(12) United States Patent
Lee et al.

(10) Patent No.: US 11,001,841 B2
(45) Date of Patent: May 11, 2021

(54) CCCTC-BINDING FACTOR (CTCF) RNA INTERACTOME

(71) Applicant: The General Hospital Corporation, Boston, MA (US)

(72) Inventors: Jeannie T. Lee, Boston, MA (US); Johnny Kung, Boston, MA (US); Barry Kesner, Charlestown, MA (US)

(73) Assignee: The General Hospital Corporation, Boston, MA (US)

( * ) Notice: Subject to any disclaimer, the term of this patent is extended or adjusted under 35 U.S.C. 154(b) by 0 days.

(21) Appl. No.: 15/952,679

(22) Filed: Apr. 13, 2018

(65) Prior Publication Data
US 2019/0309291 A1    Oct. 10, 2019

Related U.S. Application Data

(63) Continuation of application No. 14/735,930, filed on Jun. 10, 2015, now abandoned.

(60) Provisional application No. 62/010,342, filed on Jun. 10, 2014.

(51) Int. Cl.
*C07H 21/04* (2006.01)
*C12N 15/113* (2010.01)

(52) U.S. Cl.
CPC ........ *C12N 15/113* (2013.01); *C12N 2310/11* (2013.01); *C12N 2310/14* (2013.01); *C12N 2310/315* (2013.01); *C12N 2310/3231* (2013.01); *C12N 2310/341* (2013.01); *C12N 2310/531* (2013.01)

(58) Field of Classification Search
None
See application file for complete search history.

(56) References Cited

U.S. PATENT DOCUMENTS

| | | |
|---|---|---|
| 2004/0146902 A1 | 7/2004 | Ecker |
| 2005/0266422 A1 | 12/2005 | Vagle et al. |
| 2009/0215872 A1 | 8/2009 | Lee |
| 2009/0264503 A1 | 10/2009 | Chiang |
| 2011/0098342 A1 | 4/2011 | Ramadass et al. |

FOREIGN PATENT DOCUMENTS

| | | |
|---|---|---|
| WO | WO 2012/065143 | 5/2012 |
| WO | WO 2012/087983 | 6/2012 |
| WO | WO 2013/173608 | 11/2013 |

OTHER PUBLICATIONS

Bacher et al., "Transient colocalization of X-inactivation centres accompanies the initiation of X inactivation," Nat Cell Biol, 8:293-299, Jan. 24, 2006.
Bell and Felsenfeld, "Methylation of a CTCF-dependent boundary controls imprinted expression of the Igf2 gene," Nature, 405:482-485, May 25, 2000.
Berletch, et al., "Genes that escape from X inactivation," Hum Genet, 130(2):237-245, Aug. 2011.
Calabrese et al., "Site-specific silencing of regulatory elements as a mechanism of X inactivation," Cell 151(5):951-963, Nov. 21, 2012.
Carrel and Willard, "X-inactivation profile reveals extensive variability in X-linked gene expression in females," Nature, 434:400-404, Mar. 17, 2005.
Chao et al., "CTCF, a candidate trans-acting factor for X-inactivation choice," Science, 295(5553):345-347, Jan. 2002.
Chen et al., "Comprehensive identification and annotation of cell type-specific and ubiquitous CTCF-binding sites in the human genome," PLoS ONE, 7, e41374, Jul. 19, 2012.
Cifuentes-Rojas et al., "Regulatory interactions between RNA and Polycomb repressive complex 2," Molecular Cell ePub 55(2):171-185, Jul. 17, 2014.
Davidovich et al., "Promiscuous RNA binding by Polycomb repressive complex 2," Nature structural & molecular biology 20:1250-1257, Sep. 2013.
DeMare et al., "The genomic landscape of cohesin-associated chromatin interactions," Genome Res 23:1224-1234, May 2013.
Disteche, "Dosage compensation of the sex chromosomes," Annual Review of Genetics 46:537-560, Sep. 2012.
Dixon et al., "Topological domains in mammalian genomes identified by analysis of chromatin interactions," Nature, 485:376-380, May 17, 2012.
Donohoe et al., "Identification of a Ctcf cofactor, Yyl, for the X chromosome binary switch," Mol Cell 25(1):43-56, Jan. 12, 2007.
Donohoe et al., "The pluripotency factor Oct4 interacts with Ctcf and also controls X-chromosome pairing and counting," Nature 460:128-132, Jul. 2009.
Filippova "Genetics and epigenetics of the multifunctional protein CTCF," Curr Top Dev Biol 80:337-360, Oct. 2013.
Filippova et al., "Boundaries between Chromosomal domains of X inactivation and escape bind CTCF and lack CpG methylation during early development," Dev Cell, 8(1):31-42, Jan. 2005.
Handoko et al., "CTCF-mediated functional chromatin interactome in pluripotent cells," Nat Genet, 43:630-638, Jul. 2011.
Hark e al., "CTCF mediates methylation-sensitive enhancer-blocking activity at the H19/Igf2 locus," Nature, 405:486-489, May 2000.
Heard and Disteche "Dosage compensation in mammals: fine-tuning the expression of the X chromosome," Genes Dev, 20(14):1848-1867, Jul. 15, 2006.
Heintzman et al., "Histone modifications at human enhancers reflect global cell-type-specific gene expression," Nature, 459:108-112, May 7, 2009.

(Continued)

*Primary Examiner* — Kimberly Chong
(74) *Attorney, Agent, or Firm* — Fish & Richardson P.C.

(57) ABSTRACT

This invention relates to methods and compositions for selectively reactivating or downregulating certain genes, e.g., genes regulated by zinc-finger protein CCCTC-binding factor (CTCF) on autosomes (e.g., imprinted genes, tumor suppressors, cancer) and the inactive X chromosome (Xi), e.g., genes associated with X-linked diseases, e.g., Rett Syndrome, Factor VIII or IX deficiency, Fragile X Syndrome, Duchenne muscular dystrophy, and PNH, in heterozygous females carrying a mutated allele, in addition to a functional wildtype or hypomorphic allele.

16 Claims, 26 Drawing Sheets

Specification includes a Sequence Listing.

(56) References Cited

OTHER PUBLICATIONS

International Preliminary Report on Patentability in International Application No. PCT/US2015/035204, dated Dec. 22, 2016, 9 pages.
International Search Report and Written Opinion in International Application No. PCT/US2015/35204, dated Dec. 7, 2015, 19 pages.
Jensen, and Darnell, "CLIP: crosslinking and immunoprecipitation of in vivo RNA targets of RNA-binding proteins," Methods Mol Biol, 488:85-98, 2008.
Jeon and Lee, "YY1 Tethers Xist RNA to the Inactive X Nucleation Center," Cell, 146(1):119-133, Jul. 8, 2011.
Kanduri et al., "A differentially methylated imprinting control region within the Kcnq1 locus harbors a methylation-sensitive chromatin insulator," J Biol Chem, 277(20):18106-18110, May 17, 2002.
Kharchenko et al., "Design and analysis of ChIP-seq experiments for DNA-binding proteins," Nat Biotech, 26:1351-1359, Nov. 2008.
Kim et al., "Analysis of the vertebrate insulator protein CTCF-binding sites in the human genome," Cell, 128(6):1231-1245, Mar. 23, 2007.
Kung et al., "Long noncoding RNAs: Past, present, and future," Genetics 193(3):651-669, Mar. 1, 2013.
Lai et al., "Activating RNAs associate with Mediator to enhance chromatin architecture and transcription," Nature, 494:497-501, Feb. 2013.
Lanz et al., "A steroid receptor coactivator, SRA, functions as an RNA and is present in an SRC-1 complex," Cell, 97(1):17-27, Apr. 2, 1999.
Lee and Bartolomei, "X-Inactivation, Imprinting, and Long Noncoding RNAs in Health and Disease," Cell, 152(6):1308-1323, Mar. 14, 2013.
Lee and Lu, "Targeted mutagenesis of Tsix leads to nonrandom X inactivation," Cell, 99(1):47-57, Oct. 1, 1999.
Lee et al., "Tsix, a gene antisense to Xist at the X-inactivation centre," Nat Genet, 21:400-404, May 1999.
Li and Carrel, "Escape from X chromosome inactivation is an intrinsic property of the Jarid1c locus," Proc Natl Acad Sci USA, 105(44):17055-17060, Nov. 4, 2008.
Li et al., "Functional roles of enhancer RNAs for oestrogen-dependent transcriptional activation," Nature, 498:516-520, Jun. 27, 2013.
Li et al., "TCF regulates allelic expression of Igf2 by orchestrating a promoter-polycomb repressive complex 2 interchromosomal loop," Mol Cell Biol, 28(20):6473-6482, Oct. 2008.
Ling et al., "CTCF mediates interchromosomal colocalization between Igf2/H19 and Wsb1/Nf1," Science, 312(5771):269-272, Apr. 14, 2006.
Lobanenkov et al., "A novel sequence-specific DNA binding protein which interacts with three regularly spaced direct repeats of the CCCTC-motif in the 5' flaking sequence of the chicken c-myc gene," Oncogene, 5:1743-1753, 1991.
Lyon, "X-chromosome inactivation and human genetic disease," Acta Paediatr Suppl, 91(s439):107-112, Nov. 2002.
MacPherson et al., "The CTCF Insulator Protein Is Posttranslationally Modified by SUMO," Mol Cell Biol, 29(3):714-25, Feb. 2009.
Masui et al., "Live-cell chromosome dynamics and outcome of X chromosome pairing events during ES cell differentiation," Cell, 145(3):447-458, Apr. 29, 2011.
Mugford et al., "Evidence for Local Regulatory Control of Escape from Imprinted X Chromosome Inactivation," Genetics, 197(2)715-723, Mar. 19, 2014.
Nakahashi, et al. "A genome-wide map of CTCF multivalency redefines the CTCF code," Cell Rep, 3(5):1678-1689, May 30, 2013.
Navarro et al., "Molecular coupling of Tsix regulation and pluripotency," Nature, 468:457-460, Nov. 18, 2010.
Nora et al., "Spatial partitioning of the regulatory landscape of the X-inactivation centre," Nature, 485:381-385, Apr. 11, 2012.

Ogawa and Lee, "Xite, X-inactivation intergenic transcription elements that regulate the probability of choice," Mol Cell, 11(3):731-743, Mar. 2003.
Ogawa et al., "Intersection of the RNA interference and X-inactivation pathways," Science, 320(5881):1336-1341, Jun. 6, 2008.
Ohlsson et al., "CTCF is a uniquely versatile transcription regulator linked to epigenetics and disease," Trends Genet, 7(9):520-527, Sep. 1, 2001.
Ohlsson et al., "Does CTCF mediate between nuclear organization and gene expression?" BioEssays, 32(1):37-50, Jan. 2010.
Ong and Corces "CTCF: an architectural protein bridging genome topology and function," Nat Rev Genet, 15:234-246, Nov. 11, 2014.
Palstra et al., "The β-globin nuclear compartment in development and erythroid differentiation," Nat Genet, 35:190-194, Sep. 21, 2003.
Phillips-Cremins et al., "Architectural protein subclasses shape 3D organization of genomes during lineage commitment," Cell, 153(6):1281-1295, Jun. 6, 2013.
Pinter et al., "Spreading of X chromosome inactivation via a hierarchy of defined Polycomb stations," Genome Res, 22:1864-1876, Sep. 4, 2012.
Plenge et al., "Skewed X-Chromosome Inactivation Is a Common Feature of X-Linked Mental Retardation Disorders," Am. J. Hum. Genet, 71(1):168-173, Jul. 2002.
Sado et al., "Regulation of imprinted X-chromosome inactivation in mice by Tsix," Development, 128:1275-1286, Apr. 15, 2001.
Saldana-Meyer et al., "CTCF regulates the human p53 gene through direct interaction with its natural antisense transcript, Wrap53," Genes Dev, 28:723-734, 2014.
Sanyal et al., "The long-range interaction landscape of gene promoters," Nature, 489:109-113, Dec. 6, 2012.
Sarma et al., "Locked nucleic acids (LNAs) reveal sequence requirements and kinetics of Xist RNA localization to the X chromosome," Proc Natl Acad Sci USA, 107(51):22196-22201, Dec. 21, 2010.
Shen et al., "A map of the cis-regulatory sequences in the mouse genome," Nature, 488:116-120, Aug. 2, 2012.
Spencer et al., "A boundary element between Tsix and Xist binds the chromatin insulator Ctcf and contributes to initiation of X-chromosome inactivation," Genetics, 189(2):441-454, Aug. 11, 2011.
Splinter et al., "CTCF mediates long-range chromatin looping and local histone modification in the β-globin locus," Genes Dev, 20:2349-2354, Sep. 2006.
Starmer and Magnuson, "A new model for random X chromosome inactivation," Development, 136:1-10, Jan. 1, 2009.
Stavropoulos et al., "Identification of developmentally specific enhancers for Tsix in the regulation of X chromosome inactivation," Mol Cell Biol, 25(7):2757-2769, Apr. 2005.
Sun, et al., "Jpx RNA activates Xist by evicting CTCF," Cell, 153(7):1537-1551, Jun. 20, 2013.
Takahashi et al., "Application of the chromatin immunoprecipitation method to identify in vivo protein-DNA associations in fission yeast," Sci STKE, 2000(56):11, Oct. 31, 2000.
Tsai et al., "Higher order chromatin structure at the X-inactivation center via looping DNA," Dev Biol, 319(2):416-425, Jul. 15, 2008.
Van den Veyver, "Skewed X inactivation in X-linked disorders," Semin Reprod Med, 19(2):183-91, 2001.
Wahlestedt, "Targeting Long Non-Coding RNA to Therapeutically Upregulate Gene Expression," Nature Reviews, Jun. 2013, 12:433-446.
Wan and Bartolomei, "Regulation of imprinting in clusters: Noncoding RNAs versus insulators," Adv Genet, 61:207-223, 2008.
Wutz, "Gene silencing in X-chromosome inactivation: advances in understanding facultative heterochromatin formation," Nat Rev Genet 12:542-553, Aug. 2011.
Xi et al., "Identification and characterization of cell type-specific and ubiquitous chromatin regulatory structures in the human genome," PLoS Genetics, 3(8):e136, Aug. 17, 2007.
Xu et al., "Evidence that homologous X-chromosome pairing requires transcription and Ctcf protein," Nat Genet, 39:1390-1396, Oct. 2007.
Xu et al., "Transient homologous chromosome pairing marks the onset of X inactivation," Science, 311(5764):1149-1152, Jan. 19, 2006.

(56) References Cited

OTHER PUBLICATIONS

Yang et al., "Global survey of escape from X inactivation by RNA-sequencing in mouse," Genome Res, 20:614-622, Apr. 2010.

Yao et al., "Mediation of CTCF transcriptional insulation by Dead-box RNA-binding protein p68 and steroid receptor RNA activator SRA," Genes Dev, 24:2543-2555, Oct. 2010.

Zhang et al., "Interruption of intrachromosomal looping by CCCTC binding factor decoy proteins abrogates genomic imprinting of human insulin-like growth factor II," J Cell Biol, 193(3):475-487, May 2, 2011.

Zhao et al., "Genome-wide identification of polycomb-associated RNAs by RIP-seq," Mol Cell, 40(6):939-953, Dec. 22, 2010.

Zhao et al., "Polycomb proteins targeted by a short repeat RNA to the mouse X chromosome," Science, 322(5902):750-756, Oct. 31, 2008.

Obad et. al., "Silencing of microRNA families by seed-targeting tiny LNAs," Nat. Genet., Apr. 2011, 43(4):371-378.

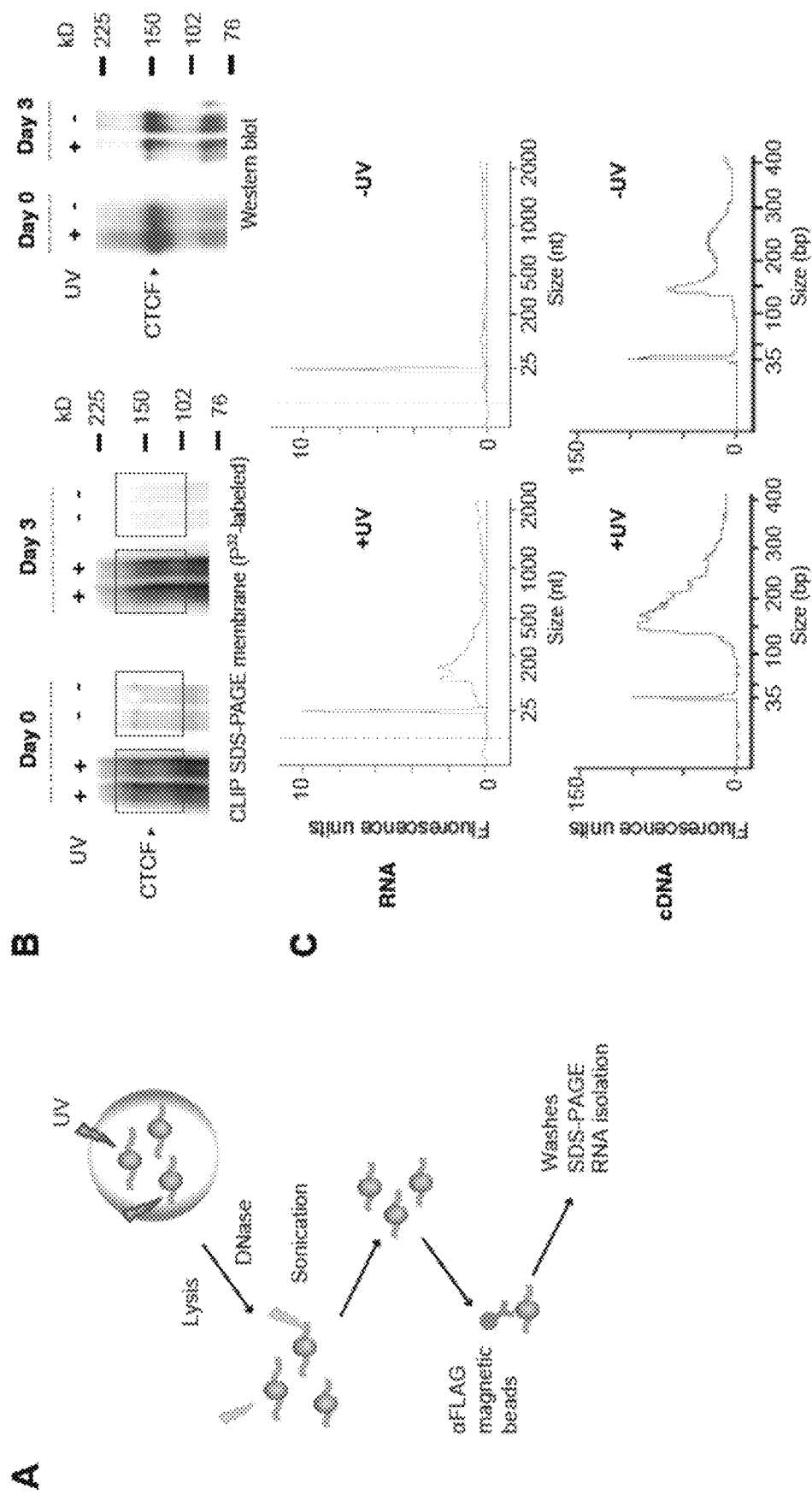
FIGs. 1A-C

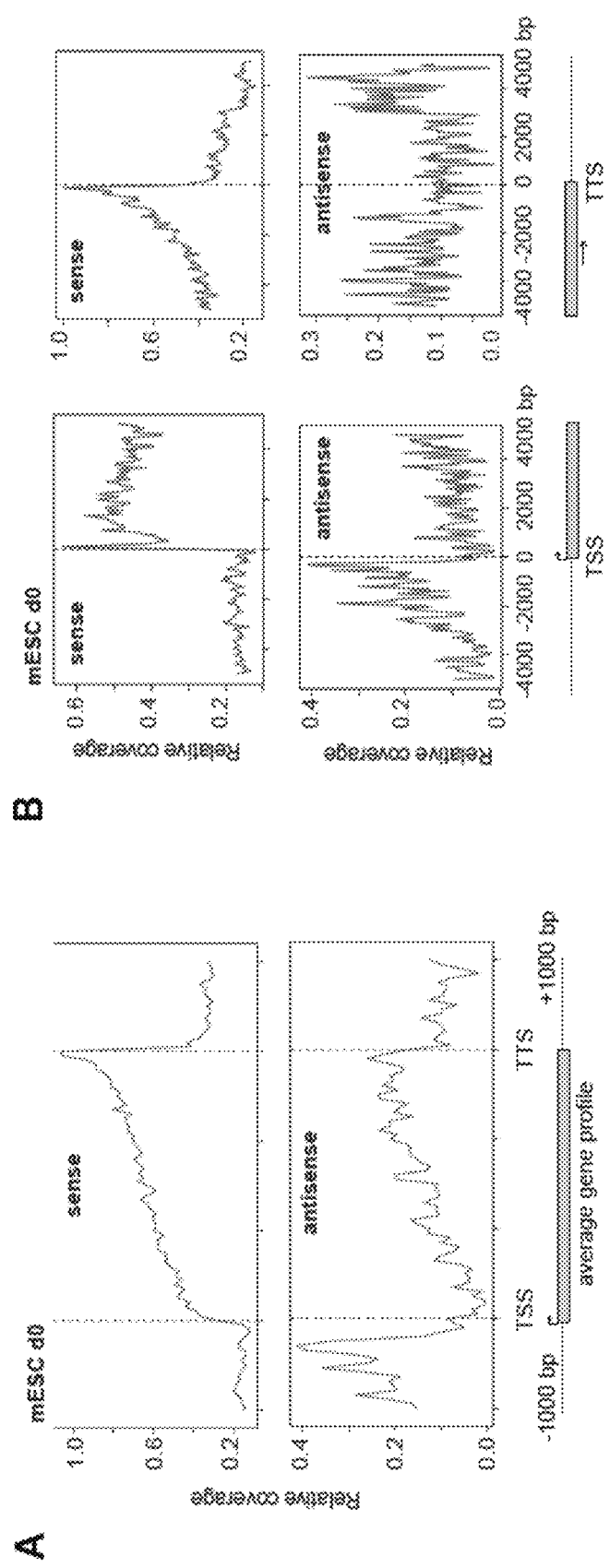
FIGs. 2A-B

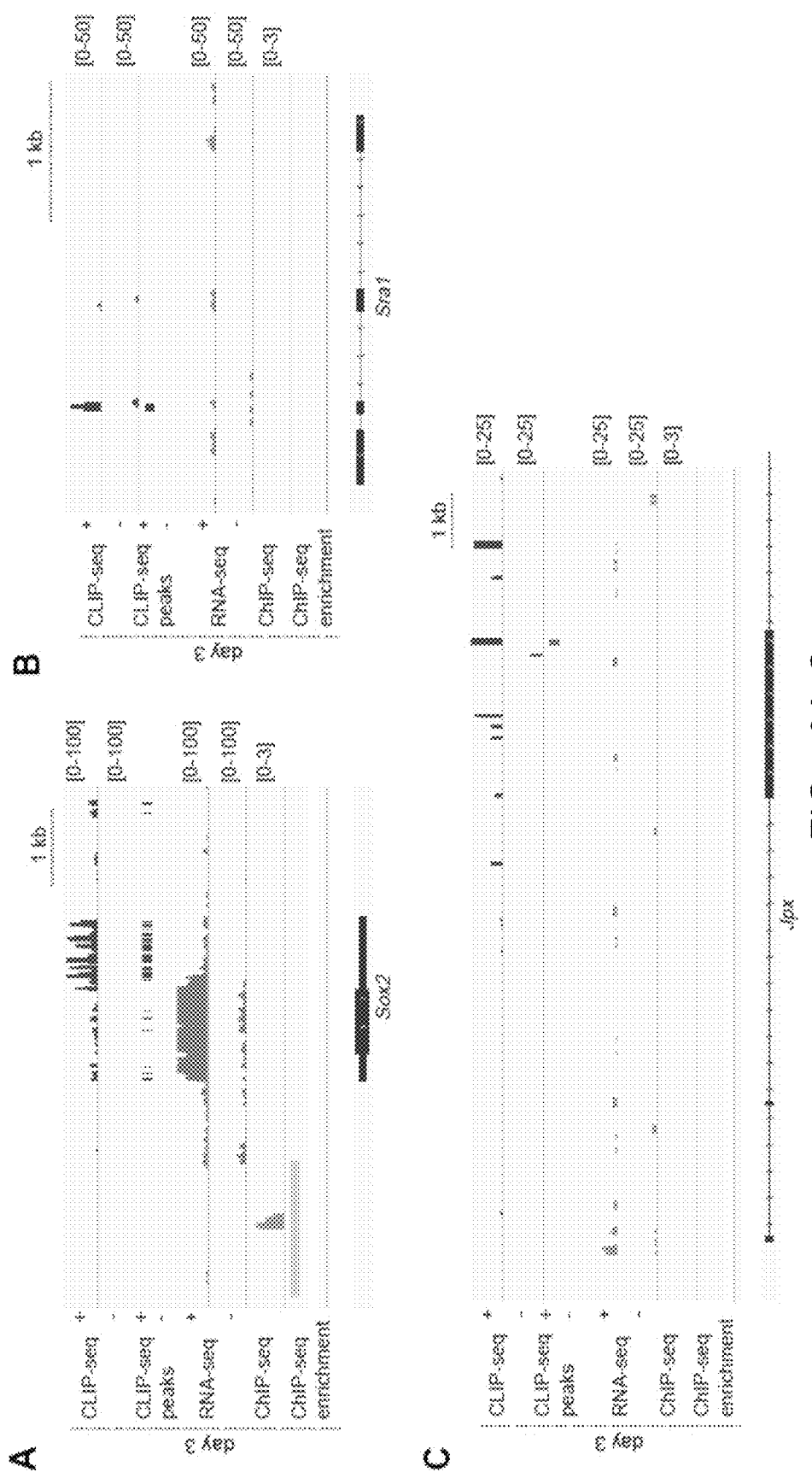
FIGs. 3A-C

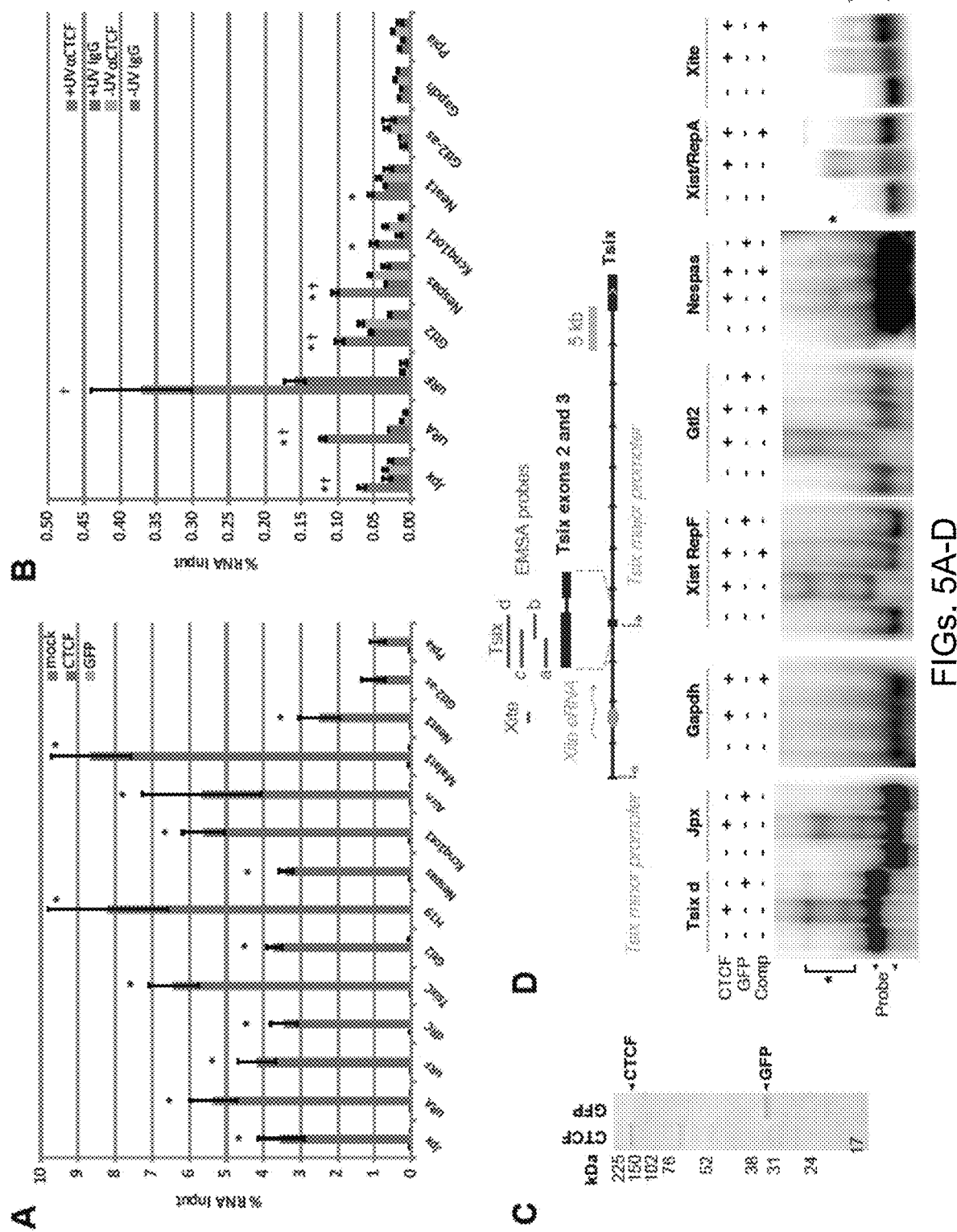
FIGs. 5A-D

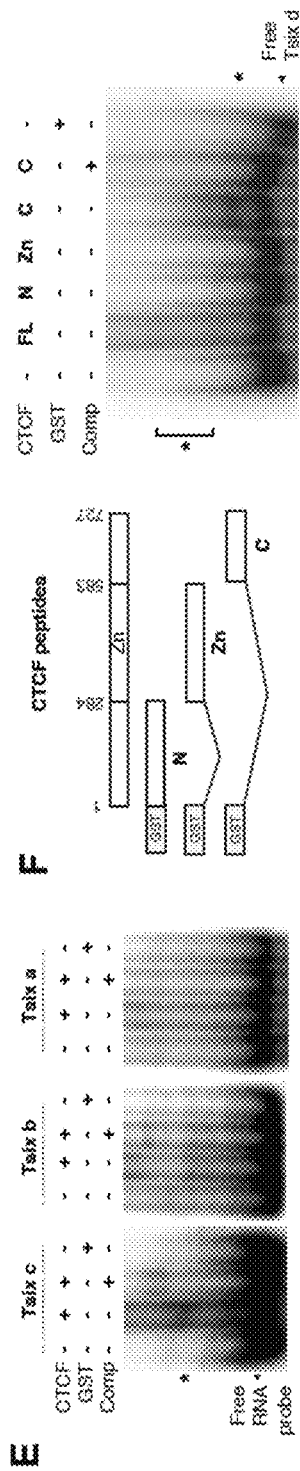
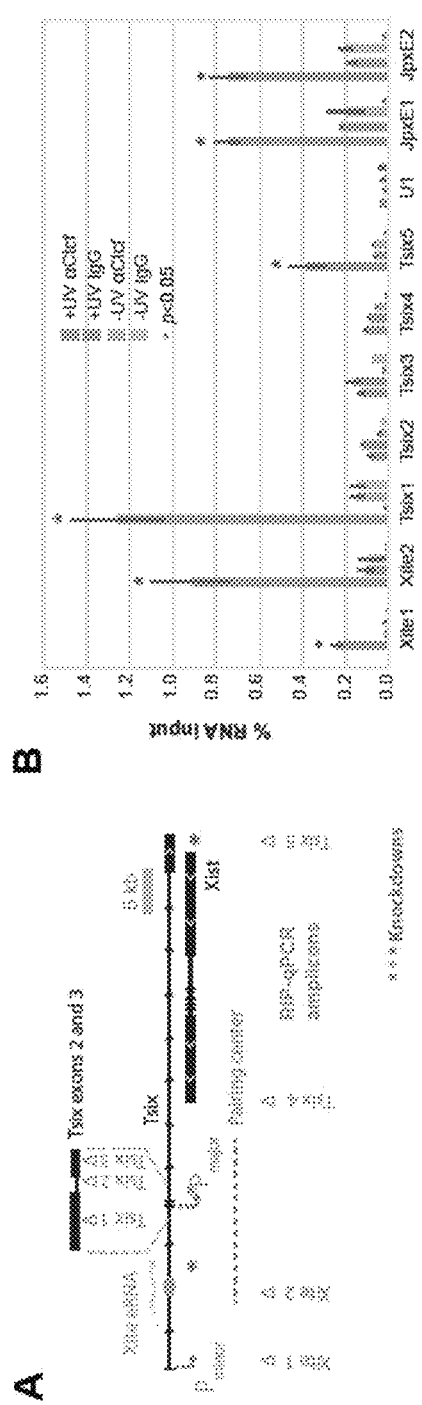
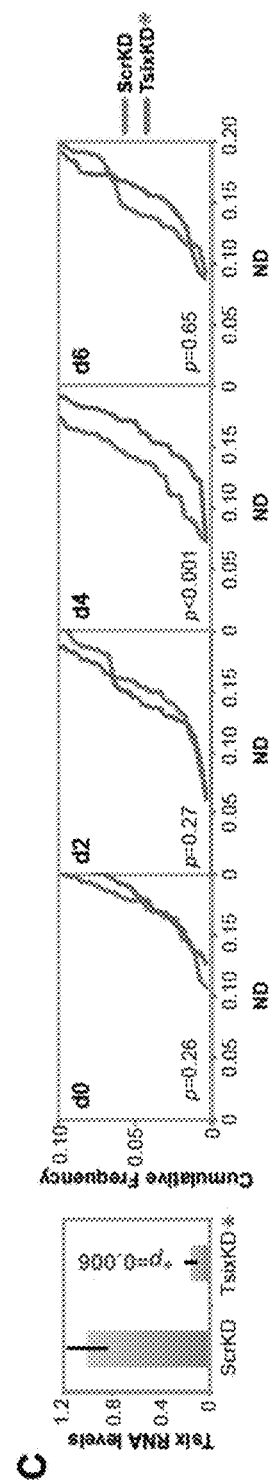
FIGs. 5E-F
FIGs. 6A-C

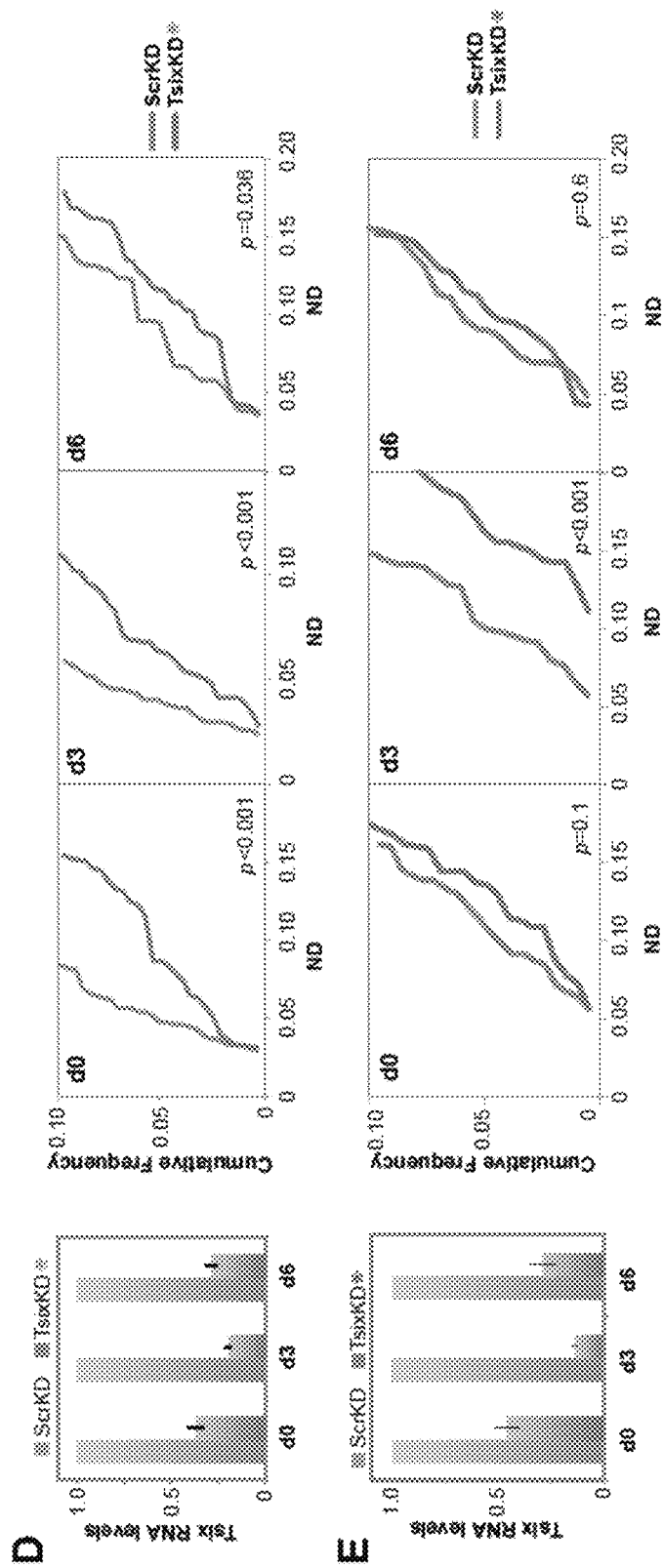
FIGs. 6D-E

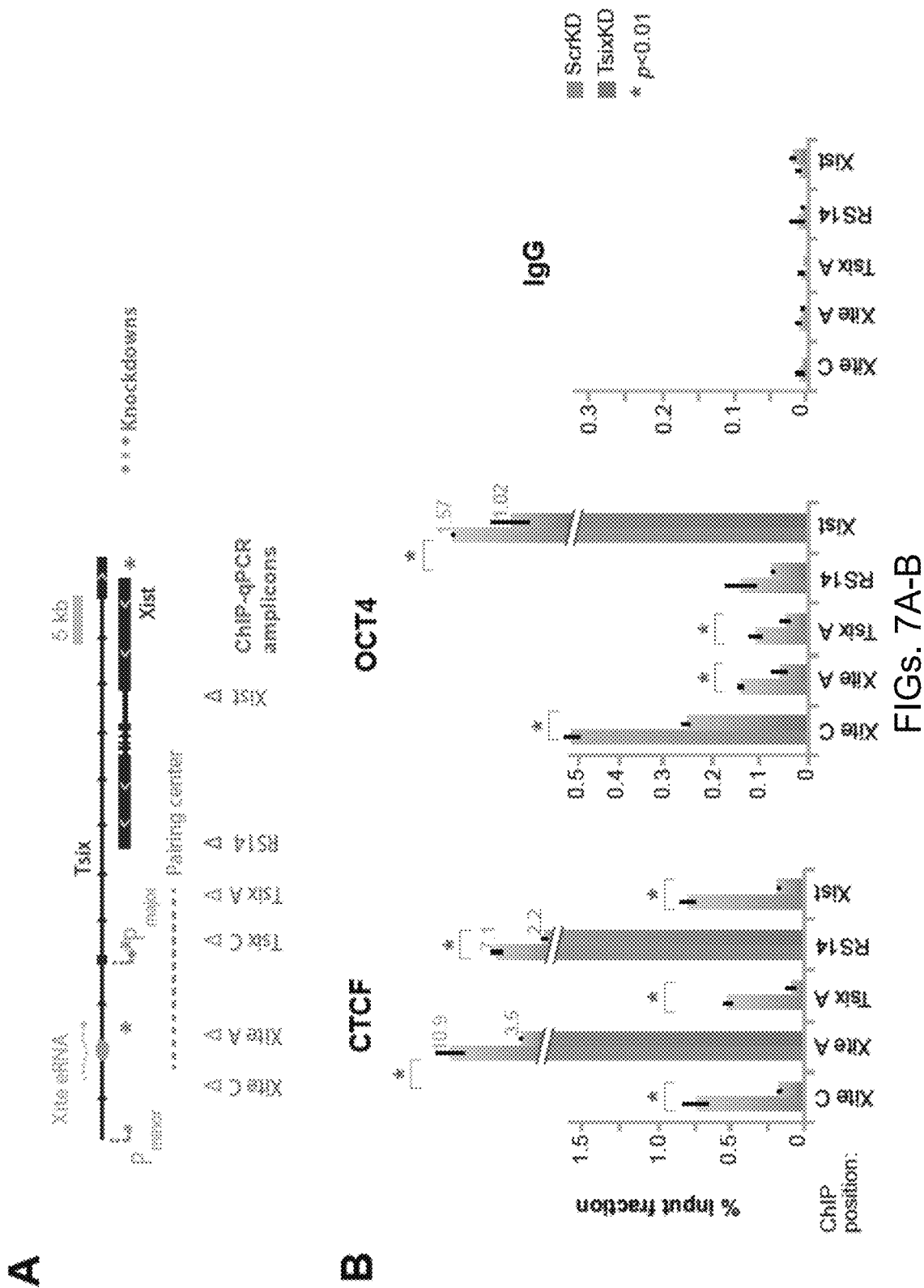
FIGs. 7A-B

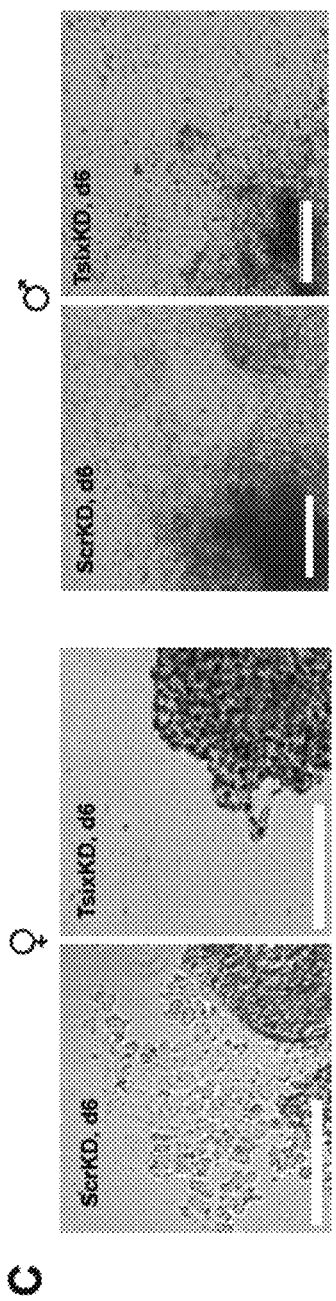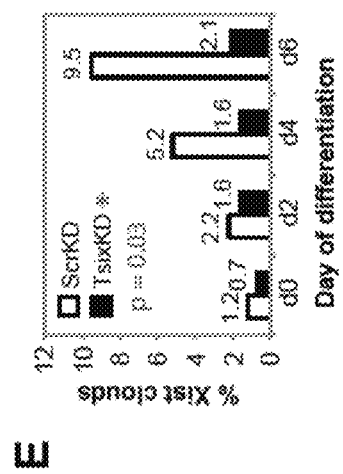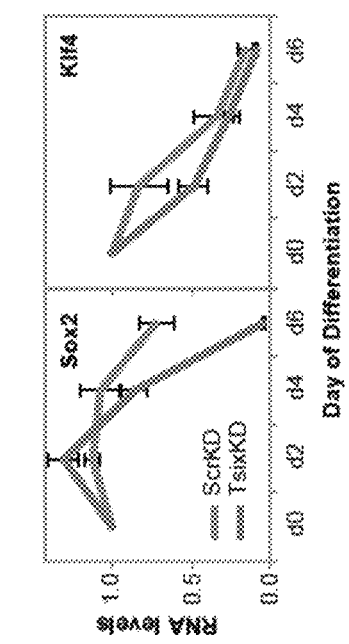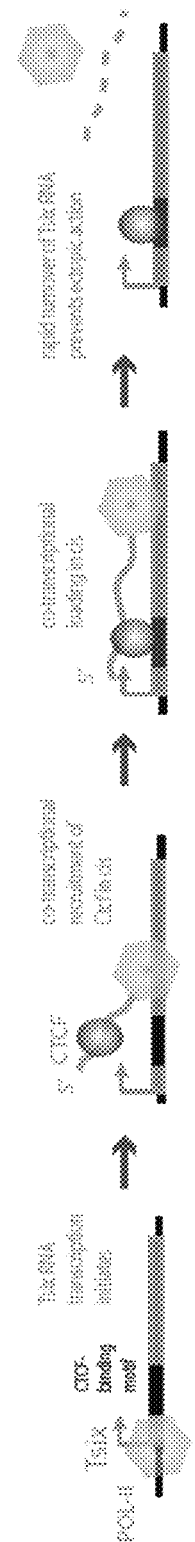
FIGs. 7C-F

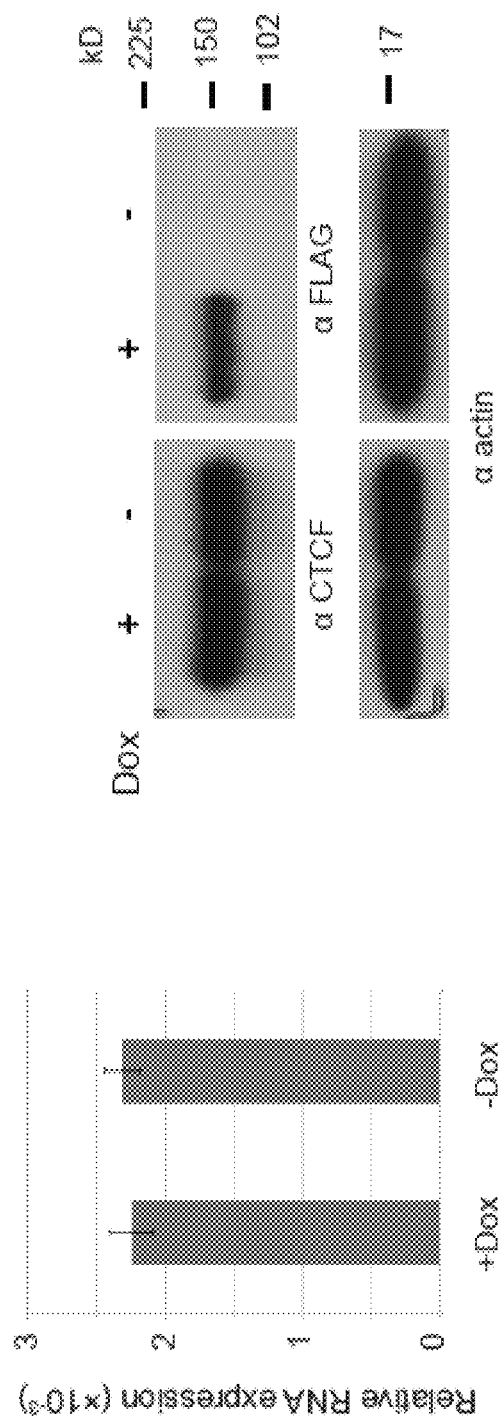

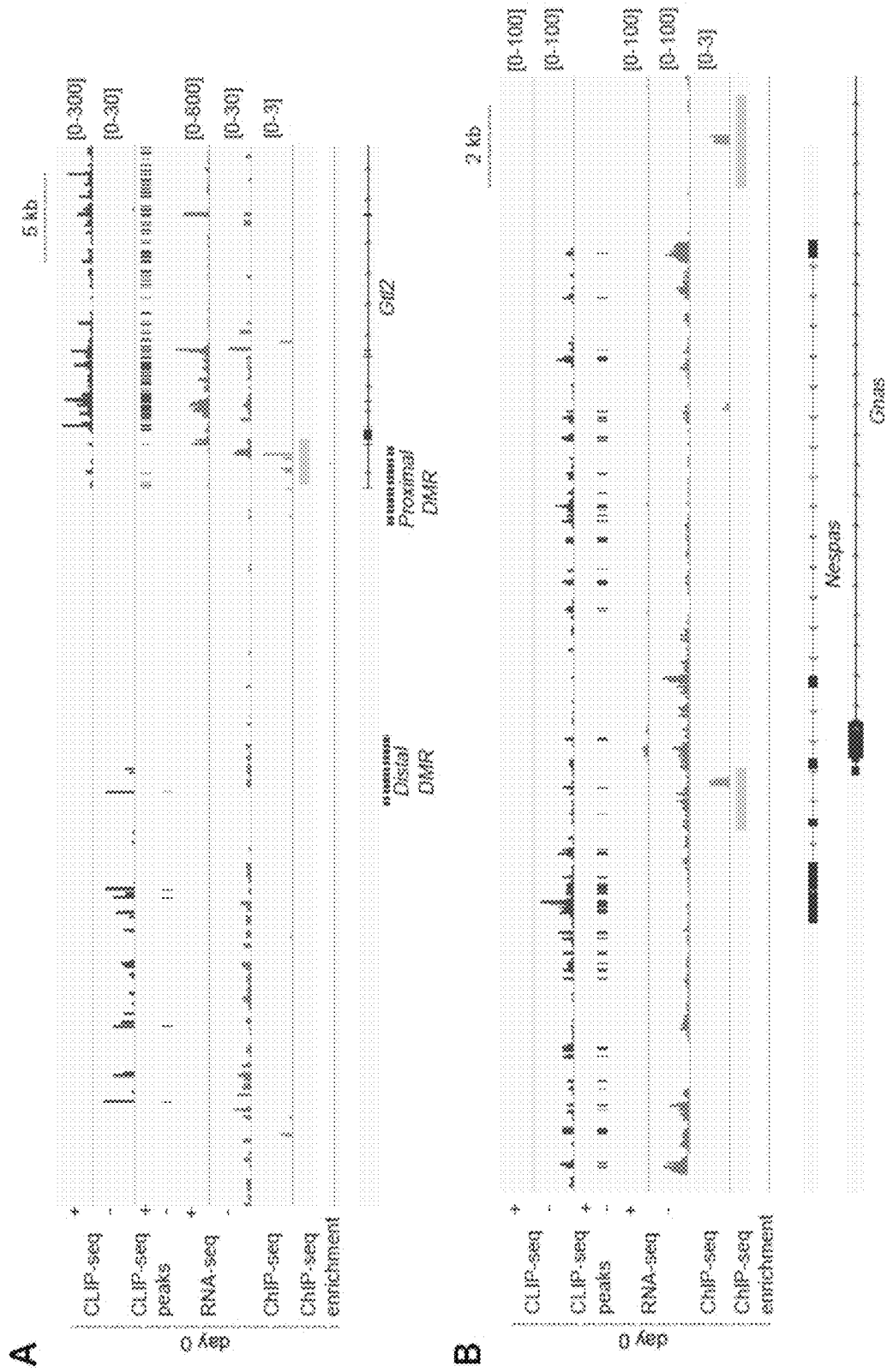
FIGs. 10A-B

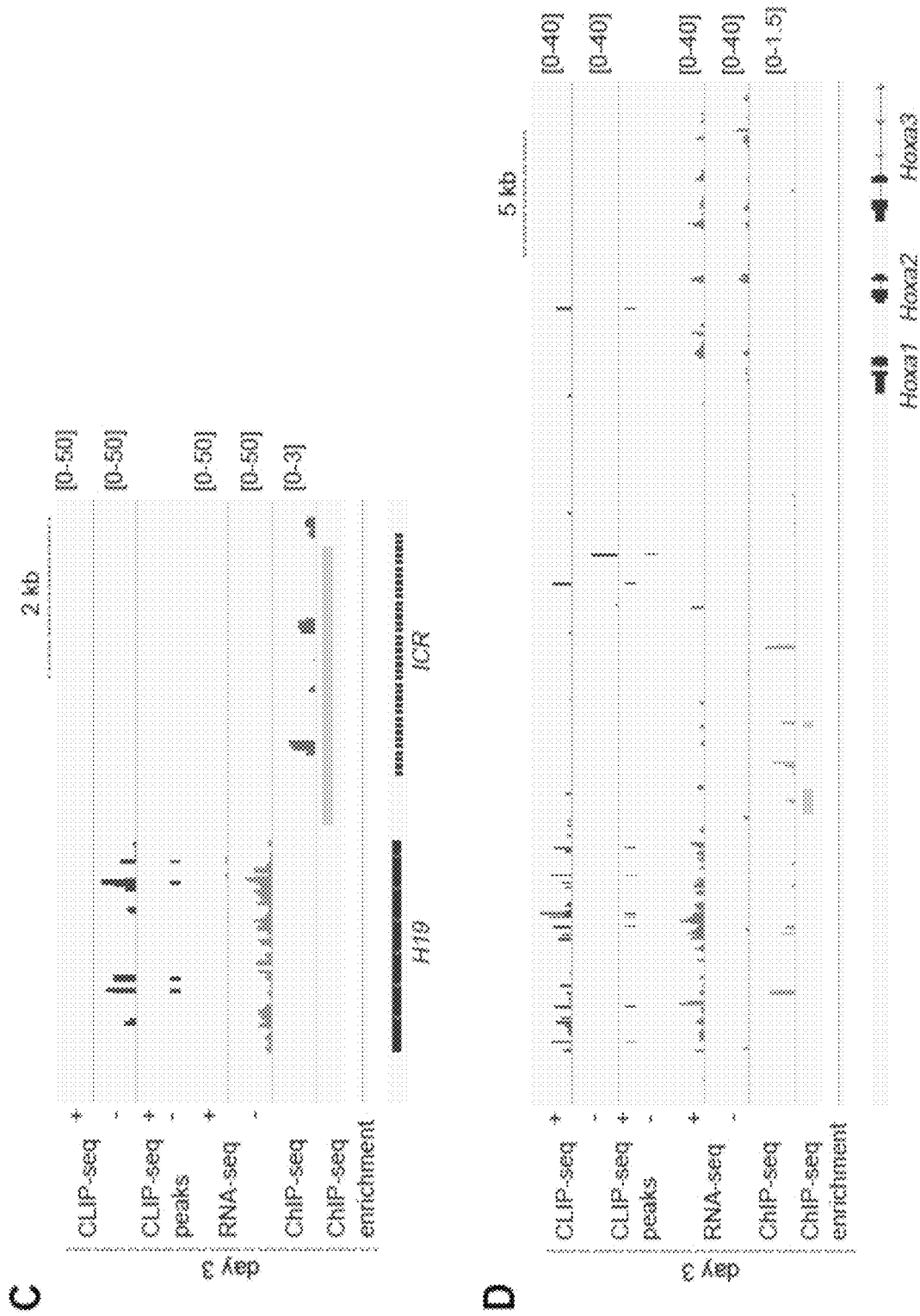
FIGs. 10C-D

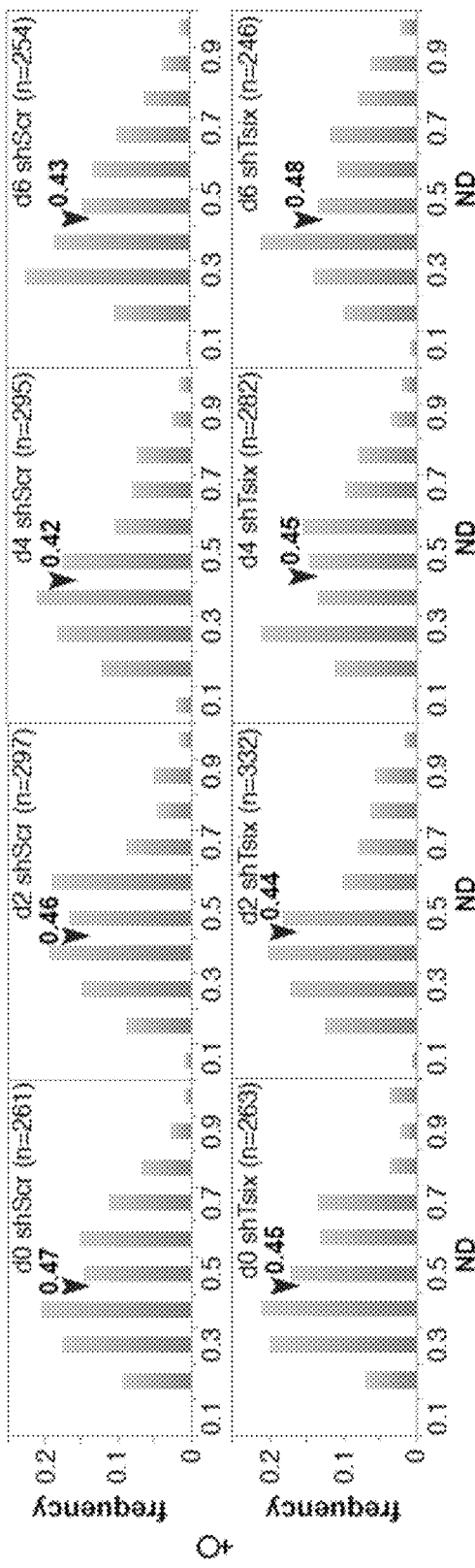
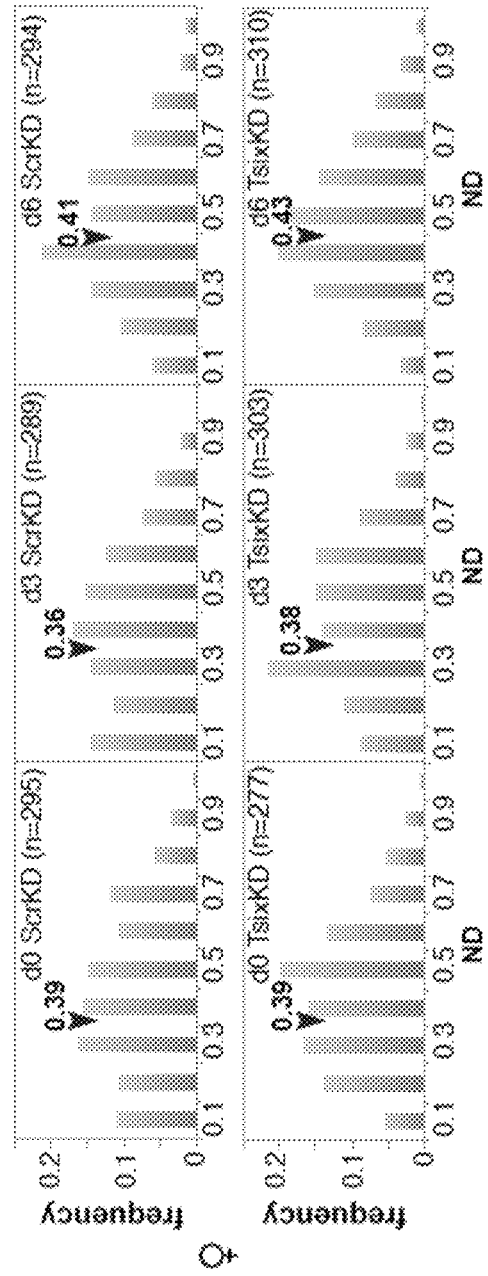
FIG. 11A
FIG. 11B

CCCTC-BINDING FACTOR (CTCF) RNA INTERACTOME

CLAIM OF PRIORITY

This application is a continuation of U.S. patent application Ser. No. 14/735,930, filed Jun. 10, 2015, which claims the benefit of U.S. Provisional Patent Application Ser. No. 62/010,342, filed on Jun. 10, 2014. The entire contents of the foregoing are hereby incorporated by reference.

FEDERALLY SPONSORED RESEARCH OR DEVELOPMENT

This invention was made with Government support under Grant No. GM58839 awarded by the National Institutes of Health. The Government has certain rights in the invention.

TECHNICAL FIELD

This invention relates to methods and compositions for selectively reactivating or repressing certain genes, e.g., genes regulated by zinc-finger protein CCCTC-binding factor (CTCF). On the inactive X chromosome (Xi), e.g., genes associated with X-linked diseases, e.g., Rett Syndrome, Factor VIII or IX deficiency, Fragile X Syndrome, Duchenne muscular dystrophy, and PNH, in heterozygous females carrying a mutated allele, in addition to a functional wildtype or hypomorphic allele.

BACKGROUND

The zinc-finger protein CCCTC-binding factor, CTCF, is a ubiquitous gene regulator that is frequently mutated or aberrantly expressed in cancer and other human diseases (Lobanenkov et al., 1990; Ohlsson et al., 2001; Kim et al., 2007; Ohlsson et al., 2010; Chen et al., 2012; Nakahashi et al., 2013). CTCF binds throughout the genome via combinatorial subsets of its 11 zinc fingers, serving as chromatin insulator, activator, or repressor depending on the epigenetic context (Filippova, 2008; Ong and Corces, 2014). One mechanism by which CTCF exercises its gene regulatory function occurs through mediation of long-range intra- and inter-chromosomal interactions that bring distant genetic elements into close proximity. In the case of intra-chromosome interactions, formation of "active chromatin hubs" (ACH)(Palstra et al., 2003; Splinter et al., 2006) results in "loop-outs" of regions that are excluded from expression.

Some of the best-studied cases of intra-chromosomal regulation by CTCF can be found in the imprinted gene cluster, H19-Igf2, where CTCF binds to an imprint control region (ICR) on the maternal allele to block the enhancer from engaging the Igf2 allele in cis, involving the formation of intrachromosomal loops between the ICR and Igf2 promoter (Bell and Felsenfeld, 2000; Hark et al., 2000; Kanduri et al., 2002; Li et al., 2008; Wan and Bartolomei, 2008; Zhang et al., 2011). Genome-wide chromosome interaction studies indicate that CTCF is often enriched at interaction boundaries at sites between genes and their distal regulatory elements (Handoko et al., 2011; Dixon et al., 2012; Sanyal et al., 2012; Shen et al., 2012; DeMare et al., 2013; Phillips-Cremins et al., 2013). CTCF may also aid inter-chromosomal associations between maternal H19-Igf2 ICR (Chr. 7) and paternal Wsb1-Nf1 (Chr. 11)(Ling et al., 2006), though the function of this interaction is unclear.

CTCF's role in epigenetic regulation has also been studied intensively for X-chromosome inactivation (XCI), the dosage compensation mechanism in mammals in which one of the two Xs in females is heterochromatinized and silenced early in development by the long noncoding Xist RNA (Heard and Disteche, 2006; Starmer and Magnuson, 2009; Wutz, 2011; Disteche, 2012; Lee and Bartolomei, 2013). During XCI, CTCF plays a number of different roles and binds a large number of sites within concentrated regions of the X-inactivation center. Here CTCF acts both in cis and in trans. In trans, CTCF-mediated inter-chromosomal interactions play a role in X-chromosome pairing, a process that has been proposed to ensure mutually exclusive choice of active versus inactive X chromosomes (Bacher et al., 2006; Xu et al., 2006; Xu et al., 2007; Donohoe et al., 2009; Masui et al., 2011). In cis, CTCF-binding sites have been correlated with intra-chromosomal interactions (Tsai et al., 2008; Spencer et al., 2011) and topologically associated domains (Nora et al., 2012) around the X-inactivation center. For example, CTCF binds the RS14 element between Xist and its antisense repressor, Tsix, to form a presumptive border between two ACH's, with one ACH involving physical interactions between promoter regions of Xist and its activator, Jpx, for the inactive X, and the other ACH centering on interactions between Tsix and its enhancer, Xite, for the active X.

SUMMARY

As described herein, crosslinking immunoprecipitation (CLIP) coupled with high-throughput sequencing (CLIP-seq) analysis was used to define an RNA interactome for CTCF in mouse embryonic stem cells (mESC) and human HEK293 kidney cells; in parallel, chromatin immunoprecipitation (ChIP) followed by high-throughput DNA sequencing (ChIP-seq) was performed to investigate the epigenomic landscape relative to interacting transcripts in the mESC. The genome-wide datasets reported here provide a useful resource for modulating CTCF's role in epigenomic regulation.

Thus, in a first aspect, the invention provides methods for activating an inactive X-linked allele in a cell, preferably a cell of a female heterozygous subject. The methods include administering to the cell an inhibitory oligonucleotide targeting a sequence within 500 nucleotides of a CTCF binding site on a CTCF-interacting RNA, i.e., complementary or identical to a region within 500 nts of a CTCF binding site, i.e., within a sequence as listed in Tables 1-2 (each of which shows a binding site sequence +500 flanking nucleotides on both sides). In some embodiments, the inactive X-linked allele is associated with an X-linked disorder, and the oligonucleotide is administered in a therapeutically effective amount.

In another aspect, the invention provides methods for activating a repressed autosomal gene in a cell. The methods include administering to the cell an inhibitory oligonucleotide targeting a sequence within 500 nucleotides of a CTCF binding site on a CTCF-interacting RNA that represses the autosome or the autosomal gene, i.e., complementary or identical to a region within 500 nts of a CTCF binding site on the RNA, i.e., within a sequence as listed in Tables 1-2 (each of which shows a binding site sequence +500 flanking nucleotides on both sides). In some embodiments, the repressed gene is associated with a disorder, and the oligonucleotide is administered in a therapeutically effective amount.

In another aspect, the invention provides methods for downregulating an X-linked escapee gene in a cell. The methods include administering to the cell an inhibitory oligonucleotide targeting a sequence within 500 nucleotides of a CTCF binding site on a CTCF-interacting RNA that increases expression of the X-linked escapee gene, i.e., complementary or identical to a region within 500 nts of a CTCF binding site on the RNA, i.e., within a sequence as listed in Tables 1-2 (each of which shows a binding site sequence +500 flanking nucleotides on both sides). In some embodiments, the X-linked escapee gene is associated with a disorder, and the oligonucleotide is administered in a therapeutically effective amount.

In another aspect, the invention provides methods for repressing an autosomal gene in a cell. The methods include administering to the cell an inhibitory oligonucleotide targeting a sequence within 500 nucleotides of a CTCF binding site on a CTCF-interacting RNA that increases expression of the autosomal gene, i.e., complementary or identical to a region within 500 nts of a CTCF binding site on the RNA, i.e., within a sequence as listed in Tables 1-2 (each of which shows a binding site sequence +500 flanking nucleotides on both sides). In some embodiments, the autosomal gene is associated with a disorder, and the oligonucleotide is administered in a therapeutically effective amount.

In a further aspect, the invention provides methods for increasing expression of a selected gene listed in Tables 1 or 2 in a cell; the methods include contacting the cell with a nucleic acid triplex-forming oligonucleotide (TFO) that binds specifically to a CTCF localization sequence or binding site associated with the selected gene.

In some embodiments, the cell is in a living subject, e.g., a human, and the oligonucleotide is optionally administered in a therapeutically effective amount.

In some embodiments, the inhibitory oligonucleotide is identical or complementary to at least 8 consecutive nucleotides of a strong or moderate binding site nucleotide sequence as set forth in Tables 1-2, or complementary to at least 8 consecutive nucleotides of a caRNA as set forth in Tables 1-2.

In another aspect, the invention provides inhibitory oligonucleotides that are complementary or identical to at least 8 consecutive nucleotides of a CTCF binding site nucleotide sequence as set forth in Tables 1-2.

In some embodiments, the oligonucleotide does not comprise three or more consecutive guanosine nucleotides.

In some embodiments, the oligonucleotide does not comprise four or more consecutive guanosine nucleotides.

In some embodiments, the oligonucleotide is 8 to 30 nucleotides in length.

In some embodiments, at least one nucleotide of the oligonucleotide is a nucleotide analogue.

In some embodiments, at least one nucleotide of the oligonucleotide comprises a 2' O-methyl. In some embodiments, each nucleotide of the oligonucleotide comprises a 2' O-methyl.

In some embodiments, the oligonucleotide comprises at least one ribonucleotide, at least one deoxyribonucleotide, or at least one bridged nucleotide.

In some embodiments, the bridged nucleotide is a LNA nucleotide, a cEt nucleotide or a ENA modified nucleotide.

In some embodiments, each nucleotide of the oligonucleotide is a LNA nucleotide.

In some embodiments, one or more of the nucleotides of the oligonucleotide comprise 2'-fluoro-deoxyribonucleotides.

In some embodiments, one or more of the nucleotides of the oligonucleotide comprise 2'-O-methyl nucleotides.

In some embodiments, one or more of the nucleotides of the oligonucleotide comprise ENA nucleotide analogues.

In some embodiments, one or more of the nucleotides of the oligonucleotide comprise LNA nucleotides.

In some embodiments, the nucleotides of the oligonucleotide comprise comprising phosphorothioate internucleotide linkages between at least two nucleotides.

In some embodiments, the nucleotides of the oligonucleotide comprise phosphorothioate internucleotide linkages between all nucleotides.

In some embodiments, the oligonucleotide is a gapmer or a mixmer.

In some embodiments of the methods described herein, the TFO comprises one or more of DNA, RNA, PNA, HNA, MNA, ANA, LNA, CAN, INA, CeNA, TNA, (2'-NH)-TNA, (3'-NH)-TNA, alpha-L-Ribo-LNA, alpha-L-Xylo-LNA, beta-D-Ribo-LNA, beta-D-Xylo-LNA, [3.2.1]-LNA, Bicyclo-DNA, 6-Amino-Bicyclo-DNA, 5-epi-Bicyclo-DNA, alpha-Bicyclo-DNA, Tricyclo-DNA, Bicyclo[4.3.0]-DNA, Bicyclo[3.2.1]-DNA, Bicyclo[4.3.0]amide-DNA, beta-D-Ribopyranosyl-NA, alpha-L-Lyxopyranosyl-NA, 2'-R-RNA, 2'-OR-RNA, 2'-AE-RNA, alpha-L-RNA, and beta-D-RNA.

In some embodiments of the methods described herein, the TFO includes one or more modifications described herein.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

REFERENCE TO SEQUENCE LISTING SUBMITTED ON A COMPACT DISC

This application includes a sequence listing submitted on compact disc. The sequence listing is identified on the compact disc as follows.

| File Name | Date of Creation | Size |
| --- | --- | --- |
| 29539-0115002 SEQ LIST.txt | Apr. 13, 2018 | 238,862 KB |

The entire content of this file is hereby incorporated by reference.

DESCRIPTION OF DRAWINGS

The patent or application file contains at least one drawing executed in color. Copies of this patent or patent application publication with color drawing(s) will be provided by the Office upon request and payment of the necessary fee.

FIGS. 1A-E. CLIP-seq identifies a large CTCF-RNA interactome.

(A) Schematic for modified CLIP-seq protocol.

(B) Autoradiographs ($^{32}$P, top) and α-FLAG Western blots (bottom) for CLIP, performed in CTCF-3xFLAG expressing d0 and d3 mESC with or without UV (256 nm)

irradiation. Location of FLAG-CTCF-bound RNA indicated with bracket on autoradiograph. Red boxes indicate regions of membrane excised for RNA isolation and library synthesis.

(C) Agilent Bioanalyzer profiles of membrane-isolated RNA (top) and corresponding CLIP-seq library (bottom) from d0 experiments. ±UV, with or without UV irradiation. Spike at 25 nt (for RNA) or 35 bp (for DNA) are the lower markers for Bioanalyzer runs.

(D) Scatterplot comparing +UV and −UV library reads. Fragments per kilobase per million reads (FPKM) were calculated from both libraries over transcripts that were assembled from RNA-seq data. Loge values of FPKM were plotted; d0 data shown. Red line is x=y diagonal. Pearson's correlation (R)=0.773, p<<0.0001.

(E) Enrichment of total, sense and antisense CTCF CLIP peaks, from day 0 mESC, in various genomic regions as compared to reference mouse genome.

FIGS. 2A-E. Characterization of the CTCF RNA interactome.

(A) Average CLIP peaks profile over a 3-kb metagene, as well as 1 kb up- or down-stream, for d0 CLIP peaks that are sense or antisense to RefSeq annotated genes.

(B) Average profile of d0 CLIP peaks between 0-4 kb up- or downstream of transcription start site (TSS) or transcription termination site (TTS).

(C) Scatterplot comparing CLIP-seq and RNA-seq coverage. Fragments per kilobase per million reads (FPKM) were calculated for both libraries, and their loge values were plotted against each other; d3 data shown. Transcripts were assembled from RNA-seq data. For CLIP-seq, coverage under all peaks within each transcript was summed for division over the transcript length. Red line is x=y diagonal. Position of various RNAs of interest indicated. Pearson's correlation (R)=0.287, p=2.94×10$^{-178}$.

(D) Metagene profiles comparing d3 CTCF CLIP (red) and ChIP (blue) peaks.

(E) Average profile of d3 ChIP peaks relative to CLIP peaks. CLIP-seq peak is centered at bp 0 on the x-axis.

FIGS. 3A-E. The RNA interactome and epigenomic landscape of CTCF.

Normalized CTCF CLIP-seq, ChIP-seq and RNA-seq signals for (A) Sox2, (B) Sra1, (C) Jpx, (D) 5' end of Xist, and (E) Xite and 5' end of Tsix. Below each CLIP and ChIP tracks are corresponding "peaks", defined as statistically significant CLIP and ChIP enriched segments. Regions of interest within Xist and Tsix indicated by red dashed bar. RNA data are divided into strand-specific tracks, with + strand being the Watson strand.

Figure 4A:
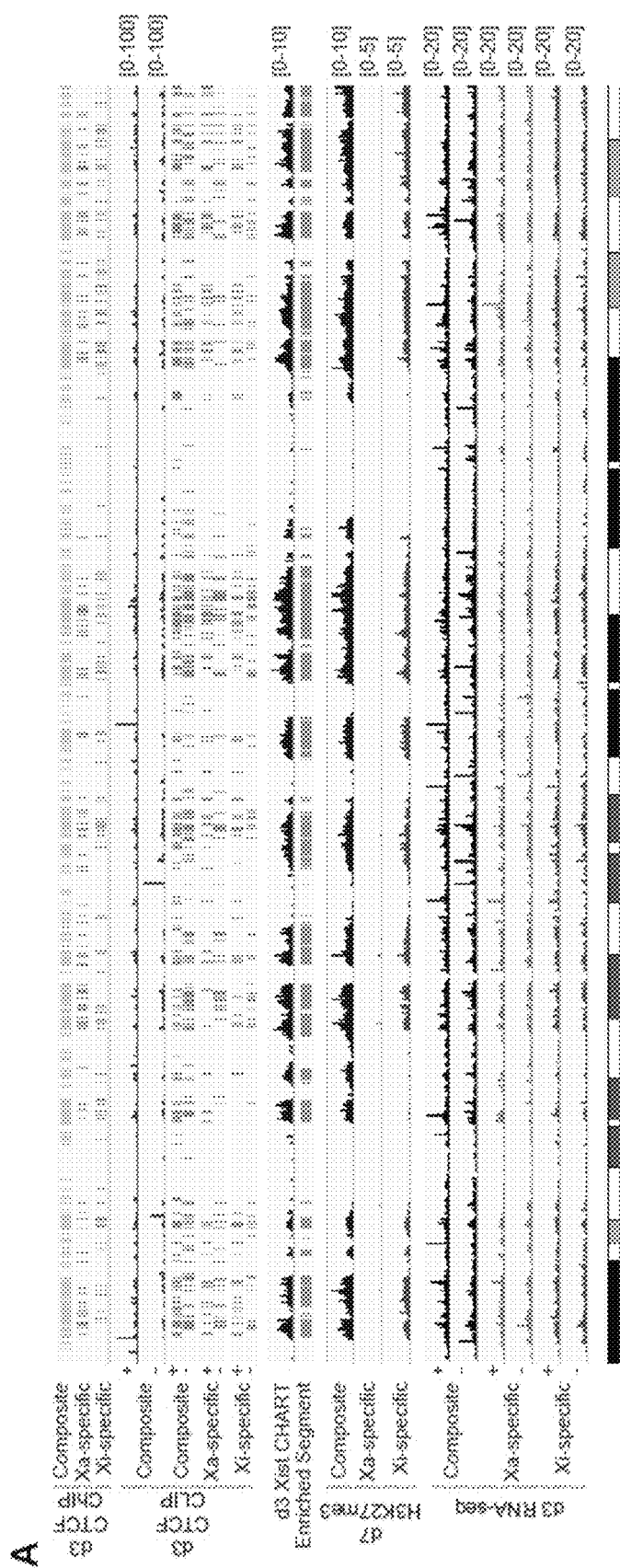
Figure 4B:
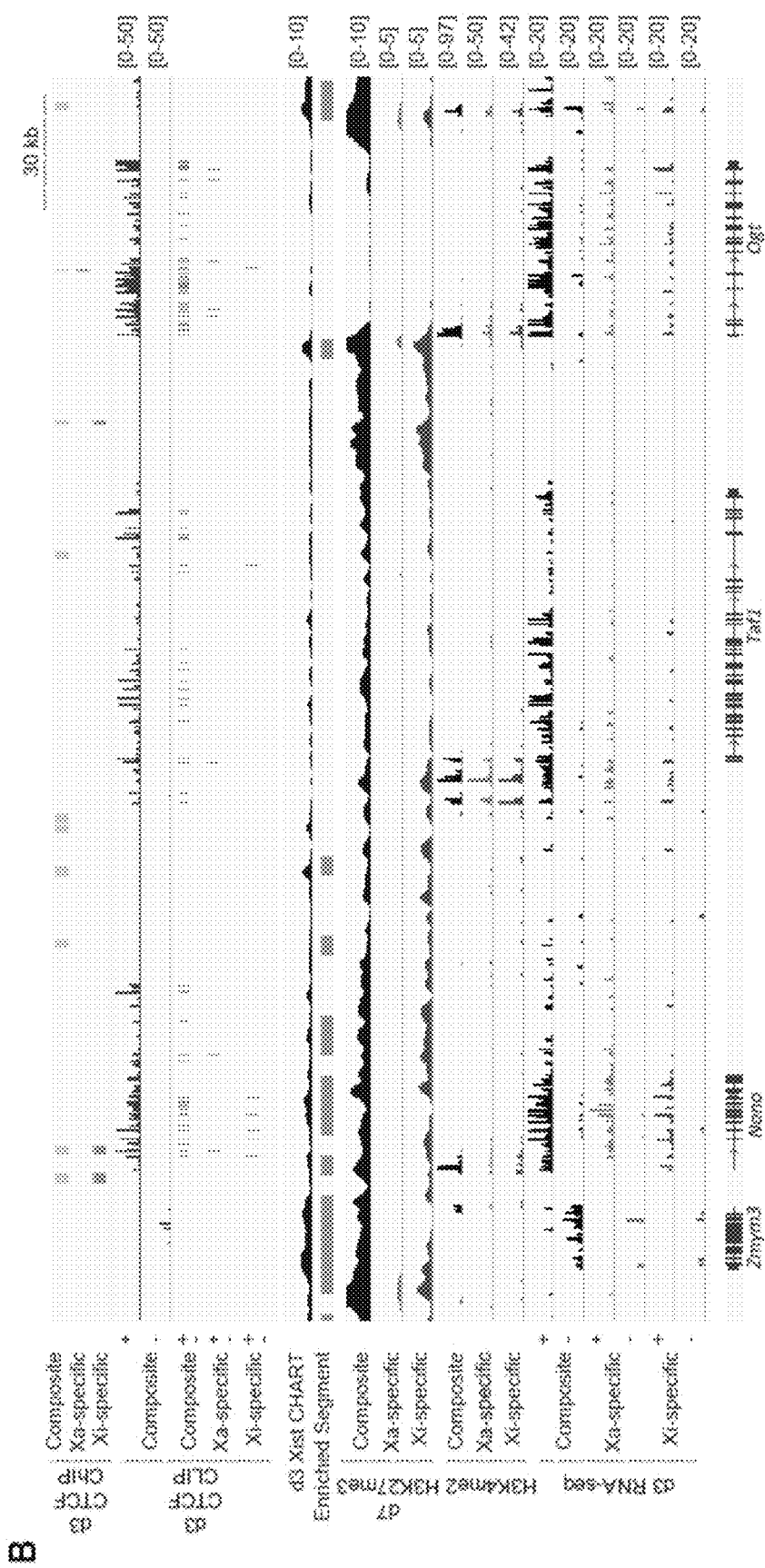
Figure 4C:
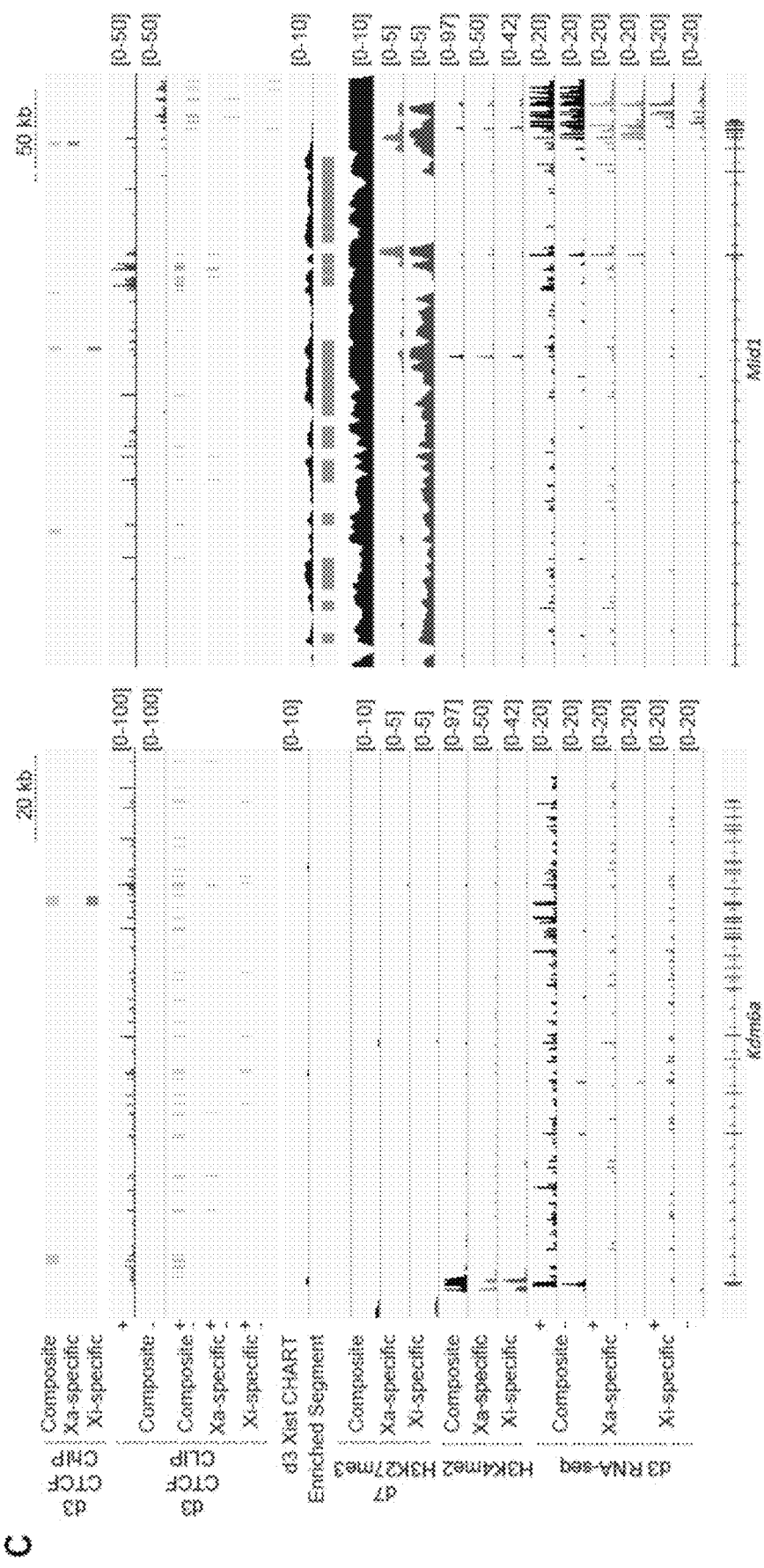

FIGS. 4A-C. Allele-specific binding of CTCF on the X-chromosome.

Day 3 CTCF ChIP peaks, CLIP peaks, and RNA-seq signal over (A) entire X chromosome, (B) Zmym-Nono-Taf1-Ogt region, (C) Kdm6a (left) and Mid1 (right). Only statistically significant ChIP and CLIP peaks are shown. Composite=sum of all peaks (cas, mus, and neutral). Xa-specific=enriched on cas chromosome. Xi-specific=enriched on mus chromosome. Day 3 ES composite Xist CHART, day 7 ES allelic H3K27me3 ChIP (Simon et al., 2013), and mouse embryonic fibroblast allelic H3K4me3 ChIP (Yildirim et al., 2012) data also included for comparison.

FIGS. 5A-F. CTCF binds RNA with high affinity and specificity.

(A) qRT-PCR for in vitro RNA pulldown with FLAG-CTCF, FLAG-GFP and mock pulldown. Results are expressed as percent of RNA in input sample. Representative results from four biological replicates shown. Means±1 SD shown. *, p<0.05, as determined by unpaired two-tailed Student's t-test comparing each amplicon to Ppia. RepA, RepF, RepC: Xist Repeats A, F and C. Ppia and Gtl2-as are negative controls.

(B) UV-RIP qRT-PCR, comparing αCTCF and IgG immunoprecipitation performed on UV-crosslinked or uncrosslinked day 3 ES cells. Results are expressed as percent of RNA in input sample. Representative results from three biological replicates shown. Means±1 SD shown. *, significant enrichment (p<0.05, determined by unpaired two-tailed Student's t-test) of +UV αCTCF pulldown over +UV IgG pulldown; †, significant enrichment of +UV αCTCF pulldown over −UV αCTCF pulldown. Ppia, Gapdh and Gtl2-as are negative controls.

(C) Coomassie staining of FLAG-CTCF and FLAG-GFP on an SDS-PAGE.

(D) RNA EMSA using 1.5 pmol of purified recombinant FLAG-CTCF or FLAG-GFP and 0.5 pmol of various in vitro-transcribed, end-labelled RNA probes. Comp, unlabelled competitors at 40× molar excess. *, CTCF-RNA shift. Jpx is positive control, Gapdh is negative control. Map of Xite/Tsix and EMSA probes are shown above the gels.

(E) RNA EMSA using 1.5 pmol of purified recombinant FLAG-CTCF or FLAG-GFP and 0.5 pmol of various Tsix RNA fragments (as shown in map in panel D). Comp, unlabelled competitors at 40× molar excess. *, CTCF-RNA shift.

(F) RNA EMSA with 0.5 pmol of purified Tsix probe d and 1.5 pmol of recombinant, purified CTCF full-length protein (FL), GST-CTCF fragments: N, N-terminal domain (aa 1-284); Zn, zinc-finger domain (aa 284-583); C, C-terminal domain (aa 583-727); or GST alone. Comp, unlabelled competitors at 40× molar excess. *, CTCF-RNA shift.

FIGS. 6A-E. Tsix RNA is Required for X-X Pairing (A) Map of Xic and pairing center, with positions for RIP qPCR primers and EMSA probes (arrowheads). Tsix antagomirs (asterisks): blue, shRNA; green, LNA; red, LNA. The Tsix major promoter accounts for 90% of Tsix transcripts. Position of the Tsix$^{TST}$ truncation allele is shown. Xite enhancer expresses an eRNA.

(B) RIP-RT-qPCR, + or −UV, on d3 female ES cells at various RNA domains with Tsix and Xite, with Jpx as positive control and U1 snRNA as negative control. qPCR positions shown in panel A. Representative results from two biological replicates shown. All values normalized to 1% of input RNA. Means±1 s. d. shown. p, determined by unpaired two-tailed Student t-tests comparing CTCF to IgG pull-downs in the +UV samples.

(C) Effect of TsixKD on pairing in female clones stably expressing shTsix versus shScr. DNA FISH using a two-probe combination of RP24 (centromeric) and pSx9 (Xist/Tsix) was performed. To exclude XO artifacts, only nuclei with two RP24 signals were scored. Cumulative frequency curves shown for decile with closest X-X distances. Whole distributions shown in FIG. 11A-C. The significance of the difference, p, in pairwise comparisons between ScrKD and TsixKD on various differentiation days is determined using unpaired two-tailed Student t-tests. Representative results shown for two independent biological replicates. Sample sizes, n: ScrKD: 261 (d0), 297 (d2), 295 (d4), 254 (d6); TsixKD: 263 (d0), 332 (d2), 282 (d4), 246 (d6).

(D,E) Quantitation of Tsix RNA after ScrKD versus TsixKD using two LNAs. Pairing analysis performed as in panel C. Whole distributions shown in FIG. 11A-C. Representative results shown from 2-3 independent biological replicates. D, sample sizes: ScrKD: 295 (d0), 289 (d3), 294

(d6); TsixKD: 277 (d0), 303 (d3), 310 (d6). E, sample sizes: ScrKD: 212 (d0), 186 (d3), 171 (d6); TsixKD, 205 (d0), 202 (d3), 186 (d6).

FIGS. 7A-F. Tsix RNA Recruits CTCF to Binding Sites in Xic (A) Map of Xic and pairing center, with positions for ChIP primers. Tsix antagomirs (asterisks) as in FIG. 6A.

(B) ChIP-qPCR in stable shTsix or shScr KD clones. Representative results from four biological replicates shown. Means±1 SD shown. p determined by unpaired two-tailed t-tests.

(C) EB outgrowth of shTsix KD ES cells was severely compromised. Scale bar, 100 μm.

(D) Pluripotency markers are appropriately downregulated in female shTsix KD cells, suggesting proper cell differentiation. Means±1 SD shown.

(E) Xist RNA FISH in shRNA TsixKD versus ScrKD during differentiation. P, determined by $x^2$ test comparing the distribution of Xist+ cells for ScrKD versus TsixKD from d0, d2, d4, and d6; [(observed-expected)$^2$/expected], degrees of freedom=3.

(F) Site-specific action of Tsix RNA facilitates locus-specific targeting of CTCF. POL-II transcribes Tsix RNA, which remains tethered to the site of synthesis as the RNA recruits CTCF to the locus. Co-transcriptional tethering, coupled to rapid turnover of Tsix ($t_{1/2}$, 30-60 min), enables the RNA to act in cis and in a locus-specific manner.

FIGS. 8A-B. CTCF is expressed at physiological levels in the inducible FLAG-CTCF mESC line.

(A) qRT-PCR of CTCF RNA level, normalized to GAPDH RNA level, with or without 24-hr induction with 1 μg/mL of doxycycline (Dox) induction.

(B) Immunoblot of nuclear lysate, with or without Dox induction, with a CTCF, a FLAG and a actin antibodies.

Figure 9A:
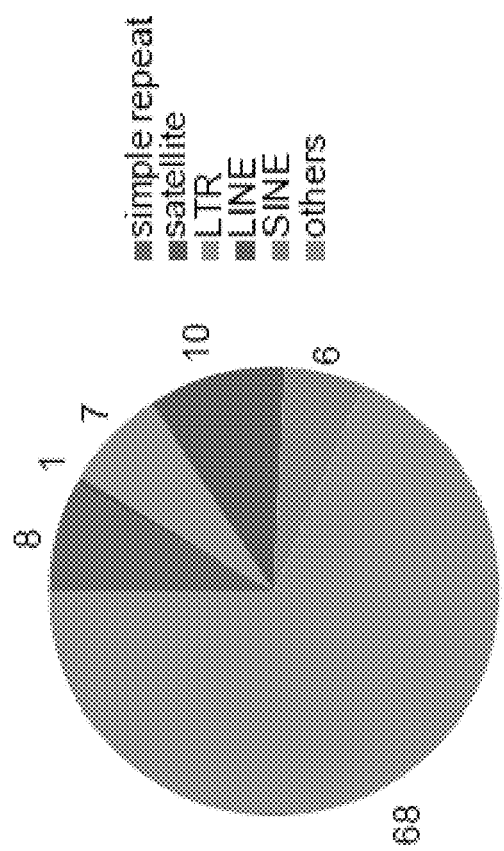
Figure 9B:
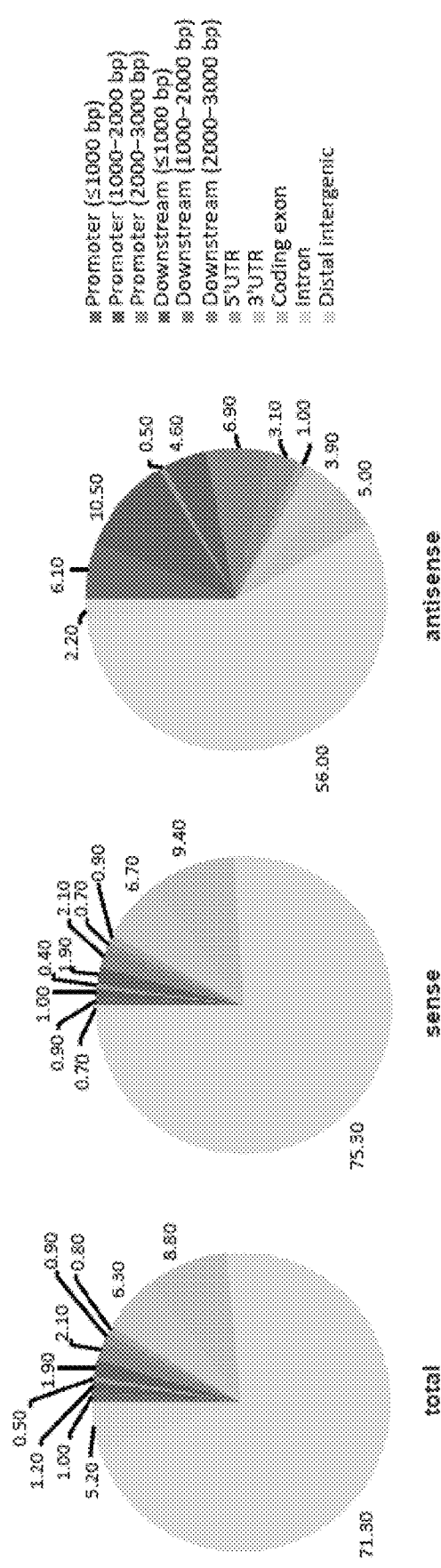
Figure 9C:
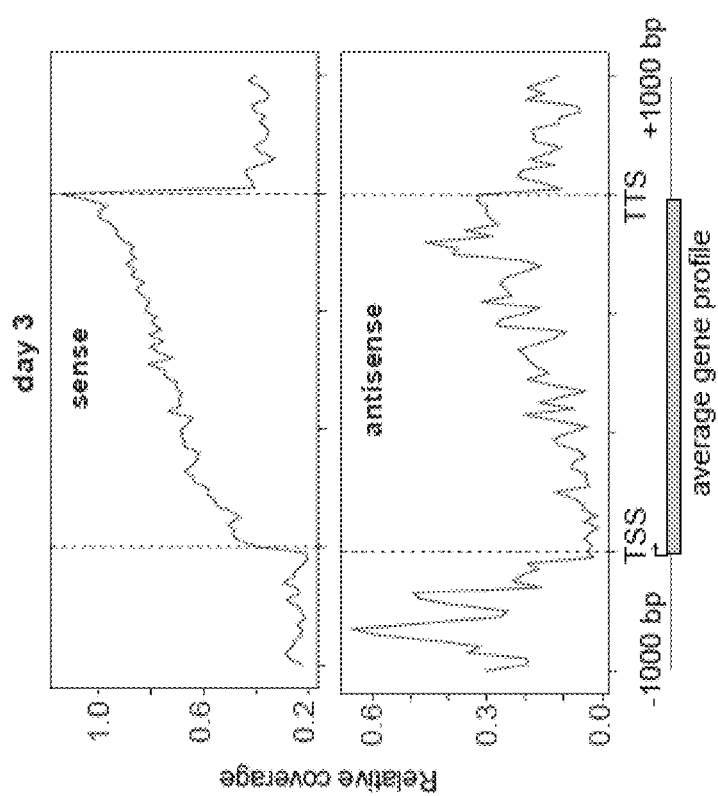

FIGS. 9A-C. Metagene analysis of CLIP-seq peaks in day 3 mESC.

(A) Percentage of multiple-mapping reads in d0+UV library that are in various classes of repetitive elements.

(B) Percentage of total, sense and antisense CTCF CLIP peaks, from d3 mESCs, in various genomic regions.

(C) Average CLIP peaks profile over a 3-kb metagene, as well as 1 kb up- or downstream, for d3 CLIP peaks that are sense or antisense to RefSeq annotated genes.

FIGS. 10A-D. The CTCF RNA interactome and epigenomic landscape at additional loci.

(A) 5' end of Gtl2 and upstream sequence. DMR, differentially methylated region.

(B) Nespas-Gnas cluster.

(C) H19. ICR, imprinting control region.

(D) Hoxa1, -2, -3, and upstream sequence.

Figure 11C:
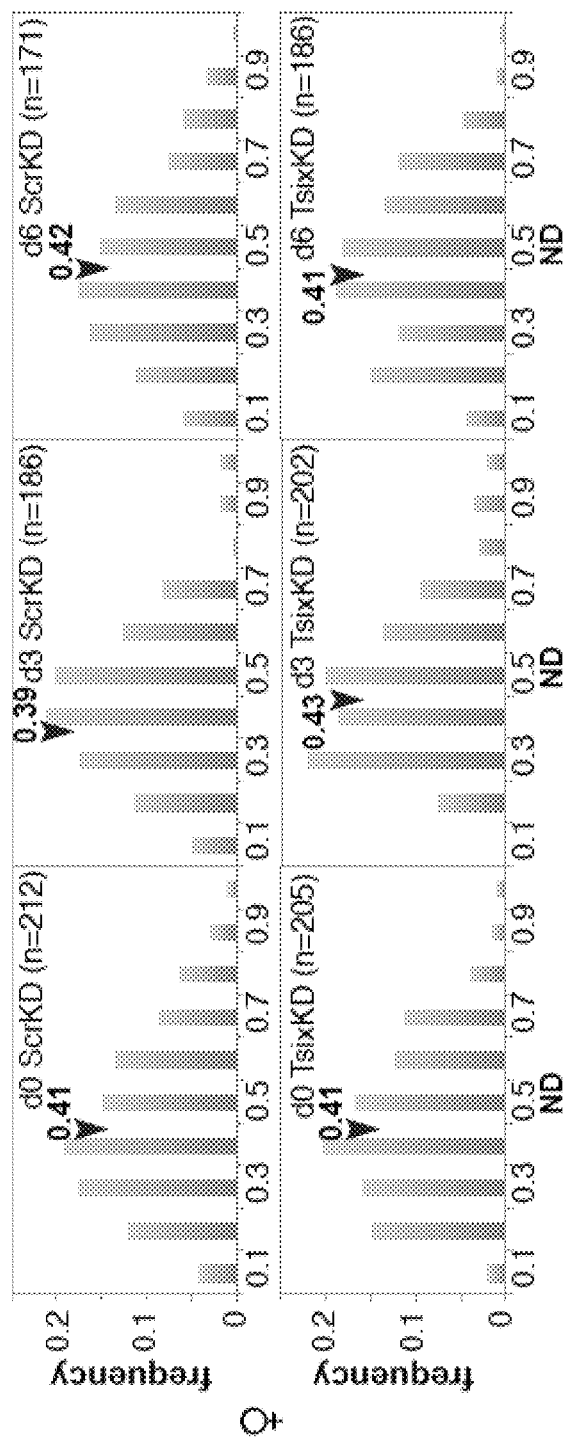

FIGS. 11A-C. Distribution of inter-Xic distances in control and Tsix-knockdown mESCs.

(A) Normalized distance (ND) distribution profiles of shScr and shTsix, corresponding to cumulative frequency (CF) curves in FIG. 6C. Arrowheads, Mean of ND. ND=X-X distance/d, where d=2*(nuclear area/π)$^{0.5}$. ND ranges from 0 to 1. Samples sizes are indicated in parentheses.

(B,C) ND distribution profiles of ScrKD and TsixKD, corresponding to CF curves in FIG. 6D,E. Arrowheads, Mean of ND. Representative results from three independent biological replicates.

Figure 12A:
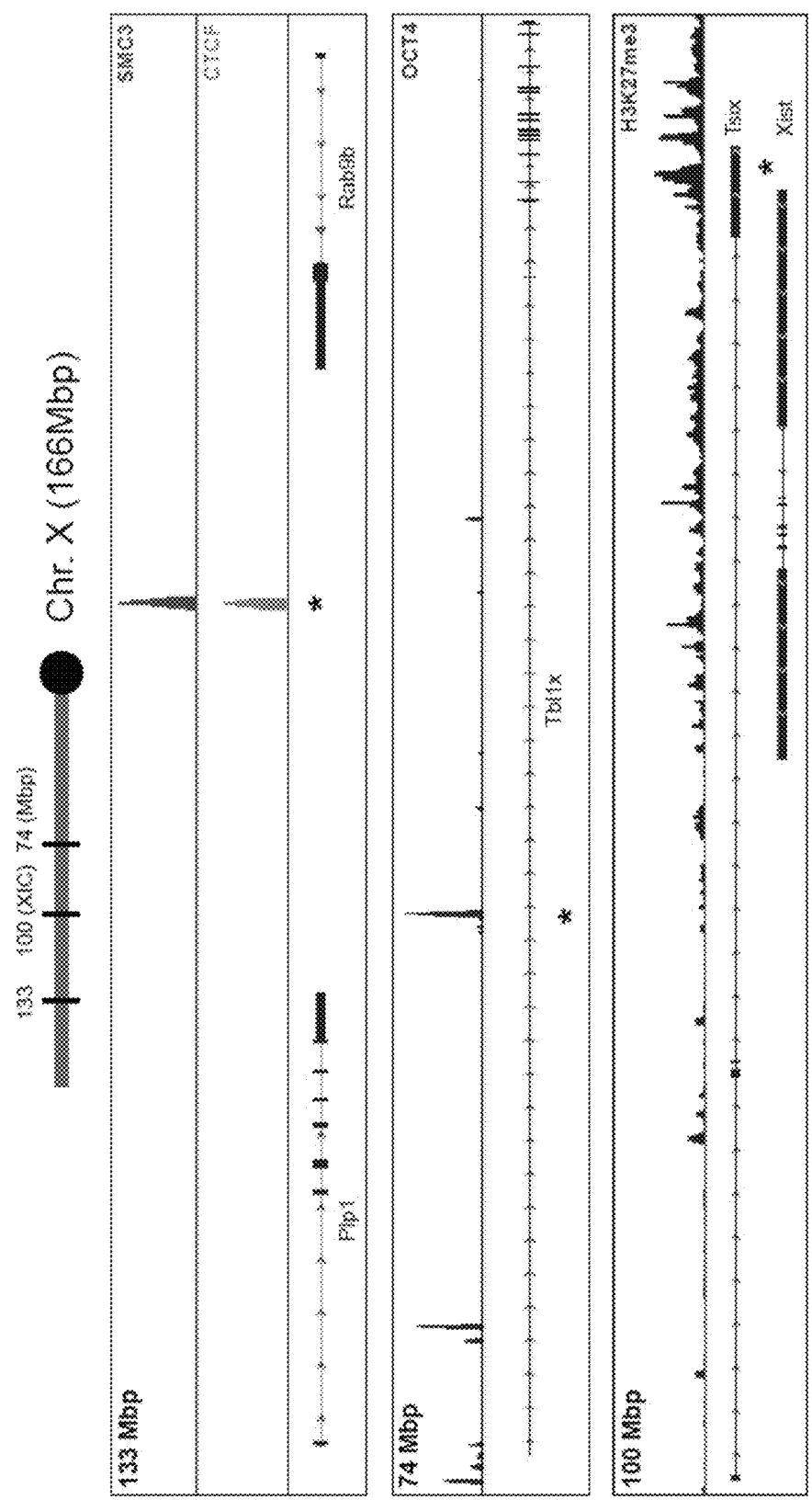
Figure 12B:
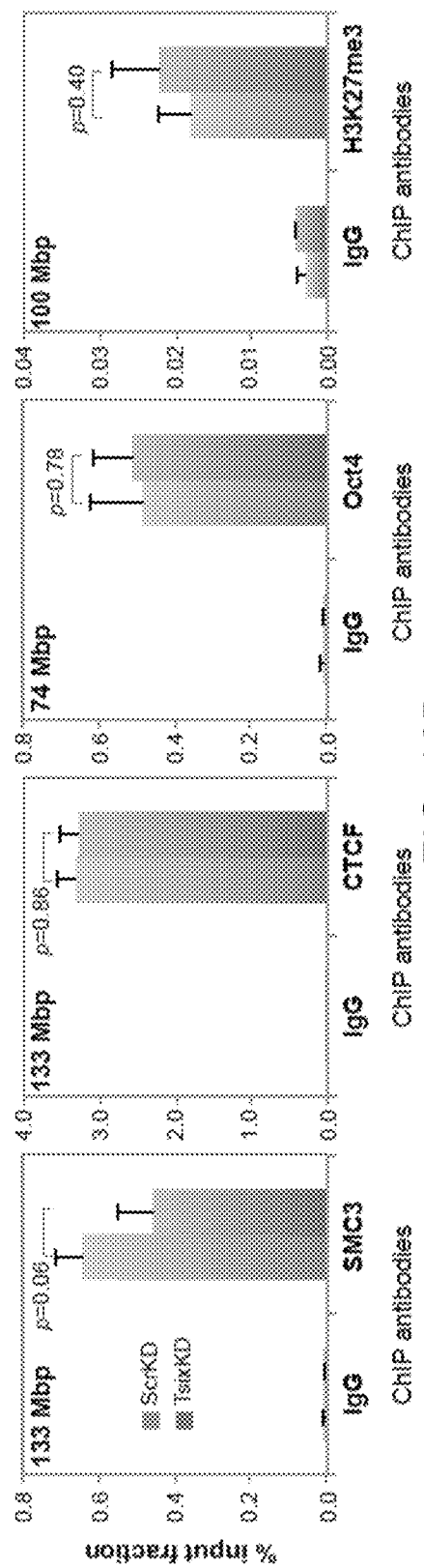

FIG. 12A-B. Occupancies of CTCF and OCT4 are not significantly affected in the regions outside of the pairing center (A) ChIP-seq analysis of SMC3, CTCF, OCT4, and H3K27me3 on X chromosome.

(B) ChIP-qPCR in shScr and shTsix at indicated sites of X chromosome. Means±1 S.D. shown. Three independent biological replicates shown.

Table 1. Human CTCF Binding Sites. Coordinates for the genomic equivalents of the sequences of the empirically determined human peaks plus 500 nucleotides of flanking sequence; the sequences coordinates are with reference to human genome build 19. Imp'd, imprinted; Onco, oncogene; T-supp., tumor suppressor.

Table 2. Human CTCF Binding Sites. Coordinates for the genomic equivalents of the sequences of the human Lift-Over peaks plus 500 nucleotides of flanking sequence; the sequences coordinates are with reference to human genome build 19. Imp'd, imprinted; Onco, oncogene; T-supp., tumor suppressor.

DETAILED DESCRIPTION

CTCF is a master regulator of the genome and a fastener that holds together higher-order genomic architecture. In light of recent advances that have uncovered roles for RNA in chromosome looping (Lai et al., 2013a; Li et al., 2013), it is tempting to speculate that RNA may play a general role in aiding CTCF weave genomic architecture. Thus, we speculated that CTCF might interact with RNA on a larger scale. Given that enhancer-directed chromosomal looping involves RNA-mediated interactions (Kung et al., 2013; Lai et al., 2013b), the present inventors set out to determine whether RNA may bind CTCF on a global scale and aid long-range chromatin interactions in some contexts. As described herein, CLIP-seq analysis was used to define an RNA interactome for CTCF in mESC and, in parallel, ChIP-seq was performed to investigate the epigenomic landscape relative to interacting transcripts. One novel function of CTCF-RNA interactions described herein is the in cis locus-specific targeting of CTCF to chromatin. Because Tsix remains tethered to the site of transcription, it serves as an allele-specific tether for CTCF and ensures locus-specific recruitment of an otherwise ubiquitous factor (FIG. 7F). By targeting CTCF to the pairing center, Tsix and Xite RNAs promote long-range chromosomal interaction. Because many imprinted noncoding RNAs such as H19, Nespas, and Gtl2 are cis-acting (Lee and Bartolomei, 2013) and interact directly with CTCF (FIG. 10A-D), CTCF may be recruited to nearby imprinting control regions via a similar RNA-mediated mechanism. CTCF-RNA interactions elsewhere may similarly mediate long-range interactions to form inter- and intra-chromosomal structures—structures that are now increasingly associated with CTCF binding activities (Handoko et al., 2011; Dixon et al., 2012; Sanyal et al., 2012; Shen et al., 2012; DeMare et al., 2013; Phillips-Cremins et al., 2013).

Using XCI as a model, the present analysis defines a large RNA interactome and chromosome-specific binding patterns, which together implicate RNAs in the recruitment of CTCF to the X-chromosome pairing center and in inter-chromosomal interactions. Relevant to this, the allele-specific binding patterns of CTCF to the Xi chromatin also merit future consideration (FIG. 4), as CTCF-RNA interactions near escapee genes (FIG. 4) may facilitate the genes' continued expression within facultative heterochromatin (Filippova et al., 2005; Li and Carrel, 2008; Calabrese et al., 2012; Mugford et al., 2014). As shown in the case of Kdm6a and Mid1 genes (FIG. 4C), there are Xi-specific CTCF peaks within/flanking theses escapees, which correlated CTCF-interacting transcripts. We suspect that these transcripts may recruit CTCF to the escapees to mediate escape from XCI.

In general, the CTCF-interacting RNAs may operate both in cis and in trans. For example, Tsix and Xite (FIG. 7) are cis-acting and are required to target CTCF to the pairing center of the X-inactivation center to enable long-range interactions between two X-chromosomes (inter-chromosomal pairing) and the initiation of Xist RNA expression from the future inactive X (FIGS. 6DE; 7AB). Other CTCF-associated RNAs such as Jpx (Sun et al., 2013) and SRA1 (Yao et al., 2010) are trans-acting. In the case of Jpx, interaction between the RNA and CTCF leads to eviction of CTCF from the promoter of Xist, which thereby induces expression of Xist RNA. CTCF may also function as either activator or repression of gene expression. As an example of CTCF-mediated repression, at the X-inactivation center, CTCF is recruited by Tsix and Xite RNA, and binding to Tsix/Xite operates as a transcriptional repressor of Xist (FIG. 6-7). At the H19-imprinted cluster, binding of CTCF to the imprinting control region (ICR) is also repressive for the linked Igf2 gene in cis (Wan and Bartolomei, 2008; Li et al., 2008; Ling et al., 2006; Lee and Bartolomei, 2013). Thus, selective activation such genes as Xist and Igf2 may be achieved by blocking CTCF recruitment to those location, potentially by interfering with the RNA-mediated recruitment of CTCF. As an example of an activator, in the same imprinted cluster H19-Igf2, CTCF binding to the ICR activates H19 in cis (while it represses the Igf2). Thus, CTCF's effect on gene expression is context-dependent and likely mediated by the intra- and inter-chromosomal loops generated by CTCF as its primary function. That is, CTCF is believed to be acting by forming functional chromosomal domains (e.g., intra-chromosomal loops to insulate one gene while repressing or activating a neighboring gene). Thus, this invention leverages the role of RNA in recruiting CTCF to modulate the expression of genes within such higher-order domains.

Provided herein are putative CTCF binding sites within an interacting transcript, against which antisense oligonucleotides could be designed to block CTCF-RNA interactions and thereby interfere with CTCF's chromatin binding and function in a locus-specific manner. A "binding site" is defined as a region on the interacting RNA that makes direct contact with CTCF protein. These binding sites were identified as statistically significant "peaks" in the CLIP-seq data. Listed in Tables 1-2 are the coordinates for the genomic equivalents of the sequences of the peaks of binding PLUS 500 nucleotides of flanking sequence; the sequences are provided in the sequence listing filed herewith. The additional 500 nucleotides are included because designing inhibitory nucleic acids against flanking sequences can be efficacious in targeting RNA-protein interactions (e.g., RepC RNA interaction with YY1—see Sarma et al., 2010; Jeon and Lee, 2011). Mouse-to-human LiftOver analysis and analysis in the UCSC genome browser of syntenic positions indicate the existence of similar transcripts in the human genome; the peaks are set out in Table 2. This process and LiftOver chains are generally described in Kent et al., *Proc. Nat'l Acad. Sci.*, 100(20) 11484-11489 (2003). Similar CTCF-interacting transcripts are believed to occur in the human system given the geographic and sequence similarities between the mouse and human transcripts. The data suggest that many if not all of the mouse CTCF-transcripts have direct counterparts in the human epigenome. Such direct counterparts in other species are termed "orthologous" herein. Empirically identified CTCF binding sites in the X Chromosome, are described herein (see Example 5 and Table 1). These CTCF binding sites may be functionally conserved without being highly conserved at the level of overall nucleotide identity. For example, mouse Xist shows only 76% overall nucleotide identity with human XIST using sliding 21-bp windows, or an overall sequence identity of only 60%. However, within specific functional domains, such as Repeat A of XIST, the degree of conservation can be >70% between different mammalian species. The crucial motif in Repeat A is the secondary structures formed by the repeat. A CTCF binding site interacting with CTCF may therefore be similarly low in overall conservation but still have conservation in secondary structure within specific domains of the RNA, and thereby demonstrate functional conservation with respect to recruitment of CTCF. Calculations of homology or sequence identity between sequences (the terms are used interchangeably herein) are performed as follows.

To determine the percent identity of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is at least 80% of the length of the reference sequence, and in some embodiments is at least 90% or 100%. The nucleotides at corresponding amino acid positions or nucleotide positions are then compared. When a position in the first sequence is occupied by the same nucleotide as the corresponding position in the second sequence, then the molecules are identical at that position (as used herein nucleic acid "identity" is equivalent to nucleic acid "homology"). The percent identity between the two sequences is a function of the number of identical positions shared by the sequences, taking into account the number of gaps, and the length of each gap, which need to be introduced for optimal alignment of the two sequences.

For purposes of the present invention, the comparison of sequences and determination of percent identity between two sequences can be accomplished using a Blossum 62 scoring matrix with a gap penalty of 12, a gap extend penalty of 4, and a frameshift gap penalty of 5.

There are several potential uses for the CTCF binding sites described herein in the expanded CTCF transcriptome: The CTCF binding sites themselves, or antagomirs and small molecules designed against them, can be utilized to modulate expression (either up or down) of CTCF target genes. In addition, the CTCF binding sites can be used to design and/or test inhibitory nucleic acids as described herein.

Methods of Treatment

The present disclosure provides therapeutics, useful in treating a number of conditions including but not limited to various autosomal imprinting disorders, cancer, and X-linked diseases, that are formulated by designing inhibitory nucleic acids, e.g., oligonucleotides, or TFOs that bind to the CTCF binding sites as described herein (e.g., in Tables 1-2). In some embodiments, the oligo is targeted to anywhere in the binding site sequence; in some embodiments, it is targeted to a sequence within a region that starts at nt+501 from the 5' end of a sequence in Tables 1-2, and ends at nt−501 from the 3' end. We envision that this approach could be used to (1) disrupt silencing of X-linked and autosomal genes controlled repressively by CTCF sites (e.g., all of the genes within a cluster), or to disrupt silencing of one specific gene; to (2) prevent the activation of X-linked and autosomal genes that are turned on by CTCF, as targeting the CTCF binding sites would enable repression of the disease gene of interest; and to (3) turn off escapee genes on the X-chromosome.

Treating X-Linked Disorders

This methodology is useful particularly in X-linked disorders, e.g., in heterozygous women who retain a wildtype copy of a gene on the Xi (See, e.g., Lyon, Acta Paediatr Suppl. 2002; 91(439):107-12; Carrell and Willard, Nature. 434(7031):400-4 (2005); den Vey ver, Semin Reprod Med. 19(2):183-91 (2001)). Again, without wishing to be bound by theory, administration of an inhibitory nucleic acid (e.g., oligonucleotide) targeting a strong or moderate binding site is expected to prevent CTCF recruitment to a specific X-linked gene cluster or to a specific gene on the inactive X, thereby reactivating the "good" or hypomorphic copy of the X-linked gene.

As a result of X-inactivation, heterozygous females are mosaic for X-linked gene expression; some cells express genes from the maternal X and other cells express genes from the paternal X. The relative ratio of these two cell populations in a given female is frequently referred to as the "X-inactivation pattern." One cell population may be at a selective growth disadvantage, resulting in clonal outgrowth of cells with one or the other parental X chromosome active; this can cause significant deviation or skewing from an expected mean X-inactivation pattern (i.e., 50:50). See, e.g., Plenge et al., Am. J. Hum. Genet. 71:168-173 (2002) and references cited therein.

In some embodiments, the present methods include targeting RNAs that recruit CTCF for either gene upregulation or downregulation. In this manner, specific genes of interest on the inactive X could be reactivated to treat X-linked diseases, when the inactivated X chromosome bears a functional or hypomorphic copy of the gene. In this manner, specific autosomal genes such as Igf2 could be reactivated. To downregulate genes, ASOs could be targeted to CTCF to silence H19, for example. The example of FIG. 6-7 shows that knocking down Tsix and Xite prevented CTCF recruitment, which in turn prevent inter-chromosomal pairing and the ability to induce Xist RNA. In another embodiment, targeting the CTCF binding sites could block the expression of disease genes that "escape" from XCI. Thus, the present methods can be used to treat disorders associated with X-inactivation, which includes those listed in Table A.

TABLE A

| Disorder | OMIM # | Locus | Gene |
| --- | --- | --- | --- |
| Dent's disease 1 | 300009 | Xp11.22 | CLCN5 |
| Testicular feminization syndrome | 300068 | Xq11-q12 | AR |
| Addison's disease with cerebral sclerosis | 300100 | Xq28 | ABCD1 |
| Adrenal hypoplasia | 300200 | XP21.3-p21.2 | DAX1 |
| siderius X-linked mental retardation syndrome | 300263 | Xp11.22 | PHF8 |
| Agammaglobulinaemia, Bruton type | 300300 | Xq21.3-q22 | BTK |
| Choroidoretinal degeneration | 300389 | Xp21.1 | RPGR |
| Choroidaemia | 300390 | Xq21.2 | CHM |
| Albinism, ocular | 300500 | Xp22.3 | OA1 |
| Dent's disease 2 | 300555 | Xq25-q26 | OCRL |
| fragile X syndrome | 300624 | Xq27.3 | FMR1 |
| Rett/Epileptic encephalopathy, early infantile, 2 | 300672 | Xp22.13 | CDKL5 |
| Albinism-deafness syndrome | 300700 | Xq26.3-q27.1 | ADFN |
| paroxysmal nocturnal hemoglobinuria | 300818 | Xp22.2 | PIGA |

TABLE A-continued

| Disorder | OMIM # | Locus | Gene |
| --- | --- | --- | --- |
| Aldrich syndrome | 301000 | Xp11.23-p11.22 | WAS |
| Alport syndrome | 301050 | Xq22.3 | COL4A5 |
| Anaemia, hereditary hypochromic | 301300 | Xp11.21 | ALAS2 |
| Anemia, sideroblastic, with ataxia | 301310 | Xq13.3 | ABCB7 |
| Fabry disease | 301500 | Xq22 | GLA |
| Spinal muscular atrophy 2 | 301830 | Xp11.23 | UBA1 |
| Cataract, congenital | 302200 | Xp | CCT |
| Charcot-Marie-Tooth, peroneal | 302800 | Xq13.1 | GJB1 |
| Spastic paraplegia | 303350 | Xq28 | L1CAM |
| Colour blindness | 303800 | Xq28 | OPN1MW |
| Diabetes insipidus, nephrogenic | 304800 | Xq28 | AVPR2 |
| Dyskeratosis congenita | 305000 | Xq28 | DKC1 |
| Ectodermal dysplasia, anhidrotic | 305100 | Xq12-q13.1 | ED1 |
| Faciogenital dysplasia (Aarskog syndrome) | 305400 | Xp11.21 | FGD1 |
| Glucose-6-phosphate dehydrogenase deficiency | 305900 | Xq28 | G6PD |
| Glycogen storage disease type VIII | 306000 | Xp22.2-p22.1 | PHKA2 |
| Gonadal dysgenesis (XY female type) | 306100 | Xp22.11-p21.2 | GDXY |
| Granulomatous disease (chronic) | 306400 | Xp21.1 | CYBB |
| Haemophilia A | 306700 | Xq28 | F8 |
| Haemophilia B | 306900 | Xq27.1-q27.2 | F9 |
| Hydrocephalus (aqueduct stenosis) | 307000 | Xq28 | L1CAM |
| Hypophosphataemic rickets | 307800 | Xp22.2-p22.1 | PHEX |
| Lesch-Nyhan syndrome (hypoxanthine-guanine-phospho-ribosyl transferase deficiency) | 308000 | Xq26-q27.2 | HPRT1 |
| Incontinentia pigmenti | 308300 | Xq28 | IKBKG |
| Kallmann syndrome | 308700 | Xp22.3 | KAL1 |
| Keratosis follicularis spinulosa | 308800 | Xp22.1 | SAT |
| Lowe (oculocerebrorenal) syndrome | 309000 | Xq26.1 | OCRL |
| Menkes syndrome | 309400 | Xq12-q13 | ATP7A |
| Renpenning Syndrome | 309500 | Xp11.23 | PQBP1 |
| Mental retardation, with or without fragile site (numerous specific types) | 309530 | Xp11.3-q21.1 | MRX1 |
| Coffin-Lowry syndrome | 309580 | Xq13 | ATRX |
| Microphthalmia with multiple anomalies (Lenz syndrome) | 309800 | Xq27-q28 | MAA |
| Muscular dystrophy (Becker, Duchenne and Emery-Dreifuss types) | 310300 | Xq28 | EMD |
| Myotubular myopathy | 310400 | Xq28 | MTM1 |
| Night blindness, congenital stationary | 310500 | Xp11.4 | CSNB1 |
| Norrie's disease (pseudoglioma) | 310600 | Xp11.4 | NDP |
| Nystagmus, oculomotor or 'jerky' | 310700 | Xq26-q27 | NYS1 |
| Orofaciodigital syndrome (type I) | 311200 | Xp22.3-p22.2 | OFD1 |
| Ornithine transcarbamylase deficiency (type I hyperammonaemia) | 311250 | Xp21.1 | OTC |
| Phosphoglycerate kinase deficiency | 311800 | Xq13 | PGK1 |
| Phosphoribosylpyrophosphate synthetase deficiency | 311850 | Xq22-q24 | PRPS1 |
| Retinitis pigmentosa | 312610 | Xp21.1 | RPGR |
| Retinoschisis | 312700 | Xp22.2-p22.1 | RS1 |
| Rett syndrome | 312750 | Xq28, Xp22 | MECP2 |
| Muscular atrophy/Dihydro-testosterone receptor deficiency | 313200 | Xq11-q12 | AR |
| Spinal muscular atrophy | 313200 | Xq11-q12 | AR |
| Spondyloepiphyseal dysplasia tarda | 313400 | Xp22.2-p22.1 | SEDL |
| Thrombocytopenia, hereditary | 313900 | Xp11.23-p11.22 | WAS |
| Thyroxine-binding globulin, absence | 314200 | Xq22.2 | TBG |
| McLeod syndrome | 314850 | Xp21.1 | XK |

Table A was adapted in part from Germain, "Chapter 7: General aspects of X-linked diseases" in Fabry Disease: Perspectives from 5 Years of FOS. Mehta A, Beck M, Sunder-Plassmann G, editors. (Oxford: Oxford PharmaGenesis; 2006).

Treating Cancer

The methods described herein can also be used to treat a cancer in a subject by administering to the subject a composition (e.g., as described herein) comprising an inhibitory nucleic acid or TFO that binds to a CTCF binding site associated with a tumor suppressor, or cancer-suppressing gene, or imprinted gene and/or other growth-suppressing genes in any of Tables 1-2. Examples of cellular proliferative and/or differentiative disorders include cancer, e.g., carcinoma, sarcoma, metastatic disorders or hematopoietic neoplastic disorders, e.g., leukemias. A metastatic tumor can arise from a multitude of primary tumor types, including but not limited to those of prostate, colon, lung, breast and liver origin.

As used herein, treating includes "prophylactic treatment" which means reducing the incidence of or preventing (or reducing risk of) a sign or symptom of a disease in a patient at risk for the disease, and "therapeutic treatment", which means reducing signs or symptoms of a disease, reducing progression of a disease, reducing severity of a disease, in a patient diagnosed with the disease. With respect to cancer, treating includes inhibiting tumor cell proliferation, increasing tumor cell death or killing, inhibiting rate of tumor cell growth or metastasis, reducing size of tumors, reducing number of tumors, reducing number of metastases, increasing 1-year or 5-year survival rate.

As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states may be categorized as pathologic, i.e., characterizing or constituting a disease state, or may be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. "Pathologic hyperproliferative" cells occur in disease states characterized by malignant tumor growth. Examples of non-pathologic hyperproliferative cells include proliferation of cells associated with wound repair.

The terms "cancer" or "neoplasms" include malignancies of the various organ systems, such as affecting lung (e.g., small cell, non-small cell, squamous, adenocarcinoma), breast, thyroid, lymphoid, gastrointestinal, genito-urinary tract, kidney, bladder, liver (e.g. hepatocellular cancer), pancreas, ovary, cervix, endometrium, uterine, prostate, brain, as well as adenocarcinomas which include malignancies such as most colon cancers, colorectal cancer, renal-cell carcinoma, prostate cancer and/or testicular tumors, non-small cell carcinoma of the lung, cancer of the small intestine and cancer of the esophagus. The term "carcinoma" is art recognized and refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. In some embodiments, the disease is renal carcinoma or melanoma. Exemplary carcinomas include those forming from tissue of the cervix, lung, prostate, breast, head and neck, colon and ovary. The term also includes carcinosarcomas, e.g., which include malignant tumors composed of carcinomatous and sarcomatous tissues. An "adenocarcinoma" refers to a carcinoma derived from glandular tissue or in which the tumor cells form recognizable glandular structures.

The term "sarcoma" is art recognized and refers to malignant tumors of mesenchymal derivation.

Additional examples of proliferative disorders include hematopoietic neoplastic disorders.

As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. Preferably, the diseases arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus, L. (1991) Crit Rev. in Oncol./Hemotol. 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

In some embodiments, specific cancers that can be treated using the methods described herein are listed in the categories herein, for example, and include, but are not limited to: breast, lung, prostate, CNS (e.g., glioma), salivary gland, prostate, ovarian, and leukemias (e.g., ALL, CML, or AML). Associations of these genes with a particular cancer are known in the art, e.g., as described in Futreal et al., Nat Rev Cancer. 2004; 4:177-83; and The COSMIC (Catalogue of Somatic Mutations in Cancer) database and website, Bamford et al., Br J Cancer. 2004; 91:355-8; see also Forbes et al., Curr Protoc Hum Genet. 2008; Chapter 10; Unit 10.11, and the COSMIC database, e.g., v. 50 (Nov. 30, 2010). It is understood that reference to any particular type of cancer herein means that patients with other types of cancer, i.e., cancer in general, may be treated.

In addition, the methods described herein can be used for modulating (e.g., enhancing or decreasing) pluripotency of a stem cell and to direct stem cells down specific differentiation pathways to make endoderm, mesoderm, ectoderm, and their developmental derivatives. To modulate, e.g., decrease, increase, maintain, or enhance pluripotency, the methods include introducing into the cell an inhibitory nucleic acid that specifically binds to, or is complementary to, a CTCF-binding RNA or RNA domain as set forth herein. Stem cells useful in the methods described herein include adult stem cells (e.g., adult stem cells obtained from the inner ear, bone marrow, mesenchyme, skin, fat, liver, muscle, or blood of a subject, e.g., the subject to be treated); embryonic stem cells, or stem cells obtained from a placenta or umbilical cord; progenitor cells (e.g., progenitor cells derived from the inner ear, bone marrow, mesenchyme, skin, fat, liver, muscle, or blood); and induced pluripotent stem cells (e.g., iPS cells).

Methods of Targeting Genes Modulated by CTCF

The methods described herein can be used to specifically re-activate or repress one or more genes suppressed by CTCF, by targeting CTCF binding sites (i.e., within 500 nts of a peak sequence) as described herein, to disrupt RNA-mediated silencing or enhancement in cis on the inactive X-chromosome. The CTCF-binding RNAs can be noncoding (long noncoding RNA, lncRNA) or occasionally part of a coding mRNA; for simplicity, we will refer to them together as CTCF-associated RNAs (caRNAs) henceforth.

In the present methods, inhibitory nucleic acids targeting the CTCF binding sites, or complementary or identical to a CTCF binding site in the genome, are used to modulate gene expression in a cell, e.g., a cancer cell, a stem cell, or other normal cell types for gene or epigenetic therapy. The nucleic acids used in the methods described herein are termed "inhibitory" because they inhibit the CTCF-mediated repression or enhancement of a specified gene, by binding to a CTCF-binding sequence on the caRNA itself (e.g., an antisense oligo that is complementary to the CTCF-binding region of the caRNA) or by binding to a CTCF binding site as described herein in the genome, and (without wishing to be bound by theory) preventing binding or recruitment of CTCF to the binding site and thus disrupting CTCF-mediated silencing or enhancement in the region of the binding site. The cells can be in vitro, including ex vivo, or in vivo (e.g., in a subject who has cancer, e.g., a tumor). In some embodiments, the methods include introducing into the cell an inhibitory nucleic acid that is modified in some way, e.g., that differs from the endogenous caRNA or CTCF binding site by including one or more modifications to the backbone or bases as described herein for inhibitory nucleic acids. Such modified oligos are also within the scope of the present invention.

In some embodiments, the methods include introducing into the cell an inhibitory nucleic acid that specifically binds, or is complementary, to a strong or moderate binding site or a long non-coding RNA described herein. A nucleic acid that binds "specifically" binds primarily to the target, i.e., to the CTCF binding site to inhibit regulatory function or binding of CTCF to the caRNA or DNA but not to other non-target RNAs. The specificity of the nucleic acid interaction thus refers to its function (e.g., inhibiting the CTCF-associated repression or enhancement of gene expression) rather than its hybridization capacity. Inhibitory nucleic acids may exhibit nonspecific binding to other sites in the genome or other mRNAs, without interfering with binding of other regulatory proteins and without causing degradation of the non-specifically-bound RNA. Thus this nonspecific binding does not significantly affect function of other non-target RNAs and results in no significant adverse effects. These methods can be used to treat a subject, e.g., a subject with an X-linked condition or cancer, by administering to the subject a composition (e.g., as described herein) comprising an inhibitory nucleic acid that binds to a long non-coding RNA (e.g., an inhibitory nucleic acid that binds to a CTCF binding site described herein, e.g., as described in Tables 1-2) that is associated with a disease gene. Examples of genes involved in X-linked diseases are shown in Table A.; examples of oncogenes, tumor suppressors, and imprinted genes are shown in Tables 1-2.

The methods described herein can be used for modulating expression of oncogenes and tumor suppressors in cells, e.g., cancer cells. For example, to decrease expression of an oncogene in a cell, the methods include introducing into the cell an inhibitory nucleic acid that binds to a CTCF-binding region of a CTCF associated RNA or DNA as described herein, that regulates the genes, e.g., the tumor suppressors, oncogenes, and/or other growth-promoting genes in Tables 1-2.

As another example, to increase expression of a tumor suppressor in a cell, the methods include introducing into the cell an inhibitory nucleic acid or small molecule that specifically binds, or is complementary, to a CTCF-associated RNA targeting a tumor suppressor as set forth in Tables 1-2, e.g., in subjects with cancer, e.g., lung adenocarcinoma patients. In some embodiments, the methods include introducing into the cell an inhibitory nucleic acid that specifically binds, or is complementary, to a CTCF-associated RNA targeting an imprinted gene as set forth in Tables 1-2, or an X-linked gene as listed in Table A. A nucleic acid that binds "specifically" binds primarily to the target lncRNA or related lncRNAs to inhibit regulatory function of the lncRNA but not of other non-target RNAs. The specificity of the nucleic acid interaction thus refers to its function (e.g. inhibiting the CTCF-associated repression of gene expression) rather than its hybridization capacity. Inhibitory nucleic acids may exhibit nonspecific binding to other sites in the genome or other mRNAs, without interfering with binding of other regulatory proteins and without causing degradation of the non-specifically-bound RNA. Thus this nonspecific binding does not significantly affect function of other non-target RNAs and results in no significant adverse effects.

As used herein, treating includes "prophylactic treatment" which means reducing the incidence of or preventing (or reducing risk of) a sign or symptom of a disease in a patient at risk for the disease, and "therapeutic treatment", which means reducing signs or symptoms of a disease, reducing progression of a disease, reducing severity of a disease, in a patient diagnosed with the disease.

In some embodiments, the methods described herein include administering a composition, e.g., a sterile composition, comprising an inhibitory nucleic acid that is complementary to a CTCF binding site described herein. Inhibitory nucleic acids for use in practicing the methods described herein can be an antisense or small interfering RNA, including but not limited to an shRNA or siRNA. In some embodiments, the inhibitory nucleic acid is a modified nucleic acid polymer (e.g., a locked nucleic acid (LNA) molecule).

Inhibitory nucleic acids have been employed as therapeutic moieties in the treatment of disease states in animals, including humans. Inhibitory nucleic acids can be useful therapeutic modalities that can be configured to be useful in treatment regimens for the treatment of cells, tissues and animals, especially humans.

For therapeutics, an animal, preferably a human, suspected of having cancer is treated by administering an inhibitory nucleic acid in accordance with this invention. For example, in one non-limiting embodiment, the methods comprise the step of administering to the animal in need of treatment, a therapeutically effective amount of an inhibitory nucleic acid as described herein.

Inhibitory Nucleic Acids

Inhibitory nucleic acids useful in the present methods and compositions include antisense oligonucleotides, ribozymes, external guide sequence (EGS) oligonucleotides, siRNA compounds, single- or double-stranded RNA interference (RNAi) compounds such as siRNA compounds, molecules comprising modified bases, locked nucleic acid molecules (LNA molecules), antagomirs, peptide nucleic acid molecules (PNA molecules), and other oligomeric compounds or oligonucleotide mimetics which hybridize to at least a portion of the target nucleic acid and modulate its function. In some embodiments, the inhibitory nucleic acids include antisense RNA, antisense DNA, chimeric antisense oligonucleotides, antisense oligonucleotides comprising modified linkages, interference RNA (RNAi), short interfering RNA (siRNA); a micro, interfering RNA (miRNA); a small, temporal RNA (stRNA); or a short, hairpin RNA (shRNA); small RNA-induced gene activation (RNAa);

small activating RNAs (saRNAs), or combinations thereof. See, e.g., WO 2010040112. However, in some embodiments the inhibitory nucleic acid is not an miRNA, an stRNA, an shRNA, an siRNA, an RNAi, or a dsRNA.

In some embodiments, the inhibitory nucleic acids are 10 to 50, 13 to 50, or 13 to 30 nucleotides in length. One having ordinary skill in the art will appreciate that this embodies oligonucleotides having antisense (complementary) portions of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length, or any range therewithin. It is understood that non-complementary bases may be included in such inhibitory nucleic acids; for example, an inhibitory nucleic acid 30 nucleotides in length may have a portion of 15 bases that is complementary to the targeted RNA. In some embodiments, the oligonucleotides are 15 nucleotides in length. In some embodiments, the antisense or oligonucleotide compounds of the invention are 12 or 13 to 30 nucleotides in length. One having ordinary skill in the art will appreciate that this embodies inhibitory nucleic acids having antisense (complementary) portions of 12, 13, 14, 15, 16, 17, 18, 19, 20, 21, 22, 23, 24, 25, 26, 27, 28, 29 or 30 nucleotides in length, or any range therewithin.

Preferably the inhibitory nucleic acid comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the inhibitory nucleic acids are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric inhibitory nucleic acids of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5, 220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the inhibitory nucleic acid comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than; 2'-deoxyoligonucleotides against a given target.

A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly $CH_2$—NH—O—$CH_2$, CH, ~N($CH_3$)~O~$CH_2$ (known as a methylene(methylimino) or MMI backbone], $CH_2$—O—N ($CH_3$)—$CH_2$, $CH_2$—N ($CH_3$)—N ($CH_3$)—$CH_2$ and O—N ($CH_3$)—$CH_2$—$CH_2$ backbones, wherein the native phosphodiester backbone is represented as O—P—O—CH,); amide backbones (see De Mesmaeker et al. Ace. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5, 177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties). Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues.

Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide. PCT Publication No. WO 99/67378 discloses arabinonucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-O,4'-C-ethylene-bridged nucleic acids.

Examples of LNAs are described in WO 2008/043753 and WO2007031091 and include compounds of the following formula.

Scheme 1

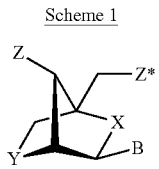

where X and Y are independently selected among the groups —O—, —S—, —N(H)—, N(R)—, —CH2- or —CH— (if part of a double bond), —CH$_2$—O—, —CH$_2$—S—, —CH$_2$—N(H)—, —CH$_2$—N(R)—, —CH$_2$—CH$_2$— or —CH$_2$—CH— (if part of a double bond), —CH=CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligomer of the invention comprises at least one LNA unit according any of the formulas Scheme 2

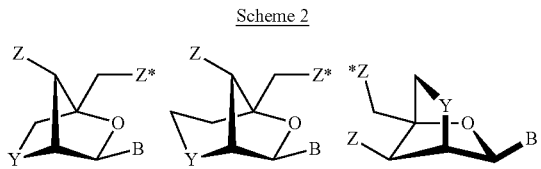

wherein Y is —O—, —S—, —NH—, or N(R$^H$); Z and Z* are independently selected among an internucleoside linkage, a terminal group or a protecting group; B constitutes a natural or non-natural nucleotide base moiety, and RH is selected from hydrogen and C$_{1-4}$-alkyl. Preferably, the Locked Nucleic Acid (LNA) used in an oligomeric compound, such as an antisense oligonucleotide, as described herein comprises at least one nucleotide comprises a Locked Nucleic Acid (LNA) unit according any of the formulas shown in Scheme 2 of PCT/DK2006/000512 (WO2007031091).

Preferably, the LNA used in the oligomer of the invention comprises internucleoside linkages selected from —O—P(O)$_2$—O—, —O—P(O,S)—O—, —O—P(S)$_2$—O—, —S—P(O)$_2$—O—, —S—P(O,X)—O—, —S—P(S)$_2$—O—, —O—P(O)$_2$—S—, —O—P(O,S)—S—, —S—P(O)$_2$—S—, —O—PO(R$^H$)—O—, O—PO(OCH$_3$)—O—, —O—PONR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—O—O—, where R$^H$ is selected from hydrogen and C$_{1-4}$-alkyl.

Specifically preferred LNA units are shown in scheme 3:

Scheme 3

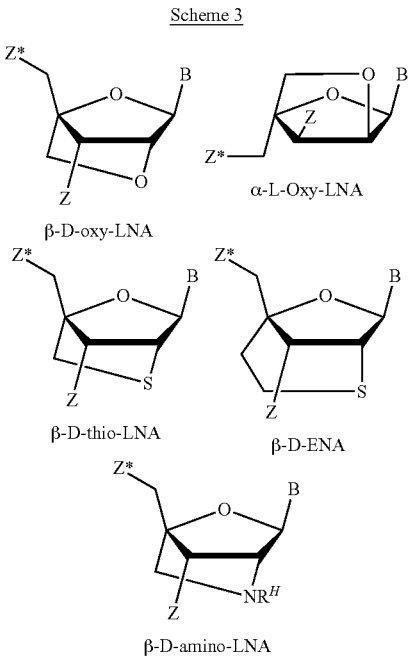

β-D-oxy-LNA

α-L-Oxy-LNA

β-D-thio-LNA

β-D-ENA

β-D-amino-LNA

The term "thio-LNA" comprises a locked nucleotide in which at least one of X or Y in the general formula above is selected from S or —CH2-S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH$_2$—N(R)— where R is selected from hydrogen and C$_{1-4}$-alkyl. Amino-LNA can be in both beta-D and alpha-L-configuration.

The term "oxy-LNA" comprises a locked nucleotide in which at least one of X or Y in the general formula above represents —O— or —CH$_2$—O—, Oxy-LNA can be in both beta-D and alpha-L-configuration.

The term "ena-LNA" comprises a locked nucleotide in which Y in the general formula above is —CH$_2$—O— (where the oxygen atom of —CH$_2$—O— is attached to the 2'-position relative to the base B).

LNAs are described in additional detail below. One or more substituted sugar moieties can also be included, e.g., one of the following at the 2' position: OH, SH, SCH$_3$, F, OCN, OCH$_3$OCH$_3$, OCH$_3$O(CH$_2$)n CH$_3$, O(CH$_2$)n NH$_2$ or O(CH$_2$)n CH$_3$ where n is from 1 to about 10; Ci to C10 lower alkyl, alkoxyalkoxy, substituted lower alkyl, alkaryl or aralkyl; Cl; Br; CN; CF3; OCF3; O—, S—, or N-alkyl; O—, S—, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A preferred modification includes 2'-methoxyethoxy [2'-O—CH$_2$Ch$_2$OCH$_3$, also known as 2'-O-(2-methoxyethyl)] (Martin et al, Helv. Chim. Acta, 1995, 78, 486). Other preferred modifications include 2'-methoxy (2'-O-CH$_3$), 2'-propoxy (2'-OCH$_2$CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Inhibitory nucleic acids can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalklyamino)adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-77; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2<0>C. (Sanghvi, in Crooke, and Lebleu, eds., Antisense Research and Applications, CRC Press, Boca Raton, 1993, pp. 276-278) and are presently preferred base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al, Science, 1991, 254, 1497-1500.

Inhibitory nucleic acids can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990; those disclosed by Englisch et al., Angewandle Chemie, International Edition, 1991, 30, page 613, and those disclosed by Sanghvi, Chapter 15, Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175, 273; 5, 367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the inhibitory nucleic acids are chemically linked to one or more moieties or conjugates that enhance the activity, cellular distribution, or cellular uptake of the oligonucleotide. For example, one or more inhibitory nucleic acids, of the same or different types, can be conjugated to each other; or inhibitory nucleic acids can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-t oxy-cholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552, 538; 5,578,717, 5,580,731; 5,580,731; 5,591,584; 5,109,124; 5,118,802; 5,138,045; 5,414,077; 5,486, 603; 5,512,439; 5,578,718; 5,608,046; 4,587,044; 4,605,735; 4,667,025; 4,762, 779; 4,789,737; 4,824,941; 4,835,263; 4,876,335; 4,904,582; 4,958,013; 5,082, 830; 5,112,963; 5,214,136; 5,082,830; 5,112,963; 5,214,136; 5, 245,022; 5,254,469; 5,258,506; 5,262,536; 5,272,250; 5,292,873; 5,317,098; 5,371,241, 5,391, 723; 5,416,203, 5,451,463; 5,510,475; 5,512,667; 5,514,785; 5, 565,552; 5,567,810; 5,574,142; 5,585,481; 5,587,371; 5,595,726; 5,597,696; 5,599,923; 5,599, 928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

The inhibitory nucleic acids useful in the present methods are sufficiently complementary to the target a CTCF binding site, e.g., hybridize sufficiently well and with sufficient biological functional specificity, to give the desired effect. "Complementary" refers to the capacity for pairing, through base stacking and specific hydrogen bonding, between two sequences comprising naturally or non-naturally occurring (e.g., modified as described above) bases (nucleosides) or analogs thereof. For example, if a base at one position of an inhibitory nucleic acid is capable of hydrogen bonding with a base at the corresponding position of a CTCF binding site, then the bases are considered to be complementary to each other at that position. 100% complementarity is not required. As noted above, inhibitory nucleic acids can comprise universal bases, or inert abasic spacers that provide no positive or negative contribution to hydrogen bonding. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as such as 3-nitropyrrole or 5-nitroindole can hybridize to and are considered complementary to any A, C, U, or T. Nichols et al., Nature, 1994; 369:492-493 and Loakes et al., Nucleic Acids Res., 1994; 22:4039-4043. Inosine (I) has also been considered in the art to be a universal base and is considered complementary to any A, C, U, or T. See Watkins and SantaLucia, Nucl. Acids Research, 2005; 33 (19): 6258-6267. In some embodiments, the location on a target CTCF binding site to which an inhibitory nucleic acid hybridizes is a region to which a protein binding partner binds. The identification of these binding sites is described in the Examples below. Routine methods can be used to design an inhibitory nucleic acid that binds to a selected strong or moderate binding site sequence with sufficient specificity. In some embodiments, the methods include using bioinformatics methods known in the art to identify regions of secondary structure, e.g., one, two, or more stem-loop structures, or pseudoknots, and selecting those regions to target with an inhibitory nucleic acid. For example, methods of designing oligonucleotides similar to the inhibitory nucleic acids described herein, and various options for modified chemistries or formats, are exemplified in Lennox and Behlke, Gene Therapy (2011) 18: 1111-1120, which is incorporated herein by reference in its entirety, with the understanding that the inhibitory oligonucleotides of the present disclosure do not target miRNA 'seed regions'.

While the specific sequences of certain exemplary target segments are set forth herein, one of skill in the art will recognize that these serve to illustrate and describe particular embodiments within the scope of the present invention. Additional target segments are readily identifiable by one having ordinary skill in the art in view of this disclosure. Target segments 5-500 nucleotides in length comprising a stretch of at least five (5) consecutive nucleotides within the protein binding region, or immediately adjacent thereto, are considered to be suitable for targeting as well. Target segments can include sequences that comprise at least the 5 consecutive nucleotides from the 5'-terminus of one of the protein binding regions (the remaining nucleotides being a consecutive stretch of the same RNA beginning immediately upstream of the 5'-terminus of the binding segment and continuing until the inhibitory nucleic acid contains about 5 to about 100 nucleotides). Similarly preferred target segments are represented by RNA sequences that comprise at least the 5 consecutive nucleotides from the 3'-terminus of one of the illustrative preferred target segments (the remaining nucleotides being a consecutive stretch of the same CTCF binding site beginning immediately downstream of the 3'-terminus of the target segment and continuing until the inhibitory nucleic acid contains about 5 to about 100 nucleotides). One having skill in the art armed with the sequences provided herein will be able, without undue experimentation, to identify further preferred protein binding regions to target with complementary inhibitory nucleic acids.

In the context of the present disclosure, hybridization means base stacking and hydrogen bonding, which may be Watson-Crick, Hoogsteen or reversed Hoogsteen hydrogen bonding, between complementary nucleoside or nucleotide bases. For example, adenine and thymine are complementary nucleobases which pair through the formation of hydrogen bonds. Complementary, as the term is used in the art, refers to the capacity for precise pairing between two nucleotides. For example, if a nucleotide at a certain position of an oligonucleotide is capable of hydrogen bonding with a nucleotide at the same position of a CTCF binding site molecule, then the inhibitory nucleic acid and the CTCF binding site are considered to be complementary to each other at that position. The inhibitory nucleic acids and the CTCF binding site are complementary to each other when a sufficient number of corresponding positions in each molecule are occupied by nucleotides that can hydrogen bond with each other through their bases. Thus, "specifically hybridizable" and "complementary" are terms which are used to indicate a sufficient degree of complementarity or precise pairing such that stable and specific binding occurs between the inhibitory nucleic acid and the CTCF binding site target. For example, if a base at one position of an inhibitory nucleic acid is capable of hydrogen bonding with a base at the corresponding position of a CTCF binding site, then the bases are considered to be complementary to each other at that position. 100% complementarity is not required. It is understood in the art that a complementary nucleic acid sequence need not be 100% complementary to that of its target nucleic acid to be specifically hybridizable. A complementary nucleic acid sequence for purposes of the present methods is specifically hybridizable when binding of the sequence to the target CTCF binding site molecule interferes with the normal function of the target CTCF binding site to cause a loss of activity (e.g., inhibiting CTCF-associated repression with consequent up-regulation of gene expression) and there is a sufficient degree of complementarity to avoid non-specific binding of the sequence to non-target CTCF binding site sequences under conditions in which avoidance of the non-specific binding is desired, e.g., under physiological conditions in the case of in vivo assays or therapeutic treatment, and in the case of in vitro assays, under conditions in which the assays are performed under suitable conditions of stringency.

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 µg/ml denatured salmon sperm DNA (ssDNA). In a most preferred embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42° C. in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS.

Additional variations on these conditions will be readily apparent to those skilled in the art. Hybridization techniques are well known to those skilled in the art and are described, for example, in Benton and Davis (Science 196:180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, N.Y.

In general, the inhibitory nucleic acids useful in the methods described herein have at least 80% sequence complementarity to a target region within the target nucleic acid, e.g., 90%, 95%, or 100% sequence complementarity to the target region within a CTCF binding site.

For example, an antisense compound in which 18 of 20 nucleobases of the antisense oligonucleotide are complementary, and would therefore specifically hybridize, to a target region would represent 90 percent complementarity. Percent complementarity of an inhibitory nucleic acid with a region of a target nucleic acid can be determined routinely using basic local alignment search tools (BLAST programs) (Altschul et al., J. Mol. Biol., 1990, 215, 403-410; Zhang and Madden, Genome Res., 1997, 7, 649-656). Antisense and other compounds of the invention that hybridize to a CTCF binding site are identified through routine experimentation. In general the inhibitory nucleic acids must retain specificity for their target, i.e., either do not directly bind to, or do not directly significantly affect expression levels of, transcripts other than the intended target.

Target-specific effects, with corresponding target-specific functional biological effects, are possible even when the inhibitory nucleic acid exhibits non-specific binding to a large number of non-target RNAs. For example, short 8 base long inhibitory nucleic acids that are fully complementary to a CTCF binding site may have multiple 100% matches to hundreds of sequences in the genome, yet may produce target-specific effects, e.g. upregulation of a specific target gene through inhibition of CTCF activity. 8-base inhibitory nucleic acids have been reported to prevent exon skipping with with a high degree of specificity and reduced off-target effect. See Singh et al., RNA Biol., 2009; 6(3): 341-350. 8-base inhibitory nucleic acids have been reported to interfere with miRNA activity without significant off-target effects. See Obad et al., Nature Genetics, 2011; 43: 371-378. For further disclosure regarding inhibitory nucleic acids, please see US2010/0317718 (antisense oligos); US2010/0249052 (double-stranded ribonucleic acid (dsRNA)); US2009/0181914 and US2010/0234451 (LNA molecules); US2007/0191294 (siRNA analogues); US2008/0249039 (modified siRNA); and WO2010/129746 and WO2010/040112 (inhibitory nucleic acids).

Antisense

In some embodiments, the inhibitory nucleic acids are antisense oligonucleotides.

Antisense oligonucleotides are typically designed to block expression of a DNA or RNA target by binding to the target and halting expression at the level of transcription, translation, or splicing. Antisense oligonucleotides of the present invention are complementary nucleic acid sequences designed to hybridize under stringent conditions to a CTCF binding site in vitro, and are expected to inhibit the activity of CTCF in vivo. Thus, oligonucleotides are chosen that are sufficiently complementary to the target, i.e., that hybridize sufficiently well and with sufficient biological functional specificity, to give the desired effect.

Modified Bases, Including Locked Nucleic Acids (LNAs)

In some embodiments, the inhibitory nucleic acids used in the methods described herein comprise one or more modified bonds or bases. Modified bases include phosphorothioate, methylphosphonate, peptide nucleic acids, or locked nucleic acids (LNAs). Preferably, the modified nucleotides are part of locked nucleic acid molecules, including [alpha]-L-LNAs. LNAs include ribonucleic acid analogues wherein the ribose ring is "locked" by a methylene bridge between the 2'-oxygen and the 4'-carbon—i.e., oligonucleotides containing at least one LNA monomer, that is, one 2'-O,4'-C-methylene-β-D-ribofuranosyl nucleotide. LNA bases form standard Watson-Crick base pairs but the locked configuration increases the rate and stability of the basepairing reaction (Jepsen et al., Oligonucleotides, 14, 130-146 (2004)). LNAs also have increased affinity to base pair with RNA as compared to DNA. These properties render LNAs especially useful as probes for fluorescence in situ hybridization (FISH) and comparative genomic hybridization, as knockdown tools for miRNAs, and as antisense oligonucleotides to target mRNAs or other RNAs, e.g., CTCF binding sites as described herien.

The modified base/LNA molecules can include molecules comprising, e.g., 10-30, e.g., 12-24, e.g., 12, 13, 14, 15, 16, 17, 18, 19, 20, 21, 22, 23, 24, 25, 26, 27, 28, 29, or 30 nucleotides in each strand, wherein one of the strands is substantially identical, e.g., at least 80% (or more, e.g., 85%, 90%, 95%, or 100%) identical, e.g., having 3, 2, 1, or 0 mismatched nucleotide(s), to a target region in the CTCF binding site. The modified base/LNA molecules can be chemically synthesized using methods known in the art.

The modified base/LNA molecules can be designed using any method known in the art; a number of algorithms are known, and are commercially available (e.g., on the internet, for example at exiqon.com). See, e.g., You et al., Nuc. Acids. Res. 34:e60 (2006); McTigue et al., Biochemistry 43:5388-405 (2004); and Levin et al., Nuc. Acids. Res. 34:e142 (2006).

For example, "gene walk" methods, similar to those used to design antisense oligos, can be used to optimize the inhibitory activity of a modified base/LNA molecule; for example, a series of oligonucleotides of 10-30 nucleotides spanning the length of a target CTCF binding site can be prepared, followed by testing for activity. Optionally, gaps, e.g., of 5-10 nucleotides or more, can be left between the LNAs to reduce the number of oligonucleotides synthesized and tested. GC content is preferably between about 30-60%. General guidelines for designing modified base/LNA molecules are known in the art; for example, LNA sequences will bind very tightly to other LNA sequences, so it is preferable to avoid significant complementarity within an LNA molecule. Contiguous runs of three or more Gs or Cs, or more than four LNA residues, should be avoided where possible (for example, it may not be possible with very short (e.g., about 9-10 nt) oligonucleotides). In some embodiments, the LNAs are xylo-LNAs.

In some embodiments, the modified base/LNA molecules can be designed to target a specific region of the CTCF binding site. For example, a specific functional region can be targeted, e.g., a region comprising a known RNA localization motif (i.e., a region complementary to the target nucleic acid on which the CTCF binding site acts), or a region comprising a known protein binding region, e.g., a CTCF binding region. Sarma et al., "Locked nucleic acids (LNAs) reveal sequence requirements and kinetics of Xist RNA localization to the X chromosome." PNAS published ahead of print Dec. 6, 2010, doi:10.1073/pnas.1009785107. Alternatively or in addition, highly conserved regions can be targeted, e.g., regions identified by aligning sequences from disparate species such as primate (e.g., human) and rodent (e.g., mouse) and looking for regions with high degrees of identity. Percent identity can be determined routinely using basic local alignment search tools (BLAST programs) (Altschul et al., J. Mol. Biol., 1990, 215, 403-410; Zhang and Madden, Genome Res., 1997, 7, 649-656), e.g., using the default parameters.

For additional information regarding LNA molecules see U.S. Pat. Nos. 6,268,490; 6,734,291; 6,770,748; 6,794,499; 7,034,133; 7,053,207; 7,060,809; 7,084,125; and 7,572,582; and U.S. Pre-Grant Pub. Nos. 20100267018; 20100261175;

and 20100035968; Koshkin et al. Tetrahedron 54, 3607-3630 (1998); Obika et al. Tetrahedron Lett. 39, 5401-5404 (1998); Jepsen et al., Oligonucleotides 14:130-146 (2004); Kauppinen et al., Drug Disc. Today 2(3):287-290 (2005); and Ponting et al., Cell 136(4):629-641 (2009), and references cited therein.

As demonstrated herein, LNA molecules can be used as a valuable tool to manipulate and aid analysis of long nuclear ncRNAs. Advantages offered by an LNA molecule-based system are the relatively low costs, easy delivery, and rapid action. While other inhibitory nucleic acids may exhibit effects after longer periods of time, LNA molecules exhibit effects that are more rapid, e.g., a comparatively early onset of activity, are fully reversible after a recovery period following the synthesis of new CTCF binding site, and occur without causing substantial or substantially complete RNA cleavage or degradation. One or more of these design properties may be desired properties of the inhibitory nucleic acids of the invention. Additionally, LNA molecules make possible the systematic targeting of domains within much longer nuclear transcripts. Although a PNA-based system has been described earlier, the effects on Xi were apparent only after 24 hours (Beletskii et al., Proc Natl Acad Sci USA 98:9215-9220 (2001)). The LNA technology enables high-throughput screens for functional analysis of long non-coding RNAs and also provides a novel tool to manipulate chromatin states in vivo for therapeutic applications.

In various related aspects, the methods described herein include using LNA molecules to target CTCF binding sites for a number of uses, including as a research tool to probe the function of a specific CTCF binding site, e.g., in vitro or in vivo. The methods include selecting one or more desired CTCF binding sites, designing one or more LNA molecules that target the CTCF binding site, providing the designed LNA molecule, and administering the LNA molecule to a cell or animal. The methods can optionally include selecting a region of the CTCF binding site and designing one or more LNA molecules that target that region of the CTCF binding site.

Aberrant imprinted gene expression is implicated in several diseases including Long QT syndrome, Beckwith-Wiedemann, Prader-Willi, and Angelman syndromes, as well as behavioral disorders and carcinogenesis (see, e.g., Falls et al., Am. J. Pathol. 154:635-647 (1999); Lalonde, Annu Rev Genet 30:173-195 (1996); Hall Annu Rev Med. 48:35-44 (1997)). LNA molecules can be created to treat such imprinted diseases. As one example, the long QT Syndrome can be caused by a K+ gated Calcium-channel encoded by Kcnql. This gene is regulated by its antisense counterpart, the long noncoding RNA, Kcnqlotl (Pandey et al., Mol Cell. 2008 Oct. 24; 32(2):232-46). Disease arises when Kcnqlotl is aberrantly expressed. LNA molecules can be created to downregulate Kcnqlotl, thereby restoring expression of Kcnql. As another example, LNA molecules could inhibit caRNA binding to CTCF to reverse the imprinted defect.

From a commercial and clinical perspective, the timepoints between about 1 to 24 hours potentially define a window for epigenetic reprogramming. The advantage of the LNA system is that it works quickly, with a defined half-life, and is therefore reversible upon degradation of LNAs, at the same time that it provides a discrete timeframe during which epigenetic manipulations can be made. By targeting nuclear long ncRNAs, LNA molecules or similar polymers, e.g., xylo-LNAs, might be utilized to manipulate the chromatin state of cells in culture or in vivo, by transiently eliminating the regulatory RNA and associated proteins long enough to alter the underlying locus for therapeutic purposes. In particular, LNA molecules or similar polymers that specifically bind to, or are complementary to, CTCF binding sites can prevent recruitment of CTCF to a specific chromosomal locus, in a gene-specific fashion.

LNA molecules might also be administered in vivo to treat other human diseases, such as but not limited to cancer, neurological disorders, infections, inflammation, and myotonic dystrophy. For example, LNA molecules might be delivered to tumor cells to downregulate the biologic activity of a growth-promoting or oncogenic long nuclear ncRNA (e.g., Gt12 or MALAT1 (Luo et al., Hepatology. 44(4):1012-24 (2006)), a lncRNA associated with metastasis and is frequently unregulated in cancers). Repressive caRNAs downregulating tumor suppressors can also be targeted by LNA molecules to promote reexpression. For example, expression of the INK4b/ARF/INK4a tumor suppressor locus is controlled by Polycomb group proteins including PRC1 and PRC2 and repressed by the antisense noncoding RNA ANRIL (Yap et al., Mol Cell. 2010 Jun. 11; 38(5): 662-74). ANRIL can be targeted by LNA molecules to promote reexpression of the INK4b/ARF/INK4a tumor suppressor. Some CTCF binding sites may be associated with caRNAs that are positive regulators of oncogenes. Such "activating caRNAs" have been described recently (e.g., Jpx (Tian et al., Cell. 143(3):390-403 (2010) and others (Orom et al., Cell. 143(1):46-58 (2010)). Therefore, LNA molecules could be directed at these activating CTCF binding sites to downregulate oncogenes. LNA molecules could also be delivered to inflammatory cells to downregulate regulatory caRNA that modulate the inflammatory or immune response. (e.g., LincRNA-Cox2, see Guttman et al., Nature. 458(7235):223-7. Epub 2009 Feb. 1 (2009)).

In still other related aspects, the LNA molecules targeting CTCF binding sites described herein can be used to create animal or cell models of conditions associated with altered gene expression (e.g., as a result of altered epigenetics).

For example, it was first noticed about half a century ago that X chromosome changes are often seen in female reproductive cancers. Some 70% of breast carcinomas lack a 'Barr body', the cytologic hallmark of the inactive X chromosome (Xi), and instead harbor two or more active Xs (Xa). Additional X's are also a risk factor for men, as XXY men (Klinefelter Syndrome) have a 20- to 50-fold increased risk of breast cancer in a BRCA1 background.

The X is also known to harbor a number of oncogenes. Supernumerary Xa's correlate with a poor prognosis and stand as one of the most common cytogenetic abnormalities not only in reproductive cancers but also in leukemias, lymphomas, and germ cell tumors of both sexes. See, e.g., Liao et al., Cancer Invest 21, 641-58 (2003); Spatz et al., Nat Rev Cancer 4, 617-29 (2004); Barr et al., Proc Can Cancer Conf 2, 3-16 (1957); Borah et al., J Surg Oncol 13, 1-7 (1980); Camargo and Wang, Hum Genet 55, 81-5 (1980); Dutrillaux et al., Int J Cancer 38, 475-9 (1986); Ghosh and Shah, Cancer Genet Cytogenet 4, 269-74 (1981); Ghosh and Shah, Med Hypotheses 7, 1099-104 (1981); Ghosh et al., Acta Cytol 27, 202-3 (1983); Huang et al., Mol Cancer Ther 1, 769-76 (2002); Kawakami et al., Lancet 363, 40-2 (2004); Kawakami et al., J Urol 169, 1546-52 (2003); Kawakami et al., Oncogene 23, 6163-9 (2004); Moore and Barr, Br J Cancer 9, 246-52 (1955); Moore and Barr, Br J Cancer 11, 384-90 (1957); Moore et al., J Exp Zool 135, 101-25 (1957); Rosen et al., Ann Clin Lab Sci 7, 491-9 (1977); Sirchia et al., Cancer Res 65, 2139-46 (2005); Tavares, Lancet 268, 948-9 (1955); Tavares, Medico (Porto) 12, 97-100 (1961); Tavares, Acta Cytol 6, 90-4 (1962); Wang et al., Cancer Genet Cytogenet 46, 271-80 (1990); and Ganesan et al., Cold Spring Harb Symp Quant Biol 70, 93-7 (2005).

See also PCT/US11/60493, which is incorporated by reference herein in its entirety.

Antagomirs

In some embodiments, the inhibitory nucleic acid is an antagomir. Antagomirs are chemically modified antisense oligonucleotides that can target a CTCF binding site. For example, an antagomir for use in the methods described herein can include a nucleotide sequence sufficiently complementary to hybridize to a CTCF binding site target sequence of about 12 to 25 nucleotides, preferably about 15 to 23 nucleotides.

In some embodiments, antagomirs include a cholesterol moiety, e.g., at the 3'-end. In some embodiments, antagomirs have various modifications for RNase protection and pharmacologic properties such as enhanced tissue and cellular uptake. For example, in addition to the modifications discussed above for antisense oligos, an antagomir can have one or more of complete or partial 2'-O-methylation of sugar and/or a phosphorothioate backbone. Phosphorothioate modifications provide protection against RNase or other nuclease activity and their lipophilicity contributes to enhanced tissue uptake. In some embodiments, the antagomir cam include six phosphorothioate backbone modifications; two phosphorothioates are located at the 5'-end and four at the 3'-end, but other patterns of phosphorothioate modification are also commonly employed and effective. See, e.g., Krutzfeldt et al., Nature 438, 685-689 (2005); Czech, N Engl J Med 2006; 354:1194-1195 (2006); Robertson et al., Silence. 1:10 (2010); Marquez and McCaffrey, Hum Gene Ther. 19(1):27-38 (2008); van Rooij et al., Circ Res. 103(9):919-928 (2008); and Liu et al., Int. J. Mol. Sci. 9:978-999 (2008). Krutzfeld et al. (2005) describe chemically engineered oligonucleotides, termed 'antagomirs', that are reported to be efficient and specific silencers of endogenous miRNAs in mice.

In general, the design of an antagomir avoids target RNA degradation due to the modified sugars present in the molecule. The presence of an unbroken string of unmodified sugars supports RNAseH recruitment and enzymatic activity. Thus, typically the design of an antagomir will include bases that contain modified sugar (e.g., LNA), at the ends or interspersed with natural ribose or deoxyribose nucleobases.

Antagomirs useful in the present methods can also be modified with respect to their length or otherwise the number of nucleotides making up the antagomir. In some embodiments, the antagomirs must retain specificity for their target, i.e., must not directly bind to, or directly significantly affect expression levels of, transcripts other than the intended target.

In some embodiments, antagomirs may exhibit nonspecific binding that does not produce significant undesired biologic effect, e.g., the antagomirs do not affect expression levels of non-target transcripts or their association with regulatory proteins or regulatory RNAs.

Interfering RNA, Including siRNA/shRNA

In some embodiments, the inhibitory nucleic acid sequence that is complementary to a CTCF binding site can be an interfering RNA, including but not limited to a small interfering RNA ("siRNA") or a small hairpin RNA ("shRNA"). Methods for constructing interfering RNAs are well known in the art. For example, the interfering RNA can be assembled from two separate oligonucleotides, where one strand is the sense strand and the other is the antisense strand, wherein the antisense and sense strands are self-complementary (i.e., each strand comprises nucleotide sequence that is complementary to nucleotide sequence in the other strand; such as where the antisense strand and sense strand form a duplex or double stranded structure); the antisense strand comprises nucleotide sequence that is complementary to a nucleotide sequence in a target nucleic acid molecule or a portion thereof (i.e., an undesired gene) and the sense strand comprises nucleotide sequence corresponding to the target nucleic acid sequence or a portion thereof.

Alternatively, interfering RNA is assembled from a single oligonucleotide, where the self-complementary sense and antisense regions are linked by means of nucleic acid based or non-nucleic acid-based linker(s). The interfering RNA can be a polynucleotide with a duplex, asymmetric duplex, hairpin or asymmetric hairpin secondary structure, having self-complementary sense and antisense regions, wherein the antisense region comprises a nucleotide sequence that is complementary to nucleotide sequence in a separate target nucleic acid molecule or a portion thereof and the sense region having nucleotide sequence corresponding to the target nucleic acid sequence or a portion thereof. The interfering can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNA interference.

In some embodiments, the interfering RNA coding region encodes a self-complementary RNA molecule having a sense region, an antisense region and a loop region. Such an RNA molecule when expressed desirably forms a "hairpin" structure, and is referred to herein as an "shRNA." The loop region is generally between about 2 and about 10 nucleotides in length. In some embodiments, the loop region is from about 6 to about 9 nucleotides in length. In some embodiments, the sense region and the antisense region are between about 15 and about 20 nucleotides in length. Following post-transcriptional processing, the small hairpin RNA is converted into a siRNA by a cleavage event mediated by the enzyme Dicer, which is a member of the RNase III family. The siRNA is then capable of inhibiting the expression of a gene with which it shares homology. For details, see Brummelkamp et al., Science 296:550-553, (2002); Lee et al, Nature Biotechnol., 20, 500-505, (2002); Miyagishi and Taira, Nature Biotechnol 20:497-500, (2002); Paddison et al. Genes & Dev. 16:948-958, (2002); Paul, Nature Biotechnol, 20, 505-508, (2002); Sui, Proc. Natl. Acad. Sd. USA, 99(6), 5515-5520, (2002); Yu et al. Proc NatlAcadSci USA 99:6047-6052, (2002).

The target RNA cleavage reaction guided by siRNAs is highly sequence specific. In general, siRNA containing a nucleotide sequences identical to a portion of the target nucleic acid are preferred for inhibition. However, 100% sequence identity between the siRNA and the target gene is not required to practice the present invention. Thus the invention has the advantage of being able to tolerate sequence variations that might be expected due to genetic mutation, strain polymorphism, or evolutionary divergence. For example, siRNA sequences with insertions, deletions, and single point mutations relative to the target sequence have also been found to be effective for inhibition. Alternatively, siRNA sequences with nucleotide analog substitutions or insertions can be effective for inhibition.

In general the siRNAs must retain specificity for their target, i.e., must not directly bind to, or directly significantly affect expression levels of, transcripts other than the intended target.

Ribozymes

In some embodiments, the inhibitory nucleic acids are ribozymes. Trans-cleaving enzymatic nucleic acid molecules can also be used; they have shown promise as therapeutic agents for human disease (Usman & McSwiggen, 1995 Ann. Rep. Med. Chem. 30, 285-294; Christoffersen and Marr, 1995 J. Med. Chem. 38, 2023-2037). Enzymatic nucleic acid molecules can be designed to cleave specific caRNA targets within the background of cellular RNA. Such a cleavage event renders the caRNA non-functional.

In general, enzymatic nucleic acids with RNA cleaving activity act by first binding to a target RNA. Such binding occurs through the target binding portion of an enzymatic nucleic acid which is held in close proximity to an enzymatic portion of the molecule that acts to cleave the target RNA. Thus, the enzymatic nucleic acid first recognizes and then binds a target RNA through complementary base pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

Several approaches such as in vitro selection (evolution) strategies (Orgel, 1979, Proc. R. Soc. London, B 205, 435) have been used to evolve new nucleic acid catalysts capable of catalyzing a variety of reactions, such as cleavage and ligation of phosphodiester linkages and amide linkages, (Joyce, 1989, Gene, 82, 83-87; Beaudry et al., 1992, Science 257, 635-641; Joyce, 1992, Scientific American 267, 90-97; Breaker et al, 1994, TIBTECH 12, 268; Bartel et al, 1993, Science 261:1411-1418; Szostak, 1993, TIBS 17, 89-93; Kumar et al, 1995, FASEB J., 9, 1183; Breaker, 1996, Curr. Op. Biotech., 1, 442). The development of ribozymes that are optimal for catalytic activity would contribute significantly to any strategy that employs RNA-cleaving ribozymes for the purpose of regulating gene expression. The hammerhead ribozyme, for example, functions with a catalytic rate (kcat) of about 1 min$^{-1}$ in the presence of saturating (10 MM) concentrations of Mg$^{2+}$ cofactor. An artificial "RNA ligase" ribozyme has been shown to catalyze the corresponding self-modification reaction with a rate of about 100 min$^{-1}$. In addition, it is known that certain modified hammerhead ribozymes that have substrate binding arms made of DNA catalyze RNA cleavage with multiple turn-over rates that approach 100 min$^{-1}$.

Making and Using Inhibitory Nucleic Acids

The nucleic acid sequences used to practice the methods described herein, whether RNA, cDNA, genomic DNA, vectors, viruses or hybrids thereof, can be isolated from a variety of sources, genetically engineered, amplified, and/or expressed/generated recombinantly. If desired, nucleic acid sequences of the invention can be inserted into delivery vectors and expressed from transcription units within the vectors. The recombinant vectors can be DNA plasmids or viral vectors. Generation of the vector construct can be accomplished using any suitable genetic engineering techniques well known in the art, including, without limitation, the standard techniques of PCR, oligonucleotide synthesis, restriction endonuclease digestion, ligation, transformation, plasmid purification, and DNA sequencing, for example as described in Sambrook et al. Molecular Cloning: A Laboratory Manual. (1989)), Coffin et al. (Retroviruses. (1997)) and "RNA Viruses: A Practical Approach" (Alan J. Cann, Ed., Oxford University Press, (2000)).

Preferably, inhibitory nucleic acids of the invention are synthesized chemically. Nucleic acid sequences used to practice this invention can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066; WO/2008/043753 and WO/2008/049085, and the refences cited therein.

Nucleic acid sequences of the invention can be stabilized against nucleolytic degradation such as by the incorporation of a modification, e.g., a nucleotide modification. For example, nucleic acid sequences of the invention includes a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O-N-methylacetamido (2'-O-NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom (see, e.g., Kaupinnen et al., Drug Disc. Today 2(3):287-290 (2005); Koshkin et al., J. Am. Chem. Soc., 120(50):13252-13253 (1998)). For additional modifications see US 20100004320, US 20090298916, and US 20090143326.

It is understood that any of the modified chemistries or formats of inhibitory nucleic acids described herein can be combined with each other, and that one, two, three, four, five, or more different types of modifications can be included within the same molecule.

Techniques for the manipulation of nucleic acids used to practice this invention, such as, e.g., subcloning, labeling probes (e.g., random-primer labeling using Klenow polymerase, nick translation, amplification), sequencing, hybridization and the like are well described in the scientific and patent literature, see, e.g., Sambrook et al., Molecular Cloning; A Laboratory Manual 3d ed. (2001); Current Protocols in Molecular Biology, Ausubel et al., eds. (John Wiley & Sons, Inc., New York 2010); Kriegler, Gene Transfer and Expression: A Laboratory Manual (1990); Laboratory Techniques In Biochemistry And Molecular Biology: Hybridization With Nucleic Acid Probes, Part I. Theory and Nucleic Acid Preparation, Tijssen, ed. Elsevier, N.Y. (1993).

Modification Patterns

In some embodiments, the inhibitory oligonucleotide comprises locked nucleic acids (LNA), ENA modified nucleotides, 2'-O-methyl nucleotides, or 2'-fluoro-deoxyribonucleotides. In some embodiments, the inhibitory oligonucleotide comprises alternating deoxyribonucleotides and 2'-fluoro-deoxyribonucleotides. In some embodiments, the inhibitory oligonucleotide comprises alternating deoxyribonucleotides and 2'-O-methyl nucleotides. In some embodiments, the inhibitory oligonucleotide comprises alternating deoxyribonucleotides and ENA modified nucleotides. In some embodiments, the inhibitory oligonucleotide comprises alternating deoxyribonucleotides and locked nucleic acid nucleotides. In some embodiments, the inhibitory oligonucleotide comprises alternating locked nucleic acid nucleotides and 2'-O-methyl nucleotides.

The oligonucleotide may comprise deoxyribonucleotides flanked by at least one bridged nucleotide (e.g., a LNA nucleotide, cEt nucleotide, ENA nucleotide) on each of the 5' and 3' ends of the deoxyribonucleotides. The oligonucleotide may comprise deoxyribonucleotides flanked by 1, 2, 3, 4, 5, 6, 7, 8 or more bridged nucleotides (e.g., LNA nucleotides, cEt nucleotides, ENA nucleotides) on each of the 5' and 3' ends of the deoxyribonucleotides. In some embodiments, the 5' nucleotide of the oligonucleotide is a deoxyribonucleotide. In some embodiments, the 5' nucleotide of the oligonucleotide is a locked nucleic acid nucleotide. In some embodiments, the nucleotides of the oligonucleotide comprise deoxyribonucleotides flanked by at least one locked nucleic acid nucleotide on each of the 5' and 3' ends of the deoxyribonucleotides. In some embodiments, the nucleotide at the 3' position of the oligonucleotide has a 3' hydroxyl group or a 3' thiophosphate.

In some embodiments, the inhibitory oligonucleotide comprises phosphorothioate internucleotide linkages. In some embodiments, the single stranded oligonucleotide comprises phosphorothioate internucleotide linkages between at least two nucleotides. In some embodiments, the single stranded oligonucleotide comprises phosphorothioate internucleotide linkages between all nucleotides.

It should be appreciated that the oligonucleotide can have any combination of modifications as described herein.

As an example, the oligonucleotide may comprise a nucleotide sequence having one or more of the following modification patterns.

(a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxXXxx, (X)XxxXXx, (X)XxxxXX, (X)XxxxXX, (X)xXxXXx, (X)xXxxXX, (X)xxXxXX, (X)xXxXxX and (X)XxXxXx, (d) (X)xxXXXX, (X)xXxXXX, (X)xXXxXX, (X)xXXXxX, (X)xXXXXx, (X)XxxXXX, (X)XxXxXX, (X)XxXXxX, (X)XxXXx, (X)XXxxXX, (X)XXxXxX, (X)XXXxxX, (X)XXxXXx, (X)XXXxXx, (X)XXXXxx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, in which "X" denotes a nucleotide analogue, (X) denotes an optional nucleotide analogue, and "x" denotes a DNA or RNA nucleotide unit. Each of the above listed patterns may appear one or more times within an oligonucleotide, alone or in combination with any of the other disclosed modification patterns.

In some embodiments, the oligonucleotide is a gapmer (contain a central stretch (gap) of DNA monomers sufficiently long to induce RNase H cleavage, flanked by blocks of LNA modified nucleotides; see, e.g., Stanton et al., Nucleic Acid Ther. 2012. 22: 344-359; Nowotny et al., Cell, 121:1005-1016, 2005; Kurreck, European Journal of Biochemistry 270: 1628-1644, 2003; FLuiter et al., Mol Biosyst. 5(8):838-43, 2009). In some embodiments, the oligonucleotide is a mixmer (includes alternating short stretches of LNA and DNA; Naguibneva et al., Biomed Pharmacother. 2006 November; 60(9):633-8; from et al., Gene. 2006 May 10; 3720:137-41).

Additional Sequence Structural Information

The inhibitory oligonucleotides described herein may have a sequence that does not contain guanosine nucleotide stretches (e.g., 3 or more, 4 or more, 5 or more, 6 or more consecutive guanosine nucleotides). In some embodiments, oligonucleotides having guanosine nucleotide stretches have increased non-specific binding and/or off-target effects, compared with oligonucleotides that do not have guanosine nucleotide stretches.

The inhibitory oligonucleotides have a sequence that has less than a threshold level of sequence identity with every sequence of nucleotides, of equivalent length, that map to a genomic position encompassing or in proximity to an off-target gene. For example, an oligonucleotide may be designed to ensure that it does not have a sequence that maps to genomic positions encompassing or in proximity with all known genes (e.g., all known protein coding genes) other than the gene of interest. The oligonucleotide is expected to have a reduced likelihood of having off-target effects. The threshold level of sequence identity may be 50%, 60%, 70%, 80%, 85%, 90%, 95%, 99% or 100% sequence identity.

The inhibitory oligonucleotides may have a sequence that is complementary to a region that encodes an RNA that forms a secondary structure comprising at least two single stranded loops. In some embodiments, oligonucleotides that are complementary to a region that encodes an RNA that forms a secondary structure comprising one or more single stranded loops (e.g., at least two single stranded loops) have a greater likelihood of being active (e.g., of being capable of activating or enhancing expression of a target gene) than a randomly selected oligonucleotide. In some cases, the secondary structure may comprise a double stranded stem between the at least two single stranded loops. Accordingly, the area of complementarity between the oligonucleotide and the nucleic acid region may be at a location of the PRC2 associated region that encodes at least a portion of at least one of the loops. In some embodiments, the predicted secondary structure RNA (e.g., of the CTCF binding site) containing the nucleic acid region is determined using RNA secondary structure prediction algorithms, e.g., RNAfold, mfold. In some embodiments, oligonucleotides are designed to target a region of the RNA that forms a secondary structure comprising one or more single stranded loop (e.g., at least two single stranded loops) structures which may comprise a double stranded stem between the at least two single stranded loops.

The inhibitory oligonucleotide may have a sequence that is has greater than 30% G-C content, greater than 40% G-C content, greater than 50% G-C content, greater than 60% G-C content, greater than 70% G-C content, or greater than 80% G-C content. The inhibitory oligonucleotide may have a sequence that has up to 100% G-C content, up to 95% G-C content, up to 90% G-C content, or up to 80% G-C content.

The inhibitory oligonucleotide may be complementary to a chromosome of a different species (e.g., a mouse, rat, rabbit, goat, monkey, etc.) at a position that encompasses or that is in proximity to that species' homolog of the gene of interest. The inhibitory oligonucleotide may be complementary to a human genomic region encompassing or in proximity to the target gene and also be complementary to a mouse genomic region encompassing or in proximity to the mouse homolog of the target gene. Oligonucleotides having these characteristics may be tested in vivo or in vitro for efficacy in multiple species (e.g., human and mouse). This approach also facilitates development of clinical candidates for treating human disease by selecting a species in which an appropriate animal exists for the disease.

In some embodiments, the region of complementarity of the inhibitory oligonucleotide is complementary with at least 8 to 15, 8 to 30, 8 to 40, or 10 to 50, or 5 to 50, or 5 to 40 bases, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of a CTCF binding site disclosed in the tables provided herein. In some embodiments, the region of complementarity is complementary with at least 8, 10, 12, 14, 16, 18, or 20 consecutive nucleotides of a CTCF binding site disclosed in the tables provided herein.

Modulating CTCF Binding to Genomic DNA

As described herein, CTCF localizes/binds to genomic DNA in a sequence-specific manner; the present methods can include inhibiting this localization, in addition to or as an alternative to administering an inhibitory nucleic acid as described herein that binds a CTCF-binding RNA. To inhibit this localization, and thus disrupt CTCF-dependent repression and increase expression of nearby genes, oligonucleotides are used that bind to genomic DNA at or near (e.g., within 100, 50, or 25) nucleotides of a CTCF localization site identified in Tables 1 and 2. Table 1 lists genes corresponding to the CTCF CLIP-seq peaks from human embryonic kidney cells, and Table 2 provides the Human genomic regions determined by LiftOver analysis to correspond to the CTCF CLIP-seq peaks from Mus musculus mouse embryonic fibroblasts. Each table provides the SEQ ID NO: of the peak(s) (i.e., the CTCF localization site(s)) that correspond to each of the listed genes.

In some embodiments, the oligonucleotides are triplex-forming oligonucleotides (TFOs). TFOs are defined as triplex-forming oligonucleotides which bind as third strands to duplex DNA in a sequence specific manner. Triplex-forming oligonucleotides may be comprised of any possible combination of nucleotides and modified nucleotides. Modified nucleotides may contain chemical modifications of the heterocyclic base, sugar moiety or phosphate moiety. TFOs, and methods of making them, are known in the art; see, e.g., Frank-Kamenetskii and Mirkin, Annual Review of Biochemistry, 64:65-95 (1995); Vasquez and Glazer, Quarterly Reviews of Biophysics, 35(01):89-107 (2002); US PGPub Nos. 20070219122; US20110130557; and US20090216003.

In general, the TFO is a single-stranded nucleic acid molecule between 5 and 100 nucleotides in length, preferably between 7 and 40 nucleotides in length, e.g., 10 to 20 or 20 to 30 nucleotides in length. In some embodiments, the base composition is homopurine or homopyrimidine, polypurine or polypyrimidine. The oligonucleotides can be generated using known DNA synthesis procedures.

The nucleotide sequence of the oligonucleotides is selected based on a target sequence of a CTCF localization sequence as provided herein; in addition, the sequence can be determined based on physical constraints imposed by the need to achieve binding of the oligonucleotide within the major groove of the target region, and preferably have a low dissociation constant (Kd) for the oligonucleotide/target sequence. The oligonucleotides should have a base composition that is conducive to triple-helix formation and can be generated based on known structural motifs for third strand binding. The most stable complexes are formed on polypurine:polypyrimidine elements, which are relatively abundant in mammalian genomes. Triplex formation by TFOs can occur with the third strand oriented either parallel or anti-parallel to the purine strand of the duplex. In the anti-parallel, purine motif, the triplets are G.G:C and A.A:T, whereas in the parallel pyrimidine motif, the canonical triplets are $C^+$.G:C and T.A:T. The triplex structures are stabilized by two Hoogsteen hydrogen bonds between the bases in the TFO strand and the purine strand in the duplex. See U.S. Pat. No. 5,422,251 for additional information on base compositions for third strand binding oligonucleotides.

The TFOs can include one or more modifications, e.g., backbone modifications such as incorporation of the flexible basestacking monomers (Bulge insertions of (R)-1-O-[4-(1-pyrenylethynyl)phenylmethyl]glycerol into the middle of homopyrimidine oligodeoxynucleotides (twisted intercalating nucleic acids, TINA)) as described in US PGPub No 20090216003; intercalating nucleic acid monomers as described in WO2006125447A2; intercalator (R)-1-O-[4-(1-pyrenylethynyl)benzyl]-glycerol (see, e.g., Filichev et al., J. Am. Chem. Soc. 127:14849 (2005); Filichev et al., Eur. J. Org. Chem. 17:3960-3968 (2006); Globisch et al., Hely. Chim. Acta, 91:805 (2008)); 2-phenyl or 2-naphth-1-yl-phenanthroimidazole intercalators as described in US20110130557.

In addition or in alternative, modifications can be made to the nucleobases (see, e.g., Roig and Asseline, J. Am. Chem. Soc. 2003, 125, 4416; Hildbrand et al., J. Am. Chem. Soc. 1997, 119, 5499; and Xodo et al., Nucleic Acids Res. 1991, 19, 5625); to the sugar (sugar moiety modifications include, but are not limited to, 2'-O-aminoetoxy, 2'-O-amonioethyl (2'-OAE), 2'-O-methoxy, 2'-O-methyl, 2-guanidoethyl (2'-OGE), 2'-O,4'-C-methylene (LNA), 2'-O-(methoxyethyl) (2'-OME) and 2'-O-(N-(methyl)acetamido) (2'-OMA). 2'-O-aminoethyl sugar moiety substitutions are especially preferred; see, e.g., Carlomagno et al., J. Am. Chem. Soc. 2001, 123, 7364; Cuenoud et al., Angew. Chem. Int. Ed. 1998, 37, 1288; Wengel, Acc. Chem. Res. 1999, 32, 301; Obika et al., Tetrahedron Let. 2000, 41, 8923; Sun et al., Biochemistry, 2004, 43, 4160; Basye et al., Nucleic Acids Res. 2001, 29, 4873); and/or to the phosphate backbone (see, e.g., Michel, et al., Chem Bio Chem. 2005, 6, 1254; Ehrenmann et al., Nucl. Nucl. Nucleic Acids. 2001, 20, 797; Michel et al., J. Biomol. Struct. Dyn. 2003, 21, 435; Tereshko et al., J. Am. Chem. Soc. 1998, 120, 269; Escude et al., Proc. Natl. Acad. Sci. U.S.A. 1996, 93, 4365; Gryaznov et al., Proc. Natl. Acad. Sci. U.S.A. 1995, 92, 5798; Gryaznov and Chen, J. Am. Chem. Soc. 1994, 116, 3143; and Chur et al., Nucleic Acids Res. 1993, 21, 5179). Chemical modifications of heterocyclic bases or heterocyclic base analogs can be used to increase the binding affinity of a nucleotide or its stability in a triplex. Chemically-modified heterocyclic bases include, but are not limited to, inosine, 5-(1-propynyl) uracil (pU), 5-(1-propynyl) cytosine (pC), 5-methylcytosine, 8-oxo-adenine, pseudocytosine, pseudoisocytosine, 5 and 2-amino-5-(2'-deoxy-beta-D-ribofuranosyl)pyridine (2-aminopyridine), and various pyrrolo- and pyrazolopyrimidine derivatives. Substitution of 5-methylcytosine or pseudoisocytosine for cytosine in triplex-forming molecules such as TFOs and PNAs helps to stabilize triplex formation at neutral and/or physiological pH, especially in triplex-forming molecules with isolated cytosines. See, e.g., US20110268810.

For example, each nucleotide monomer can be selected from the group consisting of DNA, RNA, HNA, MNA, ANA, LNA, CAN, INA, CeNA, TNA, (2'-NH)-TNA, (3'-

NH)-TNA, alpha-L-Ribo-LNA, alpha-L-Xylo-LNA, beta-D-Ribo-LNA, beta-D-Xylo-LNA, [3.2.1]-LNA, Bicyclo-DNA, 6-Amino-Bicyclo-DNA, 5-epi-Bicyclo-DNA, alpha-Bicyclo-DNA, Tricyclo-DNA, Bicyclo[4.3.0]-DNA, Bicyclo[3.2.1]-DNA, Bicyclo[4.3.0]amide-DNA, beta-D-Ribopyranosyl-NA, alpha-L-Lyxopyranosyl-NA, 2'-R-RNA, 2'-OR-RNA, 2'-AE-RNA, alpha-L-RNA, and beta-D-RNA, and combinations and modifications thereof; in some embodiments, some or all of the TFO is a peptide nucleic acid (PNA), in which the phosphate backbone of oligonucleotides is replaced in part or in its entirety by repeating N-(2-aminoethyl)-glycine units, and the phosphodiester bonds are replaced by peptide bonds. In addition, the TFO can include one or more of the modifications described in WO2012/065143.

In some embodiments, the TFO includes a "tail" or "tail clamp" added to the Watson-Crick binding portion that binds to target strand outside the triple helix and reduces the requirement for a polypurine:polypyrimidine stretch, increasing the number of potential target sites. Tail clamps added to PNAs (referred to as tcPNAs) have been described by Kaihatsu, et al., Biochemistry, 42(47):13996-4003 (2003); Bentin, et al., Biochemistry, 42(47):13987-95 (2003) Rogers, et al., Proc. Natl. Acad. Sci. USA., 99(26): 16695-700 (2002)), and are known to bind to DNA more efficiently due to low dissociation constants.

The addition of the tail also increases binding specificity and binding stringency of the triplex-forming molecules to the target duplex.

In some embodiments, the TFOs are modified with, or administered with, amidoanthraquinones as described in Fox et al., Proc. Natl. Acad. Sci. USA 92:7887-7891 (1995).

Methods of Treatment Using TFOs

TFOs that target CTCF binding sites associated with disease-related genes can also be used to treat subjects. For example, the DMD gene is a causal factor in Duchenne muscular dystrophy; administration of a TFO that targets a CTCF localization site associated with the XIST gene can be used to treat subjects who have Rett Syndrome. One of skill in the art would be able to identify other disease-related genes from among those listed in Tables 1 and 2. In particular, a TFO that targets a CTCF localization site associated with a human disease-related gene as set forth in Tables 1 or 2 (and/or Table A) can be used to treat a human having the disease to which the gene is related; in some embodiments, the TFOs are used to reactivate a normal gene in a heterozygous individual, i.e., an individual with one normal copy and one affected copy of the gene. The TFO can be administered in a pharmaceutical composition or formulation as known in the art, e.g., as described herein. Subjects having a genetic disease, e.g., a disease related to a gene listed in Table 1 or 2, can be identified using methods known in the art.

Pharmaceutical Compositions

The methods described herein can include the administration of pharmaceutical compositions and formulations comprising inhibitory nucleic acid sequences designed to target a CTCF binding site.

In some embodiments, the compositions are formulated with a pharmaceutically acceptable carrier. The pharmaceutical compositions and formulations can be administered parenterally, topically, orally or by local administration, such as by aerosol or transdermally. The pharmaceutical compositions can be formulated in any way and can be administered in a variety of unit dosage forms depending upon the condition or disease and the degree of illness, the general medical condition of each patient, the resulting preferred method of administration and the like. Details on techniques for formulation and administration of pharmaceuticals are well described in the scientific and patent literature, see, e.g., Remington: The Science and Practice of Pharmacy, 21st ed., 2005. The inhibitory nucleic acids can be administered alone or as a component of a pharmaceutical formulation (composition). The compounds may be formulated for administration, in any convenient way for use in human or veterinary medicine. Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Formulations of the compositions of the invention include those suitable for intradermal, inhalation, oral/nasal, topical, parenteral, rectal, and/or intravaginal administration. The formulations may conveniently be presented in unit dosage form and may be prepared by any methods well known in the art of pharmacy. The amount of active ingredient (e.g., nucleic acid sequences of this invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g., an antigen specific T cell or humoral response.

Pharmaceutical formulations of this invention can be prepared according to any method known to the art for the manufacture of pharmaceuticals. Such drugs can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

Pharmaceutical formulations for oral administration can be formulated using pharmaceutically acceptable carriers well known in the art in appropriate and suitable dosages. Such carriers enable the pharmaceuticals to be formulated in unit dosage forms as tablets, pills, powder, dragees, capsules, liquids, lozenges, gels, syrups, slurries, suspensions, etc., suitable for ingestion by the patient. Pharmaceutical preparations for oral use can be formulated as a solid excipient, optionally grinding a resulting mixture, and processing the mixture of granules, after adding suitable additional compounds, if desired, to obtain tablets or dragee cores. Suitable solid excipients are carbohydrate or protein fillers include, e.g., sugars, including lactose, sucrose, mannitol, or sorbitol; starch from corn, wheat, rice, potato, or other plants; cellulose such as methyl cellulose, hydroxypropylmethyl-cellulose, or sodium carboxy-methylcellulose; and gums including arabic and tragacanth; and proteins, e.g., gelatin and collagen. Disintegrating or solubilizing agents may be added, such as the cross-linked polyvinyl pyrrolidone, agar, alginic acid, or a salt thereof, such as sodium alginate. Push-fit capsules can contain active agents mixed with a filler or binders such as lactose or starches, lubricants such as talc or magnesium stearate, and, optionally, stabilizers. In soft capsules, the active agents can be dissolved or suspended in suitable liquids, such as fatty oils, liquid paraffin, or liquid polyethylene glycol with or without stabilizers.

Aqueous suspensions can contain an active agent (e.g., nucleic acid sequences of the invention) in admixture with excipients suitable for the manufacture of aqueous suspensions, e.g., for aqueous intradermal injections. Such excipients include a suspending agent, such as sodium carboxymethylcellulose, methylcellulose, hydroxypropylmethylcellulose, sodium alginate, polyvinylpyrrolidone, gum tragacanth and gum acacia, and dispersing or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethylene oxycetanol), a condensation product of ethylene oxide with a partial ester derived from a fatty acid and a hexitol (e.g., polyoxyethylene sorbitol mono-oleate), or a condensation product of ethylene oxide with a partial ester derived from fatty acid and a hexitol anhydride (e.g., polyoxyethylene sorbitan mono-oleate). The aqueous suspension can also contain one or more preservatives such as ethyl or n-propyl p-hydroxybenzoate, one or more coloring agents, one or more flavoring agents and one or more sweetening agents, such as sucrose, aspartame or saccharin. Formulations can be adjusted for osmolarity.

In some embodiments, oil-based pharmaceuticals are used for administration of nucleic acid sequences of the invention. Oil-based suspensions can be formulated by suspending an active agent in a vegetable oil, such as arachis oil, olive oil, sesame oil or coconut oil, or in a mineral oil such as liquid paraffin; or a mixture of these. See e.g., U.S. Pat. No. 5,716,928 describing using essential oils or essential oil components for increasing bioavailability and reducing inter- and intra-individual variability of orally administered hydrophobic pharmaceutical compounds (see also U.S. Pat. No. 5,858,401). The oil suspensions can contain a thickening agent, such as beeswax, hard paraffin or cetyl alcohol. Sweetening agents can be added to provide a palatable oral preparation, such as glycerol, sorbitol or sucrose. These formulations can be preserved by the addition of an antioxidant such as ascorbic acid. As an example of an injectable oil vehicle, see Minto (1997) J. Pharmacol. Exp. Ther. 281:93-102.

Pharmaceutical formulations can also be in the form of oil-in-water emulsions. The oily phase can be a vegetable oil or a mineral oil, described above, or a mixture of these. Suitable emulsifying agents include naturally-occurring gums, such as gum acacia and gum tragacanth, naturally occurring phosphatides, such as soybean lecithin, esters or partial esters derived from fatty acids and hexitol anhydrides, such as sorbitan mono-oleate, and condensation products of these partial esters with ethylene oxide, such as polyoxyethylene sorbitan mono-oleate. The emulsion can also contain sweetening agents and flavoring agents, as in the formulation of syrups and elixirs. Such formulations can also contain a demulcent, a preservative, or a coloring agent. In alternative embodiments, these injectable oil-in-water emulsions of the invention comprise a paraffin oil, a sorbitan monooleate, an ethoxylated sorbitan monooleate and/or an ethoxylated sorbitan trioleate.

The pharmaceutical compounds can also be administered by in intranasal, intraocular and intravaginal routes including suppositories, insufflation, powders and aerosol formulations (for examples of steroid inhalants, see e.g., Rohatagi (1995) J. Clin. Pharmacol. 35:1187-1193; Tjwa (1995) Ann. Allergy Asthma Immunol. 75:107-111). Suppositories formulations can be prepared by mixing the drug with a suitable non-irritating excipient which is solid at ordinary temperatures but liquid at body temperatures and will therefore melt in the body to release the drug. Such materials are cocoa butter and polyethylene glycols.

In some embodiments, the pharmaceutical compounds can be delivered transdermally, by a topical route, formulated as applicator sticks, solutions, suspensions, emulsions, gels, creams, ointments, pastes, jellies, paints, powders, and aerosols.

In some embodiments, the pharmaceutical compounds can also be delivered as microspheres for slow release in the body. For example, microspheres can be administered via intradermal injection of drug which slowly release subcutaneously; see Rao (1995) J. Biomater Sci. Polym. Ed. 7:623-645; as biodegradable and injectable gel formulations, see, e.g., Gao (1995) Pharm. Res. 12:857-863 (1995); or, as microspheres for oral administration, see, e.g., Eyles (1997) J. Pharm. Pharmacol. 49:669-674.

In some embodiments, the pharmaceutical compounds can be parenterally administered, such as by intravenous (IV) administration or administration into a body cavity or lumen of an organ. These formulations can comprise a solution of active agent dissolved in a pharmaceutically acceptable carrier. Acceptable vehicles and solvents that can be employed are water and Ringer's solution, an isotonic sodium chloride. In addition, sterile fixed oils can be employed as a solvent or suspending medium. For this purpose any bland fixed oil can be employed including synthetic mono- or diglycerides. In addition, fatty acids such as oleic acid can likewise be used in the preparation of injectables. These solutions are sterile and generally free of undesirable matter. These formulations may be sterilized by conventional, well known sterilization techniques. The formulations may contain pharmaceutically acceptable auxiliary substances as required to approximate physiological conditions such as pH adjusting and buffering agents, toxicity adjusting agents, e.g., sodium acetate, sodium chloride, potassium chloride, calcium chloride, sodium lactate and the like. The concentration of active agent in these formulations can vary widely, and will be selected primarily based on fluid volumes, viscosities, body weight, and the like, in accordance with the particular mode of administration selected and the patient's needs. For IV administration, the formulation can be a sterile injectable preparation, such as a sterile injectable aqueous or oleaginous suspension. This suspension can be formulated using those suitable dispersing or wetting agents and suspending agents. The sterile injectable preparation can also be a suspension in a nontoxic parenterally-acceptable diluent or solvent, such as a solution of 1,3-butanediol. The administration can be by bolus or continuous infusion (e.g., substantially uninterrupted introduction into a blood vessel for a specified period of time).

In some embodiments, the pharmaceutical compounds and formulations can be lyophilized. Stable lyophilized formulations comprising an inhibitory nucleic acid can be made by lyophilizing a solution comprising a pharmaceutical of the invention and a bulking agent, e.g., mannitol, trehalose, raffinose, and sucrose or mixtures thereof. A process for preparing a stable lyophilized formulation can include lyophilizing a solution about 2.5 mg/mL protein, about 15 mg/mL sucrose, about 19 mg/mL NaCl, and a sodium citrate buffer having a pH greater than 5.5 but less than 6.5. See, e.g., U.S. 20040028670.

The compositions and formulations can be delivered by the use of liposomes. By using liposomes, particularly where the liposome surface carries ligands specific for target cells, or are otherwise preferentially directed to a specific organ, one can focus the delivery of the active agent into target cells in vivo. See, e.g., U.S. Pat. Nos. 6,063,400; 6,007,839; Al-Muhammed (1996) J. Microencapsul. 13:293-306; Chonn (1995) Curr. Opin. Biotechnol. 6:698-708; Ostro (1989) Am. J. Hosp. Pharm. 46:1576-1587. As used in the present invention, the term "liposome" means a vesicle composed of amphiphilic lipids arranged in a bilayer or bilayers. Liposomes are unilamellar or multilamellar vesicles that have a membrane formed from a lipophilic material and an aqueous interior that contains the composition to be delivered. Cationic liposomes are positively charged liposomes that are believed to interact with negatively charged DNA molecules to form a stable complex. Liposomes that are pH-sensitive or negatively-charged are believed to entrap DNA rather than complex with it. Both cationic and noncationic liposomes have been used to deliver DNA to cells.

Liposomes can also include "sterically stabilized" liposomes, i.e., liposomes comprising one or more specialized lipids. When incorporated into liposomes, these specialized lipids result in liposomes with enhanced circulation lifetimes relative to liposomes lacking such specialized lipids. Examples of sterically stabilized liposomes are those in which part of the vesicle-forming lipid portion of the liposome comprises one or more glycolipids or is derivatized with one or more hydrophilic polymers, such as a polyethylene glycol (PEG) moiety. Liposomes and their uses are further described in U.S. Pat. No. 6,287,860.

The formulations of the invention can be administered for prophylactic and/or therapeutic treatments. In some embodiments, for therapeutic applications, compositions are administered to a subject who is at risk of or has a disorder described herein, in an amount sufficient to cure, alleviate or partially arrest the clinical manifestations of the disorder or its complications; this can be called a therapeutically effective amount.

The amount of pharmaceutical composition adequate to accomplish this is a therapeutically effective dose. The dosage schedule and amounts effective for this use, i.e., the dosing regimen, will depend upon a variety of factors, including the stage of the disease or condition, the severity of the disease or condition, the general state of the patient's health, the patient's physical status, age and the like. In calculating the dosage regimen for a patient, the mode of administration also is taken into consideration.

The dosage regimen also takes into consideration pharmacokinetics parameters well known in the art, i.e., the active agents' rate of absorption, bioavailability, metabolism, clearance, and the like (see, e.g., Hidalgo-Aragones (1996) J. Steroid Biochem. Mol. Biol. 58:611-617; Groning (1996) Pharmazie 51:337-341; Fotherby (1996) Contraception 54:59-69; Johnson (1995) J. Pharm. Sci. 84:1144-1146; Rohatagi (1995) Pharmazie 50:610-613; Brophy (1983) Eur. J. Clin. Pharmacol. 24:103-108; Remington: The Science and Practice of Pharmacy, 21st ed., 2005). The state of the art allows the clinician to determine the dosage regimen for each individual patient, active agent and disease or condition treated.

Guidelines provided for similar compositions used as pharmaceuticals can be used as guidance to determine the dosage regiment, i.e., dose schedule and dosage levels, administered practicing the methods of the invention are correct and appropriate.

Single or multiple administrations of formulations can be given depending on for example: the dosage and frequency as required and tolerated by the patient, the degree and amount of therapeutic effect generated after each administration (e.g., effect on tumor size or growth), and the like. The formulations should provide a sufficient quantity of active agent to effectively treat, prevent or ameliorate conditions, diseases or symptoms.

In alternative embodiments, pharmaceutical formulations for oral administration are in a daily amount of between about 1 to 100 or more mg per kilogram of body weight per day. Lower dosages can be used, in contrast to administration orally, into the blood stream, into a body cavity or into a lumen of an organ. Substantially higher dosages can be used in topical or oral administration or administering by powders, spray or inhalation.

In some embodiments, the methods described herein can include co-administration with other drugs or pharmaceuticals, e.g., compositions for providing cholesterol homeostasis. For example, the inhibitory nucleic acids can be co-administered with drugs for treating or reducing risk of a disorder described herein.

EXAMPLES

The invention is further described in the following examples, which do not limit the scope of the invention described in the claims.

Methods

The following methods were used in the examples set forth below.

UV-Crosslinking and Immunoprecipitation of RNA

A modified CLIP protocol based on previously published protocols (Ule et al., 2003; Ule et al., 2005; Jensen and R. B., 2008; Licatalosi et al., 2008; Yeo et al., 2009) was used in this study. $10^8$ mouse ES cells expressing the FLAG-tagged CTCF protein (Sun et al., 2013) were trypsinized and resuspended in PBS. Cells for +UV experiments were cross-linked with 256 nm UV in a 15-cm dish at 250 mJ/cm$^2$ using the Stratalinker 1800 (Stratagene). ±UV cell pellets were resuspended in 1-2 mL Buffer A (10 mM HEPES pH 7.9, 1.5 mM MgCl$_2$, 10 mM KCl, 0.5 mM PMSF) and incubated on ice for 30 min with frequent vortexing. Nuclei were pelleted at 2500×g for 15 min, washed in PBS, resuspended in 500 mL Buffer C (20 mM HEPES pH 7.5, 420 mM NaCl, 15% glycerol, 1.5 mM MgCl$_2$, 0.5 mM PMSF, protease and RNase inhibitors) and incubated at 4° C. for 30 min with rotation. Nuclear lysates were diluted with one volume of 20 mM HEPES pH 7.5 and treated with 40 U TURBO DNase at 37° C. for 30 min to liberate chromatin-associated CTCF-RNA complexes. After quenching the DNase with 10 mM EDTA, 5% was removed and saved for RNA-seq, while the remainder was added with sarkosyl to 0.5% and the RNA was fragmented by sonication with Diagenode Bioruptor XL twice for 20 min each (with 30 s on, 30 s off cycles). Cell debris was pelleted at 16,000×g for 10 min, the lysate was diluted again with 1 volume of 20 mM HEPES and divided into three aliquots. 15 uL of Anti-FLAG M2 Magnetic Beads (Sigma-Aldrich A2220) was added to each aliquot and incubated at 4° C. overnight with rotation. Beads from all aliquots were recombined, washed 3× with high salt Wash Buffer I (20 mM HEPES pH 7.5, 250 mM NaCl, 0.1% SDS, 0.5% sodium deoxycholate, 0.5% Nonident-P40, protease and RNase inhibitors), once with 1× TURBO DNase buffer, then treated with 100 U/mLTURBO DNase at 37° C. for 30 min. Beads were further washed 2× with Wash Buffer I supplemented with 10 mM EDTA, then 2× with low salt Wash Buffer II (50 mM Tris-HCl pH 7.5, 1% NP40, 0.5% sodium deoxycholate, 50 mM NaCl, 10 mM EDTA), and 1× with PNK buffer (50 mM Tris-HCl pH 7.5, 10 mM $MgCl_2$, 0.5% NP40, 5 mM DTT). CLIP-tags on beads were radio-labelled with [$\gamma$-$^{32}$P]ATP using T4 polynucleotide kinase (New England Biolabs) for 20 min at 37° C., and washed 4× with PNK buffer. Beads were resuspended in SDS-PAGE loading buffer at heated for 5 min at 70° C., run on 8% Bis-Tris SDS-PAGE in MOPS buffer (50 mM MOPS, 50 mM Tris, 0.1% SDS, 1 mM EDTA) at 120 V, transferred to nitrocellulose membrane, and exposed to film for autoradiography or used for immunoblot with 1:3000 αFLAG antibodies (Sigma-Aldrich F1804).

Membrane fragments containing CLIP signal, as confirmed by immunoblot, and corresponding positions on control lanes were excised, and RNA was eluted by incubation in prewarmed proteinase K buffer (100 mM Tris-HCl pH 7.5, 50 mM NaCl, 10 mM EDTA, 0.5% SDS, 4 mg/mL proteinase K) for 20 min at 37° C., then incubation for an additional 20 min in proteinase K buffer supplemented with 7 M urea, followed by TRIzol extraction and ethanol precipitation. RNA size and quality was verified using RNA 6000 Pico chips on the Agilent Bioanalyzer.

CLIP-seq library was constructed from CLIP RNA using the NEBNext Small RNA Library Prep set (New England Biolabs E7330), size-selected and cleaned up of primer/adaptor-dimers using Agencourt AMPure XP beads (Beckman Coulter A63880), verified with DNA High Sensitivity chips on the Agilent Bioanalyzer, quantitated using KAPA Biosystems library quantification kit (KK4844), and sequenced with the Illumina HiSeq 2000 system with 50 cycles paired end reads.

RNA-Seq

Nuclear lysate was removed before sonication, and treated with proteinase K and reprecipitated in the same way as CLIP RNA eluted from membrane. RNA was depleted of ribosomal RNA with RiboMinus Eukaryote System (Ambion A15026), treated with TURBO DNase, and cleaned up with RNeasy MinElute columns (Qiagen 74204). RNA was fragmented in Superscript III first strand synthesis buffer for 10 min at 94° C. before being used for first strand cDNA synthesis with the addition of 27.5 ng/μL actinomycin D. Second strand cDNA synthesis was performed with NEBNext mRNA Second Strand Synthesis Module (E6111) in the presence of 1.25 mM dUTP to preserve directionality. Double-stranded cDNA was then used to generate RNA-seq libraries using the NEBNext ChIP-Seq Library Prep Master Mix Set (E6240), and quality-checked and sequenced similarly as the CLIP-seq libraries.

ChIP-Seq

ChIP was performed essentially as described (Jeon and Lee, 2011) using 1.5×10$^7$ TST mouse ES cells (Ogawa and Lee, 2003) and aCTCF antibodies (Cell Signaling 2899). After nuclear lysis, chromatin was sonicated in Covaris S2 ultrasonicator with 5% duty cycle, intensity 6, 200 bursts per 1-min cycle for 8 min, before IP. 15 ng of input or purified ChIP DNA was used for ChIP-seq library construction using the NEBNext ChIP-Seq Library Prep Master Mix Set. Libraries were quality-checked and sequenced similarly as CLIP-seq libraries.

Bioinformatic Analyses

Adaptor sequences were trimmed from libraries with either Trim Galore! v0.3.3 (http://www.bioinformatics.babraham.ac.uk/projects/trim_galore/) (for CLIP-seq and RNA-seq; stringency 15 and allowed error rate 0.2) or Cutadapt v1.0 (Martin, 2011)((for ChIP-seq; allowed error rate 0.2). Identical sequences were removed by custom programs prior to alignment. To account for the *M. mus* (*mus*) *M. castaneus* (*cas*) hybrid character of the ES cell lines, reads were first aligned to custom mus/129 and cas genomes, and then mapped back to the reference mm9 genome (Pinter et al., 2012). RNA was aligned with Tophat (v2.0.8 or greater) (Kim et al., 2013), while DNA was aligned using Novoalign (3.00.03) (www.novocraft.com). Post-processing of mm9 alignments was performed with custom scripts, SAMtools v0.1.18 (Li et al., 2009), and BEDtools v2.17.0 (Quinlan and Hall, 2010). These included accounting, alignment file-type conversion, extracting and sorting uniquely/paired-end reads (SAMtools), and obtaining wig coverage files (DNA: BEDtools genomecov; RNA: SAMtools depth).

For repeats analysis, non-uniquely aligned fragments were put into a "reps" category. mm9 RepeatMasker tracks from UCSC were obtained using the table browser. The first of each non-uniquely aligned fragment was then extracted and intersected with each family of repeat elements using BEDtools intersect with options -s, -c, and the percentage that mapped to each family was counted.

For CLIP-seq, +UV and −UV libraries were scaled according to total number of fragments in each library (determined by SAMtools flagstat combining reads "with itself and mate mapped" and "singletons"). After subtracting −UV hits from +UV single nucleotide hit counts, peaks of CTCF enrichment were called using Piranha v1.2.0 (Uren et al., 2012) based on a zero-truncated Poisson distribution and a p-value cutoff of 0.01. Peaks were categorized into sense, antisense-only and intergenic classes. The sense category was derived by strand-specifically intersecting peaks with 3000-nt enveloped gene bodies. The antisense-only category was derived similarly using an antisense intersection and subtracting out sense genes, while the intergenic category was the result of the complement of intersecting peaks non-strand-specifically with gene bodies.

To assemble RNA transcripts from RNA-seq data, Cufflinks (v2.1.1) (Trapnell et al., 2012) was used on composite d0 and d3 alignments with upper-quartiles-norm normalization, and guided (-g) with mm9 Ensembl transcripts. The resulting transcripts were purged of entries with FPKM=0, converted to bed format, and merged using BEDtools merge with options -nms, -scores mean, -s. To compare CLIP-seq and RNA-seq, CLIP peaks were mapped onto the transcripts using BEDtools map with options -o sum, -s, and FPKM values were obtained by dividing the summed coverage by transcript length/1000. Scatterplots were generated using Excel.

For display purposes, ChIP-seq coverage of uniquely aligned neutral/cas/mus (comp) reads were obtained and normalized to input libraries using in-house software (smoothing parameters: window size 125 and step size 25). ChIP binding positions were identified by intersecting the results of the mirror tag correlation (MTC) and window tag density (WTD) peak-finding methods within the SPP program (Kharchenko et al., 2008). Briefly, both IP and input data had local anomalies removed, then binding positions were identified using the find binding.positions routine (FDR=0.01; default method for WDT, and tag.lwcc for MTC, whs=detection.window.halfsize). Peak regions were extended using the add.broadpeak.regions function (window. size=10$^2$, z.thr=3). Finally these results were intersected to give a final high confidence peak list.

ChIP-seq allelic peak calling was performed to identify an SPP-called region as being on the active (cas) or inactive (mus) chromosome. Under the null hypothesis it was equally likely that a ChIP region would be identified by tags of either cas or mus and thus was treated as if following a binomial distribution (Pinter et al., 2012). p-values associated with cas or mus tag-id counts under an SPP-determined peak were determined from the q-value of the cumulative binomial distribution (p=0.5).

Cis-regulatory Element Annotation System (Shin et al., 2009) was used to determine peak enrichment in genomic regions and to obtain metagene profiles and metasite analyses (including comparison of CLIP peaks to ChIP enrichment). CEAS parameters were span=5000; sizes=1000, 3000,5000; and rel-dist=5000. Metagene profiles were obtained on .wig files generated from the peaks .bed files using a custom perl script. The CEAS-associated program sitepro was used to generate metasite profiles.

Recombinant Protein Cloning and Purification

Mus musculus CTCF cDNA with additional sequence encoding for a C-terminal 6×His tag was cloned into pFLAG-2 (Sigma) using EcoRI and XhoI to generate pBD39. GFP cDNA (pFA6a-GFP(S65T)-kanMX6) was similarly cloned with a C-terminal 6×His tag into pFLAG-2 to generate pBD40. Recombinant FLAG-CTCF-6×His and FLAG-GFP-6×His proteins were purified from Rosetta-Gami B cells (Novagen). Briefly, pBD39 and pBD40 transformed cells were induced with 0.2 mM IPTG at 18° C. (CTCF) or 1 mM IPTG (GFP) at 30° C. FLAG-GFP-6×His expressing cells were lysed at 4° C. with 50 mM sodium phosphate pH 8, 300 mM NaCl, 20 mM imidazole, 0.5% Triton X-100, and protease inhibitors. Following sonication, insoluble material was separated by centrifugation. FLAG-GFP-6×His was purified from the supernatant using Ni-NTA resin (Qiagen). FLAG-CTCF-6×His expressing cells were lysed at 4° C. with 50 mM sodium phosphate pH 8, 300 mM NaCl, 20 mM imidazole, 0.5% Sarkosyl, and protease inhibitors. Triton X-100 was then added to 2% final (v/v). Debris was removed by centrifugation. FLAG-CTCF-6×His was purified from the supernatant using Ni-NTA resin. Both proteins were eluted from Ni-NTA resin with 50 mM sodium phosphate pH 8, 300 mM NaCl, and 250 mM imidazole. Eluates were dialyzed against 10 mM Tris-HCl pH 7.5, 2.5 mM MgCl$_2$, 50 mM KCl, 0.1 mM ZnSO$_4$, mM DTT, 0.1% Tween-20, and 10% glycerol.

GST-fusion proteins of CTCF fragments were previously described (Donohoe et al., 2007).

In Vitro RNA Pulldown Assay

In vitro pulldown was performed as previously reported (Jeon and Lee, 2011). 1.5 µg of purified FLAG-tagged CTCF proteins or equimolar amounts of FLAG-tagged GFP (or no protein, in the case of mock pulldown) was immobilized on 30 µL of Anti-FLAG M2 Magnetic Beads in 400 µL PBS with 1 mM DTT at 4° C. for 2 hr. 15 µg of total RNA from day 3 female ES cells, treated with TURBO DNase and renatured by heating for 10 min 60° C. followed by slow cooling to 4° C., was then incubated with the protein-beads complexes at room temperature for 1 hr in 400 µL of Binding Buffer (1×PBS, 2 mM MgCl$_2$, 0.2 mM ZnCl$_2$, 0.2% NP40, 1 mM DTT, 100 U/ml RNase Inhibitor, 0.1 mg/ml yeast tRNA [Invitrogen], 0.5 mg/mL bovine serum albumin), with 10% of RNA-buffer mixture saved as input. Beads were washed 5× with Wash Buffer (1×PBS supplemented with additional 450 mM NaCl, to a total of 600 mM). RNA was isolated by TRIzol extraction and used in strand-specific qRT-PCR with the following primers:

RepA F:
(SEQ ID NO: 139661)
5'-CGGTTCTTCCGTGGTTTCTC-3'

RepA R:
(SEQ ID NO: 139662)
5'-GGTAAGTCCACCATACACAC-3'

RepF F:
(SEQ ID NO: 139663)
5'-CTCGACAGCCCAATCTTTGTT-3'

RepF R:
(SEQ ID NO: 139664)
5'-ACCAACACTTCCACTTAGCC-3'

RepC F:
(SEQ ID NO: 139665)
5'-ACTTTGCATACAGTCCTACTTTACTT-3'

RepC R:
(SEQ ID NO: 139666)
5'-GGAAAGGAGACTTGAGAGATGATAC-3'

Tsix F:
(SEQ ID NO: 139667)
5'-AATGCTTGCCAGCTATGCGG-3'

Tsix R:
(SEQ ID NO: 139668)
5'-TAACCACCTGTAAGGGACAG-3'

Jpx F:
(SEQ ID NO: 139669)
5'-TTAGCCAGGCAGCTAGAGGA-3'

Jpx R:
(SEQ ID NO: 139670)
5'-AGCCGTATTCCTCCATGGTT-3'

Ppia F:
(SEQ ID NO: 139671)
5'-CGATGACGAGCCCTTGG-3'

Ppia R:
(SEQ ID NO: 139672)
5'-TCTGCTGTCTTTGGAACTTTGTC-3'

H19 F:
(SEQ ID NO: 139673)
5'-TGTAAACCTCTTTGGCAATGCTGCC-3'

H19 R:
(SEQ ID NO: 139674)
5'-TATTGATGGACCCAGGACCTCTGGT-3'

Gtl2 F:
(SEQ ID NO: 139675)
5'-CGAGGACTTCACGCACAAC-3'

Gtl2 R:
(SEQ ID NO: 139676)
5'-TTACAGTTGGAGGGTCCTGG-3'

Gtl2-as F:
(SEQ ID NO: 139677)
5'-CACCCTGAACATCCAACA-3'

Gtl2-as R:
(SEQ ID NO: 139678)
5'-CATCTGCTTTTCCTACCTGG-3'

Malat1 F:
(SEQ ID NO: 139679)
5'-TAAGCGCTTGCCTCTGTCTT-3'

Malat1 R:
(SEQ ID NO: 139680)
5'-CACCTGCATTCTGTGTGGTC-3'

Neat1 F:
(SEQ ID NO: 139681)
5'-TGAGTGCTTTGCCACTGAAT-3'

Neat1 R:
(SEQ ID NO: 139682)
5'-TAACAGCTTCCCCTCTGCTC-3'

Airn F:
(SEQ ID NO: 139683)
5'-TAGTGTCCCGAGGACAAACC-3'

Airn R:
(SEQ ID NO: 139684)
5'-AGTGAGATCCAGGGATGCAG-3'

Kcnq1ot1 F:
(SEQ ID NO: 139685)
5'-ACTCGGAATTCAGGTGTGGG-3'

Kcnq1ot1 R:
(SEQ ID NO: 139686)
5'-GGTTGGAGGTCACCACAACAT-3'

Nespas F:
(SEQ ID NO: 139687)
5'-AGATGAGTCCAGGTGCTT-3'

Nespas R:
(SEQ ID NO: 139688)
5'-CAAGTCCAGAGTAGCCAAC-3'

UV-Crosslink RNA Immunoprecipitation

UV-RIP was performed as previously reported (Jeon and Lee, 2011). $1 \times 10^7$ day 3 female ES cells were trypsinized and resuspended in PBS. Cells for +UV experiments were crosslinked with 256 nm UV in a 15-cm dish at 250 mJ/cm$^2$ using the Stratalinker 1800 (Stratagene). ±UV cell pellets were resuspended in 1 mL of UV-RIP Nuclear Isolation Buffer (10 mM HEPES pH 7.5, 1.5 mM MgCl$_2$, 10 mM KCl, 0.5 mM DTT, protease inhibitors) for 30 min at 4° C., after which NP40 was added to a final concentration of 0.1% and incubated for an additional 10 min at 4° C. Nuclei were pelleted and lysed in 1 mL Lysis Buffer (1×PBS, 1% NP40, 0.5% sodium deoxycholate, protease and RNase inhibitors) for 25 min at 4° C., then for 15 min at 37° C. with 30 U TURBO DNase (Ambion) added. Lysates were spun down at 13,000 rpm at 4° C. for 10 min, and 5 μg of either αCTCF or IgG was added to the cleared lysate and incubated at 4° C. overnight with rotation, saving 5% lysate as input. 40 μL of Dynabeads Protein G per IP was pre-washed 3× with Lysis Buffer, added to the lysate-antibody mixture, and incubated for 2 hr at 4° C. to capture the RNA-protein-antibody complexes. Beads were washed 3× with high salt Wash Buffer I (Lysis Buffer supplemented with 150 mM NaCL, to a total of 300 mM), once with 1× TURBO DNase buffer, then treated with 100 U/mL TURBO DNase at 37° C. for 30 min in TURBO DNase buffer containing fresh protease and RNase inhibitors. Beads were further washed 2× with Wash Buffer I supplemented with 10 mM EDTA to quench DNase activity, then 2× with low salt Wash Buffer II (50 mM Tris-HCl pH 7.5, 1% NP40, 0.5% sodium deoxycholate, 50 mM NaCl, 10 mM EDTA), and finally treated with 100 μg proteinase K in 200 μL of proteinase K buffer (100 mM Tris-HCl pH 7.5, 50 mM NaCl, 10 mM EDTA, 0.5% SDS) for 30 min at 50° C. RNA was isolated by TRIzol extraction and used in strand-specific qRT-PCR with the following primers, in addition to primers listed under in vitro pulldown assay:

Gapdh F:
(SEQ ID NO: 139689)
5'-ATGAATACGGCTACAGCAACAGG-3'

Gapdh R:
(SEQ ID NO: 139690)
5'-CTCTTGCTCAGTGTCCTTGCTG-3'

Xite1 F:
(SEQ ID NO: 139691)
5'-GTCCACACTCCGCCAGCA-3'

Xite1 R:
(SEQ ID NO: 139692)
5'-TTAGGACAGAGTGAAAATCCGGAAGTTGT-3'

Xite2 F:
(SEQ ID NO: 139693)
5'-CCTATTACAACTATTACTCCATGCTACAACTTCTGG-3'

Xite2 R:
(SEQ ID NO: 139694)
5'-GGCATCTGATTCTCTCTTTCATTGTCCATG-3'

Tsix1 F:
(SEQ ID NO: 139695)
5'-CTCAAGAGCCTTAGGTCCCGC-3'

Tsix1 R:
(SEQ ID NO: 139696)
5'-AAGTGTGTAGCGCTTGCAGGTAC-3'

Tsix2 F:
(SEQ ID NO: 139697)
5'-TGAGATGCGGGCTAAGGAGAGG-3'

Tsix2 R:
(SEQ ID NO: 139698)
5'-CTGAAAGCACTTTGCCACTGTCCC-3'

Tsix3 F:
(SEQ ID NO: 139699)
5'-ACAGTGGAGCGATGGCTACGT-3'

Tsix3 R:
(SEQ ID NO: 139700)
5'-CTTCATCTCCGCATAGCTGGCAA-3'

Tsix4 F:
(SEQ ID NO: 139701)
5'-TCTGGGAACTTCTACCTGATCCTCACAT-3'

Tsix4 R:
(SEQ ID NO: 139702)
5'-AACTAGAAACAGGCAGTTAAGGTCCAAGG-3'

Tsix5 F:
(SEQ ID NO: 139703)
5'-CTTCTACTTGGACAAACCATGTATCGCTCC-3'

Tsix5 R:
(SEQ ID NO: 139704)
5'-TCCCAAGGTATGGAGTCACCAGG-3'

JpxE1 F:
(SEQ ID NO: 139705)
5'-AGGCTTCTGTAACTTATAAAATGGCGGC-3'

JpxE1 R:
(SEQ ID NO: 139706)
5'-CAGGGCATGTTCATTAATTGGCCAGT-3'

JpxE2 F:
(SEQ ID NO: 139707)
5'-CATTAATCCACCACTGAAGGAAGTCAGAGC-3'

JpxE2 R:
(SEQ ID NO: 139708)
5'-AGGTGAGCCAGCAAGCCGTATT-3'

U1 F:
(SEQ ID NO: 139709)
5'-CCAGGGCGAGGCTTATCCATT-3'

U1 R:
(SEQ ID NO: 139710)
5'-GCAGTCCCCCACTACCACAAAT-3'

RNA EMSA

RNA EMSA was performed as previously described (Sun et al., 2013). Briefly, probes were in vitro transcribed with T7 RNA polymerase (Ambion) from PCR-amplified cDNA template or linearized plasmids with cloned Xist RepA or RepF sequences. Transcripts were TURBO DNase treated, TRIzol purified, 5'-dephosphorylated with alkaline phosphatase (New England Biolabs), labelled with [γ-$^{32}$P]ATP using T4 polynucleotide kinase (New England Biolabs), and cleaned with Microspin G-50 columns. Probes were denatured at 95° C. for 2 min, then cooled at 70° C. for 5 min, 37° C. for 15 min, room temperature for 15 min, and kept in folding buffer (50 mM NaCl, 2 mM MgCl$_2$) on ice. For binding reactions, RNA probes were incubated with recombinant proteins at room temperature for 30 min in binding buffer (total reaction volume 20 µL) containing 50 mM Tris-HCl pH 7.5, 150 mM NaCl, 5 mM MgCl$_2$, 0.1 mM ZnSO$_4$, 10% glycerol, 0.1% Tween-20, 1 mM DTT, 1 µg poly(dI-dC), 0.1 mM polyamine, 8U RNase inhibitor (Roche), and 1 µg yeast tRNA. Samples were resolved at 4° C. by TBE polyacrylamide gel electrophoresis and detected using storage phosphor screen and Typhoon scanner (Amersham).

PCR primers (unlisted primers same as those for in vitro pulldown/UV-RIP):

```
T7_Neat1 F,
                                    (SEQ ID NO: 139711)
5'-TAATACGACTCACTATAGTGAGTGCTTTGCCACTGAAT-3'

T7_Nespas F,
                                    (SEQ ID NO: 139712)
5'-TAATACGACTCACTATAGAGATGAGTCCAGGTGCTT-3'

T7_Gapdh F,
                                    (SEQ ID NO: 139713)
5'-TAATACGACTCACTATAGATGAATACGGCTACAGCAACAGG-3'

T7_GtL2_2 F,
                                    (SEQ ID NO: 139714)
5'-TAATACGACTCACTATAGGGTGCTGGTGGATCGTTAAT-3'

GtL2_2 R,
                                    (SEQ ID NO: 139715)
5'-CTCCACTCCCTATTGCTTTCTATC-3'

T7_Xite F,
                                    (SEQ ID NO: 139716)
5'-TAATACGACTCACTATAGGAAGTGTGTGAGCAGAGTAAGG-3'

Xite R,
                                    (SEQ ID NO: 139717)
5'-GATGCGTGAAGACCCATGAA-3'

T7_Tsix_ex1F,
                                    (SEQ ID NO: 139718)
5'-TAATACGACTCACTATAGACAAGGTCCATGCTCTGTTCC-3'

T7_Tsix_ex1_mF,
                                    (SEQ ID NO: 139719)
5'-TAATACGACTCACTATAGGCAAGCGCTACACACTTGCG-3'

Tsix_ex1_mR,
                                    (SEQ ID NO: 139720)
5'-TTGCAGGTACTTTTGGGACC-3'

Tsix_ex1_mR2,
                                    (SEQ ID NO: 139721)
5'-AAGATGCGTGGATATCTCGG-3'

Tsix_ex1R,
                                    (SEQ ID NO: 139722)
5'-TTAGCCCGCATCTCACCCAC-3'

T7_Jpx_ex1F,
                                    (SEQ ID NO: 139723)
5'-TAATACGACTCACTATAGACGGCACCACCAGGCTTCT-3'

Jpx_ex3R,
                                    (SEQ ID NO: 139724)
5'-GAGTTTATTTGGGCTTACAGTTC-3'
```

Primer combination for Tsix RNA EMSA probes:
a, T7_Tsix_ex1F×Tsix_ex1_mR;
b, T7_Tsix_ex1 mF×Tsix_ex1R;
c, T7_Tsix_ex1F×Tsix_ex1_mR2;
d, T7_Tsix_ex1F×Tsix_ex1R.

Generation of shRNA Knockdown Lines

Wild-type male J1 (40XY) and female EL16.7 (40XX) ES cell lines and culture conditions have been previously described (Lee and Lu, 1999). Stable knockdown cell lines were generated by linearizing a pLKO.1-based vector containing shRNAs against Tsix, transfecting the DNA into J1 and EL16.7 cells using Lipofectamine 2000 (Invitrogen), and selecting for clones in 1 µg/mL puromycin for 7-9 days. Control cell lines containing a scrambled shRNA were also generated in parallel.

shRNA sequences were as follows: shTsix3 sense, 5'-GAAATAACCTCCAGAGAAATG-3' (SEQ ID NO: 139725); shTsix3 antisense, 5'-CTTTATTG-GAGGTCTCTTTAC-3' (SEQ ID NO: 139726); shScr sense, 5'-CCTAAGGTTAAGTCGCCCTCG-3' (SEQ ID NO: 139727); shScr antisense, 5'-CGAGGGCGACT-TAACCTTAGG-3' (SEQ ID NO: 139728).

Each cell line was differentiated for 6-8 days using suspension cultures forming embryoid bodies (EBs) at a starting concentration of ~5×10$^5$ cells/60 cm$^2$ as described (Ahn and Lee, 2010). At day 4, EBs were plated onto 0.2% gelatinized tissue culture plates for outgrowth. LIF (leukemia inhibitory factor) was removed from the differentiation medium, and culture medium was changed every two days. All experiments were performed three times. Viable cells were counted using a Cellometer Auto cell counter (Nexcelom Biosciences). Images were taken with a Nikon Eclipse TE2000-E inverted microscope.

Transient Knockdown by Antisense LNA

Antisense LNA oligonucleotides were obtained from Exiqon, Corp., and used for Tsix RNA knockdown. LNAs were delivered into female EL16.7 (40XX) ES cell line using Amaxa Biosystems Nucleofector and Mouse ES Cell Nucleofector Kit (Lonza). 2×10$^7$ trypsinized cells on d0, d3 and d6 were processed with 2 uM LNA using A-24 program. Cells were collected 6h or 12h later. LNA knockdown was confirmed by qRT-PCR using the following primers: TsixCf and TsixCr (see below); Tsix-F2, 5'-GTACGT-TACTCGCTAGCAGTAAT-3' (SEQ ID NO: 139729) and Tsix-R2, 5'-ATCCTTTGATTTTCTAATACCC-3' (SEQ ID NO: 139730); b-actin F, 5'-TTCTTTGCAGCTCCTTCGTT-3' (SEQ ID NO: 139731) and b-actin R, 5'-ATGGAGGG-GAATACAGCCC-3' (SEQ ID NO: 139732) LNA sequences are as follows: Tsix antisense LNA1, 5'-ACT-ACGCAGGCATTTT-3' (SEQ ID NO: 139733); Tsix antisense LNA2, 5'-GTATGGAGTCACCAGGTT-3' (SEQ ID NO: 139734); Scr LNA, 5'GTGTAACACGTC-TATACGCCCA-3' (SEQ ID NO: 139735).

Chromatin Immunoprecipitation

ChIP analyses were carried out using a modified protocol from Millipore as described (Ahn and Lee, 2010). Briefly, 1-2×10$^7$ cells were trypsinized and crosslinked with formaldehyde to a final concentration of 1% at 37° C. for 10 min. Crosslinking was quenched with glycine (125 mM final), and cells were pelleted at 640×g for 5 min and washed twice with 1×PBS containing protease inhibitors. Nuclei were isolated from fixed cells by washing once with Buffer A-NP40 (5 mM PIPES pH 8, 85 mM KCl, 0.5% NP40), incubated on ice for 10 min, then washed with Buffer A (5 mM PIPES pH 8, 85 mM KCl) and Lysis Buffer (10 mM Tris-HCl pH 8, 10 mM NaCl, 3 mM MgCl$_2$, 0.5% NP40). Pelleted nuclei were resuspended in MNase buffer (10 mM Tris-HCl pH 8, 10 mM NaCl, 3 mM MgCl$_2$, 1 mM CaCl$_2$), 4% NP40) containing protease inhibitors and 1% SDS. Lysates were sonicated using the Diagenode Bioruptor XL (15 min total with 30 s on and 30 s off cycles). Sonicated lysates were cleared at 16,100×g for 10 min. For each immunoprecipitation, 50 µL of Dynabeads Protein G were first incubated with 5 µg of either αCTCF, αOCT4 (Santa Cruz sc8628) or IgG for 2 hr with rotation, then with sonicated supernatants (~2.0×10$^6$ cells) overnight. IP samples were washed 2× each with Low Salt TSE 150 Buffer (20 mM Tris-HCl pH 8, 0.1% SDS, 1% Triton X-100, 2 mM EDTA, 150 mM NaCl), High Salt TSE 500 Buffer (20 mM Tris-HCl pH 8, 0.1% SDS, 1% Triton X-100, 2 mM EDTA, 500 mM NaCl), LiCl Buffer (10 mM Tris-HCl pH 8, 250 mM LiCl, 1% NP40, 1% deoxycholate, 1 mM EDTA), and TE Buffer (10 mM Tris-HCl pH 8, 1 mM EDTA). Protein-antibody complexes were eluted from the beads with freshly made Elution Buffer (50 mM Tris-HCl pH 8, 1 mM EDTA, 1% SDS, 50 mM NaHCO$_3$) incubated at 65° C. for 10 min. Crosslinks were reversed by digestion with 80 µg proteinase K at 65° C. for 4 hrs, and DNA was recovered by phenol/chloroform extraction and used for qPCR with the following primers (Xu et al., 2007; Donohoe et al., 2009; Navarro et al., 2010):

TsixAf, 5'-GTGTGTCATAGCTCAAGAGG-3' (SEQ ID NO: 139736)
TsixAr, 5'-GGAGCCTAAACCTGTCTGTC-3' (SEQ ID NO: 139737)
TsixCf, 5'-AATGCTTGCCAGCTATGCGG-3' (SEQ ID NO: 139738)
TsixCr, 5'-TAACCACCTGTAAGGGACAG-3' (SEQ ID NO: 139739)
Xitep77 (XiteCf), 5'-CAAGGTTGG-GAACAAGGTATATCAGG-3' (SEQ ID NO: 139740)
Xitep78 (XiteCr), 5'-GGACAAGGGACAGAAGTGCT-TATTTTAC-3' (SEQ ID NO: 139741)
XiteAf, 5'-ATGGCTTTAAGTCTGTAGCACAA-3' (SEQ ID NO: 139742)
XiteAr, 5'-CAGCCTCTATTCAGCTAGACTCC-3' (SEQ ID NO: 139743)
RS14f, 5'-ACATTCCGGCTACACACAAG-3' (SEQ ID NO: 139744)
RS14r, 5'-TGGGTGTTATACCCGTGTAGG-3' (SEQ ID NO: 139745)
Xist f, 5'-AACCCTTTTAAGTCCACTGTAAAT TCC-3' (SEQ ID NO: 139746)
Xist r, 5'-TAGAGAGCCAGACAATGCTAAGCC-3' (SEQ ID NO: 139747)
H19F, 5'-GTCACTCAGGCATAGCATTC-3' (SEQ ID NO: 139748)
H19R, 5'-GTCTGCCGAGCAATATGTAG-3' (SEQ ID NO: 139749)
ICRnF, 5'-GAGCTCTAAGGGAGGCTCCG-3' (SEQ ID NO: 139750)
ICRnR, 5'-CATCATGGTGTCCTCACAGG-3' (SEQ ID NO: 139751)

TsixAf,
(SEQ ID NO: 139736)
5'-GTGTGTCATAGCTCAAGAGG-3'

TsixAr,
(SEQ ID NO: 139737)
5'-GGAGCCTAAACCTGTCTGTC-3'

TsixCf,
(SEQ ID NO: 139738)
5'-AATGCTTGCCAGCTATGCGG-3'

TsixCr,
(SEQ ID NO: 139739)
5'-TAACCACCTGTAAGGGACAG-3'

Xitep77 (XiteCf),
(SEQ ID NO: 139740)
5'-CAAGGTTGGGAACAAGGTATATCAGG-3'

Xitep78 (XiteCr),
(SEQ ID NO: 139741)
5'-GGACAAGGGACAGAAGTGCTTATTTTAC-3'

XiteAf,
(SEQ ID NO: 139742)
5'-ATGGCTTTAAGTCTGTAGCACAA-3'

XiteAr,
(SEQ ID NO: 139743)
5'-CAGCCTCTATTCAGCTAGACTCC-3'

RS14f,
(SEQ ID NO: 139744)
5'-ACATTCCGGCTACACACAAG-3'

RS14r,
(SEQ ID NO: 139745)
5'-TGGGTGTTATACCCGTGTAGG-3'

Xist f,
(SEQ ID NO: 139746)
5'-AACCCTTTTAAGTCCACTGTAAATTCC-3'

Xist r,
(SEQ ID NO: 139747)
5'-TAGAGAGCCAGACAATGCTAAGCC-3'

H19F,
(SEQ ID NO: 139748)
5'-GTCACTCAGGCATAGCATTC-3'

H19R,
(SEQ ID NO: 139749)
5'-GTCTGCCGAGCAATATGTAG-3'

ICRnF,
(SEQ ID NO: 139750)
5'-GAGCTCTAAGGGAGGCTCCG-3'

ICRnR,
(SEQ ID NO: 139751)
5'-CATCATGGTGTCCTCACAGG-3'

Pairing Analysis

Pairing was assayed as previously described (Xu et al., 2006). DNA FISH was performed using two X-linked probes (centromeric RP24 and pSx9-Xic) to exclude XO cells. Digital images were taken with a Nikon Eclipse 90i microscope (Nikon Instruments, Inc.) and processed using Volocity software (Improvision). X-X distances were normalized to the nuclear area as distinguished by DAPI staining of the DNA. Measurements in 3D and 2D were essentially identical because maximal z dimensions were small compared to maximal x and y (H. P. Chu and J. T. Lee, unpublished observations).

Fluorescence in Situ Hybridization (FISH)

RNA/DNA FISH was performed on ES cells as previously described (Lee and Lu, 1999) using double-stranded Xist or Chr. 2 telomeric (RP24-338B6) DNA probes labeled by nick-translation (Roche). Digital images were taken with a Nikon Eclipse 90i microscope (Nikon Instruments, Inc.) and processed using Volocity software (Improvision). Cells were counted and scored for the presence or absence of an Xist RNA cloud or checked for ploidy.

Example 1. The CTCF-RNA Interactome

We endeavored to define the CTCF-RNA interactome in mouse embryonic stem cell (mESC) and examine its relationship to genomic CTCF-binding sites. To investigate the CTCF-RNA interactome, we performed UV-crosslinking and immunoprecipitation followed by deep sequencing (CLIP-seq) in order to identify directly interacting transcripts (Ule et al., 2005). We modified the CLIP-seq protocol to optimize detection within nuclear CTCF preparations (FIG. 1A; see Methods above), and performed this modified CLIP protocol in a female mESC line expressing inducible FLAG-tagged CTCF at physiological levels. Although expression of FLAG-tagged CTCF was robust after induction, total CTCF expression was nearly equal before and after induction at both the mRNA and protein levels (FIG. 8A,B), suggesting that CTCF levels are under feedback regulation. CLIP was carried out on day 0 (d0) and day 3 (d3) of cell differentiation, with minus-UV controls in parallel. Resolution of the radiolabelled CLIP materials by SDS-PAGE revealed an enrichment above background, with Western blotting indicating CTCF-RNA complexes running slightly higher than the 70-86-kD CTCF monomer and the 150-170-kD dimeric form, consistent with the presence of crosslinked RNA fragments (FIG. 1B). To minimize degradation of RNA during the isolation procedure, we used sonication instead of limiting RNase digestion to fragment RNA and produce CLIP tags of ~200 nt, as shown by bioanalyzer traces of RNA isolated from CLIP membranes (FIG. 1C, top left panel), with cDNA libraries yielding a range of sizes consistent with the RNA profile (FIG. 1C, bottom left panel). An aliquot of the CLIP nuclear lysate was set aside prior to sonication for total nuclear RNA isolation and RNA-seq library preparation to provide a comparative expression baseline.

Figure 1D:
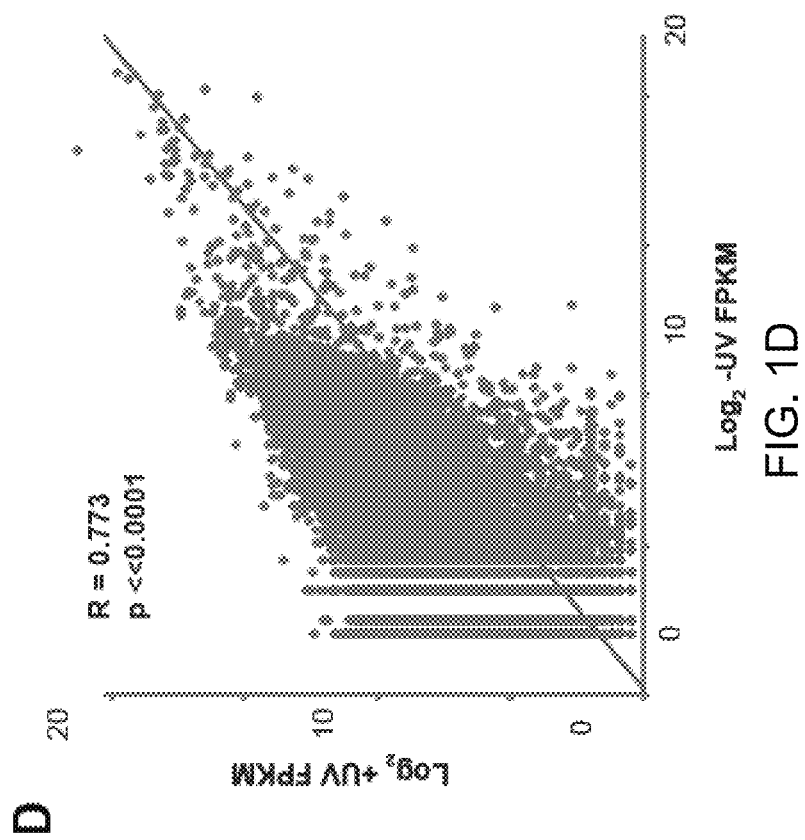
Figure 1E:
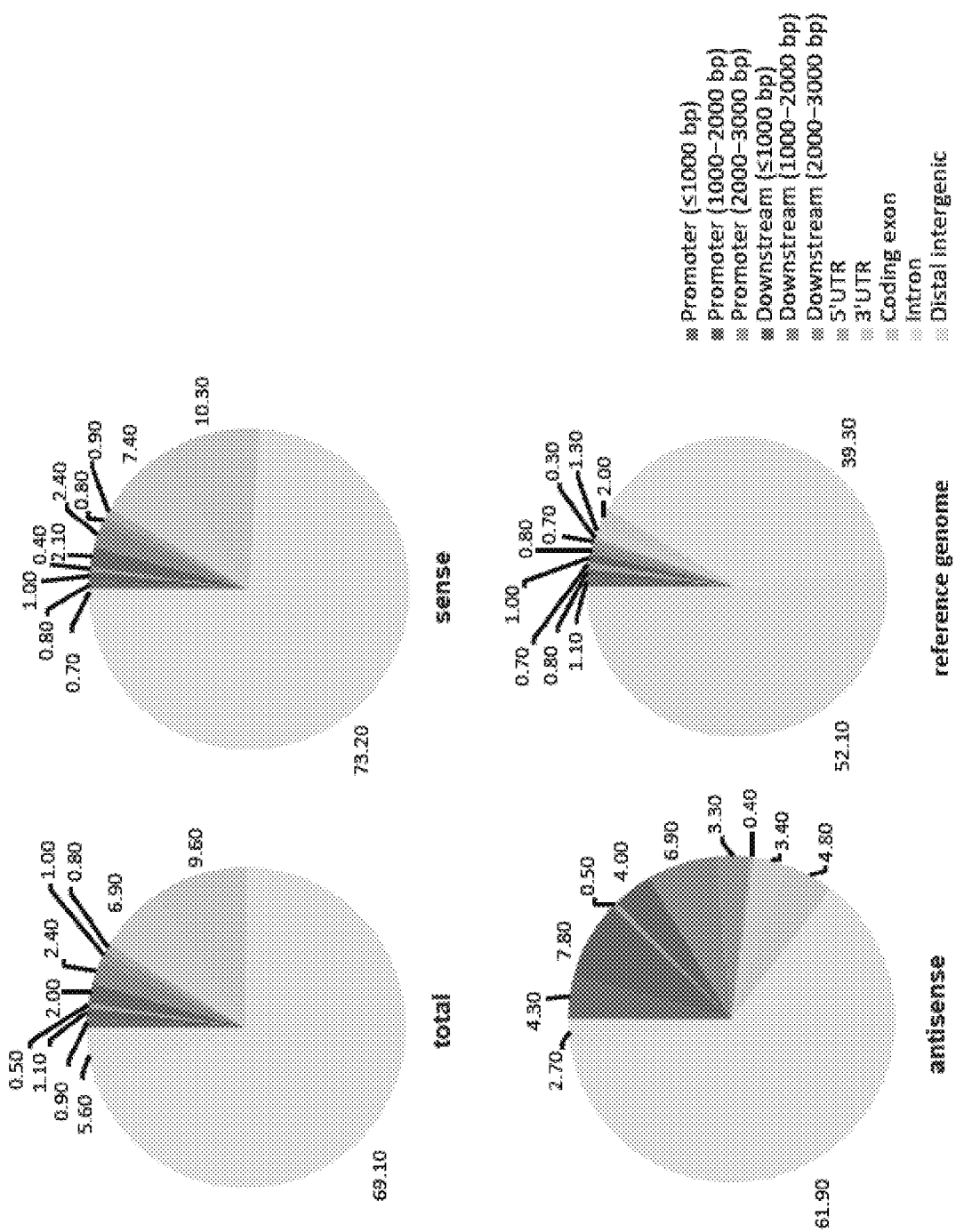

Approximately 200 million reads were obtained for each CLIP-seq (±UV) and RNA-seq libraries from two biological replicates of each sample. After removal of PCR duplicates, 40-50% of reads from the +UV libraries mapped to the mouse genome, resulting in libraries with high complexity; by contrast, only ~6% from control -UV libraries remained after removal of PCR duplicates, resulting in libraries with very low complexity (Table 3). Scatterplot analysis comparing +UV to -UV CLIP-seq reads revealed vast enrichment of RNA signal in the +UV library (FIG. 1D). Approximately a quarter of reads mapped more than once to the genome, of which 5-10% mapped to each of four well-characterized classes of repetitive elements, including LINEs, SINEs, LTRs, and simple repeats (FIG. 9A). Focusing on uniquely-aligned reads, the Piranha peak-caller software identified 100,000-200,000 statistically significant peaks (p<0.01, henceforth designated "peaks") when compared to the -UV CLIP controls. The CLIP peaks represented putative binding domains for the CTCF-RNA interactions. Using the Cis-regulatory Element Annotation System (CEAS), we determined the relative representation of CTCF CLIP peaks within genes and in intergenic space, excluding repetitive sequences. Around 90% of these peaks mapped within 3 kb of RefSeq-annotated gene loci. Thus, in mESC, RNA produced from 15,000 annotated genes are targets of CTCF. This large interactome is consistent with a recent analysis performed in a human osteosarcoma cell line using a different technique (Saldana-Meyer et al., 2014). In mESC, CTCF-interacting RNAs tend to reside within or near genes; in comparison to the reference genome, they appeared to localize preferentially to introns, exons, and 3' untranslated regions (UTR)(FIG. 1D). In addition to the forward strand of annotated genes, CLIP peaks were also identified on the reverse strand (Table 3; FIG. 1E, 9B), suggesting the existence of antisense transcripts that have not been annotated. Antisense RNAs accounted for 2.0-2.5% of peaks, corresponding to 2,000-3,000 loci. The remaining peaks were "intergenic," located outside of annotated genes (Table 3).

We then analyzed metagene profiles to examine the pattern of CTCF binding within the average interacting transcript. Interestingly, on the forward (sense) strand, CTCF binding sites trend towards greater enrichment near the 3' end at transcription termination site (TTS)(FIG. 2A,B, 9C, top panels), consistent with high enrichment within 3' UTRs (FIG. 1E, 9B). On the reverse (antisense) strand of RefSeq transcripts, enrichment was greatest within 1000 bp of the transcription start site (TSS) of the annotated sense gene (FIG. 2A,B, 9, bottom panels), indicating that CTCF preferred to bind the antisense transcript at a position upstream of the associated sense gene. Loci that produced CTCF-binding RNAs were not enriched in any noteworthy gene ontology (GO) terms, consistent with CTCF being a global transcriptional regulator. Analysis of CTCF CLIP peaks with the Multiple Em for Motif Elicitation (MEME) software also did not reveal a consensus motif, implying that CTCF recognizes RNA through secondary and/or tertiary structures, rather than through primary sequence.

Figure 2C:
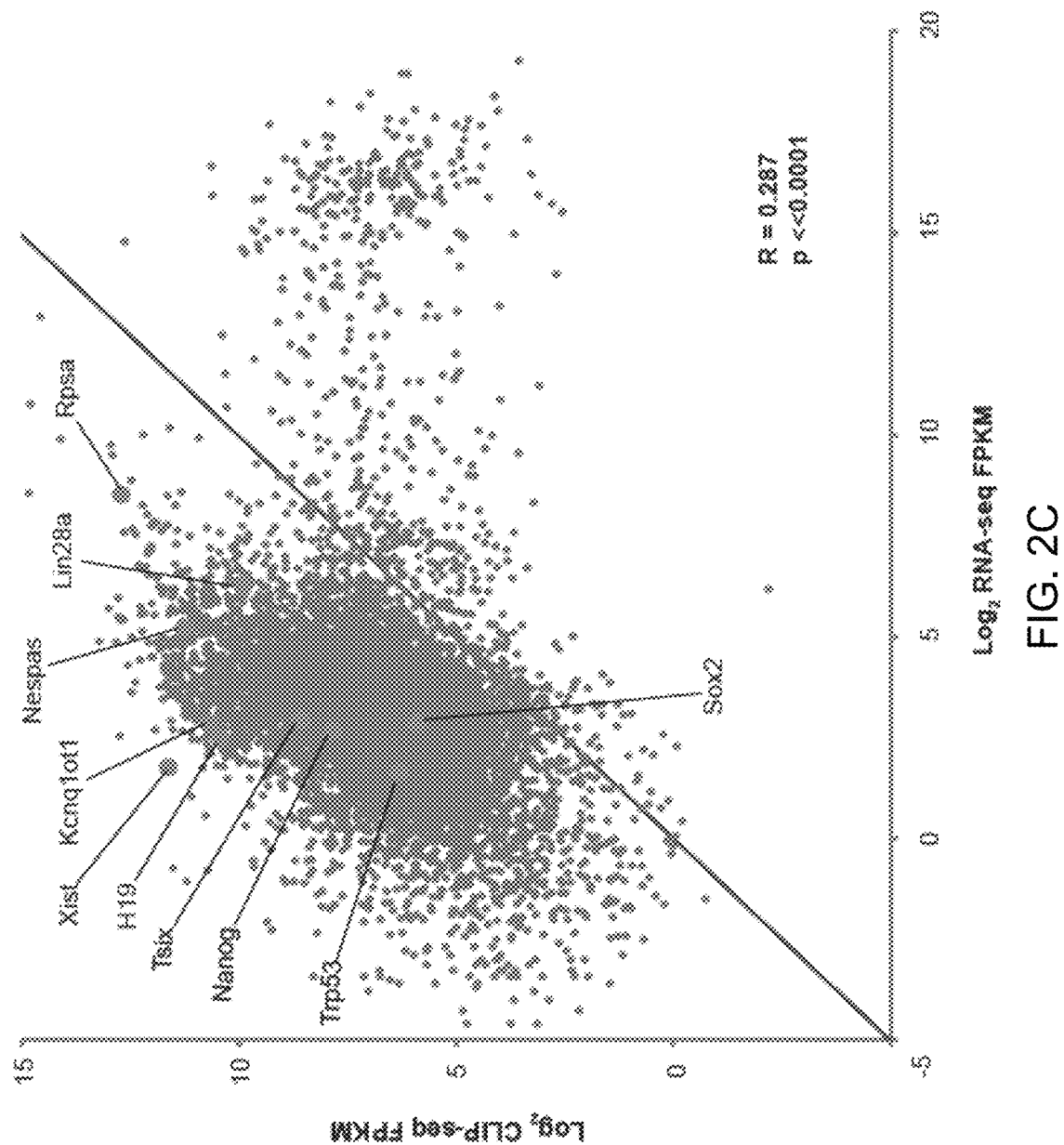

Because the CTCF CLIP peaks were highly enriched within genes, we sought to rule out the possibility of contamination by nuclear background. We therefore compared the CLIP-seq to nuclear RNA-seq profiles (FIG. 2C). If CTCF bound RNA nonspecifically or if our CLIP-seq method merely resulted in isolation of the nuclear RNA background, we would expect a random scatterplot in the case of nonspecific IP, or observe candidate transcripts residing along the diagonal in the case of nuclear RNA contamination. However, neither was the case. Indeed, we found a significant enrichment of hits in the transcripts of Table 3 ($R=0.287$, $p=2.94 \times 10^{-178}$). The proposed RNA interactome lay above the diagonal, inclusive of candidate interacting transcripts such as Tsix, Xist, Nespas, H19 and Kcnq1ot1. This data, together with the analysis comparing +UV to -UV libraries (FIG. 1D), argued against nonspecific interactions and substantial contamination by nuclear RNA. We conclude that CTCF has the capacity to interact directly with a great diversity of RNA in the mESC transcriptome.

The software UCSC Liftover was used to convert the empirically determined mouse mm9 coordinates to human hg19 to produce the sequences in Table 2.

Figure 2D:
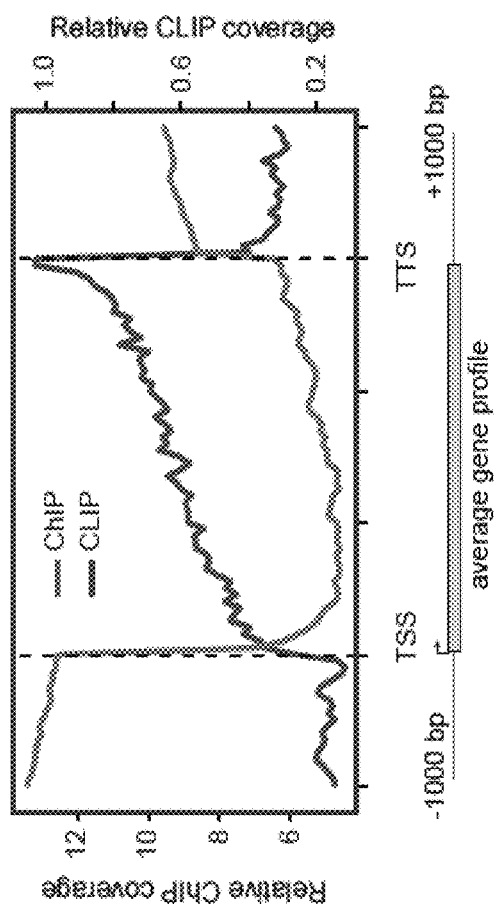
Figure 2E:
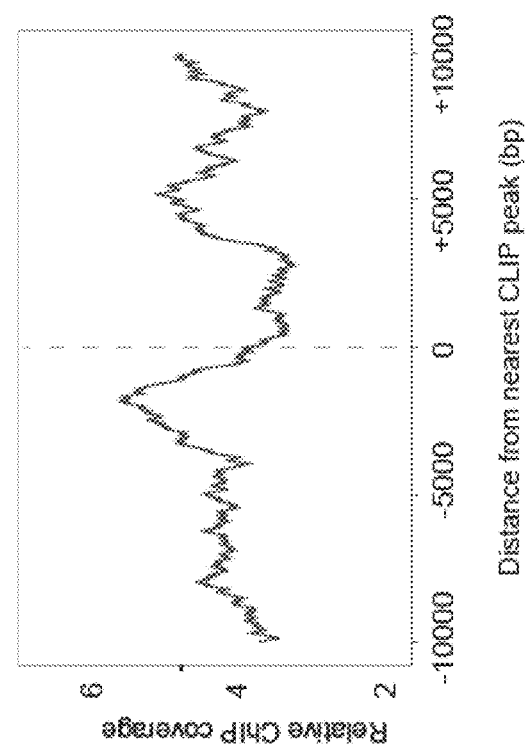

Example 2. Relationship Between the CTCF RNA Interactome and Epigenomic Landscape ChIP-seq analysis of CTCF has been reported in a number of recent publications (Xi et al., 2007; Heintzman et al., 2009; Calabrese et al., 2012). However, allelic profiling of the X-chromosome has not been carried out in female mESC during XCI. To investigate the relationship between the RNA interactome and the genomic CTCF landscape, we performed allele-specific ChIP-seq, with biological replicates, in d0 and d3 female mESCs (Table 4). Allele-specificity was made possible by a genetically marked hybrid female ES cell line carrying a disabled Tsix allele (Tsix$^{TST}$/+)(Ogawa et al., 2008), ensuring that the Xi (inactive X) will be the Mus musculus X-chromosome (mus) and Xa (active X) will be the Mus castaneus X (cas). Numerous polymorphisms between mus and cas enabled us to distinguish between CTCF ChIP signals from Xi and Xa (Pinter et al., 2012). Between 60-120 million reads were obtained for each ChIP-seq library, PCR duplicates were removed, and ChIP signals were normalized to input. Using the SPP software, we identified 45,000-48,000 CTCF DNA binding sites in d0 and d3 mESC, of which ~54% mapped within ±3 kb of Refseq annotated genes and the ~46% remaining reads mapped to intergenic space. Within genes, CTCF ChIP peaks could be observed within promoters, exons, introns, and 5' and 3' UTRs. However, metagene analysis indicated a preference for promoter regions (0-3 kb upstream of TSS) and the region immediately downstream of the TTS (0-3 kb downstream of TTS) (FIG. 2D).

located in close proximity to CTCF-interacting transcripts (FIG. 2E,F). Metagene analysis indicated that the CTCF-binding transcripts did not generally overlap the genomic binding sites (FIG. 2E). In fact, whereas CTCF tended to bind RNA sequences within gene bodies, it bound chromatin upstream of genes, preferentially in the promoter region and in regions immediately downstream of the TTS. We also examined the distance to the closest DNA-binding site (ChIP peak) from the typical RNA-binding site (CLIP peak) using a "metasite" analysis, and observed that DNA-binding sites occurred at greatest density around 2-kb upstream of the RNA-binding site, with a second concentration of ChIP sites 4000 bp downstream of the RNA-binding site (FIG. 2F). These data suggest that CTCF binds RNA and DNA at different locations, but the RNA- and DNA-binding sites tend to occur within 1-4 kb of each other.

To illustrate the aforementioned points about CTCF binding patterns, we examine specific genic loci. The locus for the Sox2 pluripotency factor harbors a distinct CTCF-DNA binding site upstream of its TSS and a robust CTCF-RNA interaction domain within the 3' UTR of the Sox2 transcript (FIG. 3A). Notably, the CLIP-seq profile did not resemble the RNA-seq profile; in fact, they were opposite of each other, with CLIP-seq peaks concentrated in the 3' UTR, and RNAseq reads showing highest coverage in the coding region (FIG. 3A). Positive controls further confirmed CLIP-seq specificity. For example, human SRA1 RNA was previously found to associate with a protein complex containing CTCF (Yao et al., 2010). Here, our CLIP-seq analysis demonstrated that the interaction is direct and that mouse Sra1 RNA contacts CTCF via its 3$^{rd}$ exon (FIG. 3B, significant peak in exon 3 [red bar]). Furthermore, binding of CTCF to Jpx RNA was previously shown to require exons 1-3 of Jpx (Sun et al., 2013). Our CLIP-seq analysis not only verified direct CTCF-Jpx interactions but also revealed that contact points occur predominantly within exon 3 (FIG. 3C). As for Sox2 RNA, the CLIP-seq profiles for Jpx and Sra1 were distinct from their RNA-seq profile. In contrast to Sox2, no CTCF-DNA interactions (ChIPseq peaks) were found within either the Jpx or Sra1 locus, consistent with the idea that Jpx and Sra1 RNA act in trans upon targets located at a distance from the site of synthesis (Lanz et al., 1999; Sun et al., 2013).

TABLE 3

Reads and peaks statistics for CTCF CLIP-seq and RNA-seq.

| | | CLIP-seq | | | | | | RNA-seq | |
|---|---|---|---|---|---|---|---|---|---|
| | | d0 rep1 | | d0 rep2 | | d3 | | | |
| | | +UV | −UV | +UV | −UV | +UV | −UV | d0 | d3 |
| reads | total | $2.18 \times 10^8$ | $1.99 \times 10^8$ | $2.19 \times 10^8$ | $2.12 \times 10^8$ | $1.97 \times 10^8$ | $2.28 \times 10^8$ | $2.50 \times 10^8$ | $1.83 \times 10^8$ |
| | with PCR duplicates removed | $2.90 \times 10^7$ | $1.64 \times 10^7$ | $3.35 \times 10^7$ | $1.77 \times 10^7$ | $2.81 \times 10^7$ | $2.20 \times 10^7$ | $4.74 \times 10^7$ | $3.48 \times 10^7$ |
| | uniquely aligned (% total reads; % cleaned-up reads) | $1.15 \times 10^7$ (5.26%; 39.52%) | $1.0 \times 10^6$ (0.53%; 6.43%) | $1.57 \times 10^7$ (7.19%; 47.00%) | $1.17 \times 10^6$ (0.55%; 6.62%) | $1.06 \times 10^7$ (5.40%; 37.81%) | $1.28 \times 10^6$ (0.56%; 5.83%) | $2.94 \times 10^7$ (11.75%; 61.93%) | $2.04 \times 10^7$ (11.16%; 58.70%) |
| peaks | total | 114016 | | 213183 | | 106382 | | | |
| | within annotated genes (+/−3b) | 101876 | | 190387 | | 96857 | | | |
| | no. of loci mapped to antisense to annotated genes | 15301 2716 | | 17107 5094 | | 14928 2137 | | | |
| | no. of loci mapped to intergenic | 2062 (1386 overlap with sense) 9424 | | 3137 (2394 overlap with sense) 17702 | | 2137 (1222 overlap with sense) 7388 | | | |

TABLE 4

Reads and peaks statistics for CTCF ChIP-seq.

| | | ChIP-seq | | | |
|---|---|---|---|---|---|
| | | d 0 | | d 3 | |
| | | input | IP | input | IP |
| reads | total | $1.27 \times 10^8$ | $9.86 \times 10^7$ | $9.40 \times 10^7$ | $6.66 \times 10^7$ |
| | with PCR duplicates removed | $1.01 \times 10^8$ | $6.76 \times 10^7$ | $8.34 \times 10^7$ | $5.66 \times 10^7$ |
| | aligned (% of total reads) | $8.69 \times 10^7$ (68.67%) | $5.79 \times 10^7$ (58.66%) | $7.21 \times 10^7$ (76.73%) | $4.82 \times 10^7$ (72.32%) |
| peaks | total | | 48495 (cas: 2932; mus: 26052) | | 45264 (cas: 2533; mus: 25170) |
| | % within annotated genes (+/− 3 kb) | | 53.3% | | 54.9% |
| | % intergenic | | 46.6% | | 46.1% |

Figure 3D:
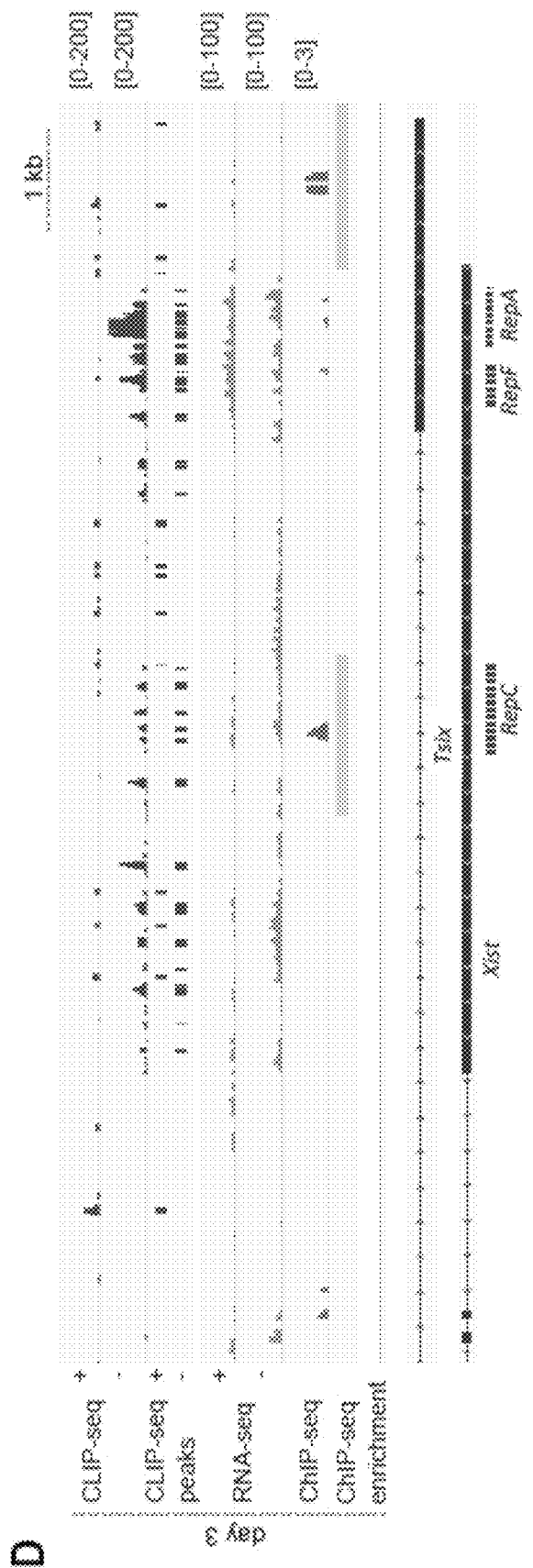
Figure 3E:
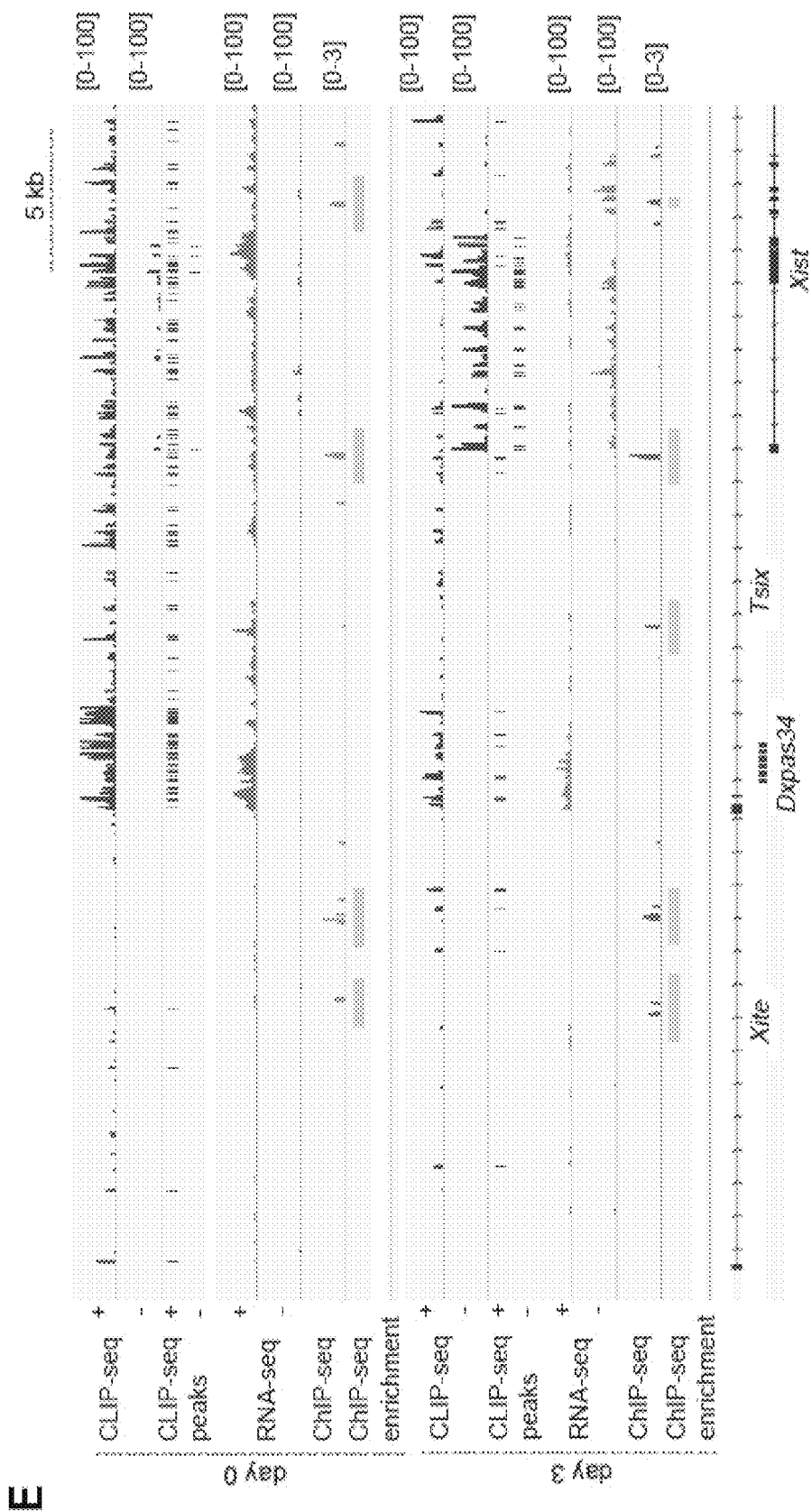

We then investigated the pattern of RNA binding (statistically significant CLIP-seq peaks) relative to DNA binding (statistically significant ChIP-seq peaks). Compared to CTCF-RNA interactions, CTCF-DNA interactions were more likely (46% vs. 5% of peaks) to occur in intergenic space. Interestingly, however, DNA binding sites were often Analysis of the rest of the X-inactivation center revealed multiple sites of interaction within both RNA and DNA (FIG. 3D,E). Within Xist, CTCF-Jpx RNA interactions has been proposed to cause eviction of CTCF repressor from the Xist promoter near Repeat F (RepF)(Sun et al., 2013). Indeed, we observed CTCF-DNA interactions near RepF, but also at ~1 kb upstream of the TSS and within Repeat C (RepC) (FIG. 3D). Meanwhile, CLIP-seq showed highly significant CTCF-RNA interactions within Xist exon 1, with particularly strong interactions at RepA and RepC, where PRC2 and YY1 interact with Xist/RepA transcripts (Zhao et al., 2008; Jeon and Lee, 2011), as well as RepF (FIG. 3D). Within Tsix and Xite, multiple CTCF-binding sites within the DNA had been identified previously by ChIP-qPCR and electromobility shift assays (EMSA)(Chao et al., 2002; Donohoe et al., 2007; Donohoe et al., 2009) and were confirmed here by ChIP-seq (FIG. 3E). Intriguingly, CLIP-seq analysis now identified multiple significant binding peaks with Tsix and Xite RNA (FIG. 3E), the biological significance of which we explored below.

The Xi provides a complex epigenomic landscape harboring both genes that are subject to silencing and those that escape from XCI (Carrel and Willard, 2005; Li and Carrel, 2008; Yang et al., 2010; Berletch et al., 2011; Calabrese et al., 2012; Pinter et al., 2012; Mugford et al., 2014). Allelic-specific ChIP-seq analysis of female mouse trophoblast stem cells (TSC) previously revealed CTCF localization patterns in a cell type with imprinted paternal X-chromosome silencing (Calabrese et al., 2012). Interestingly, in TSCs, the majority of CTCF binding sites on Xi were shared with Xa; furthermore, although a modest positive correlation was observed for CTCF binding and escape from XCI (Calabrese et al., 2012), no specific structural features have been identified (Mugford et al., 2014). Because imprinted XCI is mechanistically distinct from random XCI (Heard and Disteche, 2006; Starmer and Magnuson, 2009; Wutz, 2011; Disteche, 2012; Lee and Bartolomei, 2013), here we investigated the allelic binding patterns on Xi versus Xa in mESC undergoing random XCI.

Polymorphic sequences between mus (Xi) and cas (Xa) enabled us to distinguish between different allelic CTCF ChIP signals (Pinter et al., 2012). Although the majority of CTCF ChIP peaks were allelically balanced (or lacked sequence polymorphisms) (FIG. 4A: see "composite" track, which contains the sum of all ChIP reads at indicated positions), those peaks that did have allelic bias revealed very different binding profiles for Xa versus Xi in mESC undergoing XCI (FIG. 4A,B; violet versus green bars)—this contrasted with the mostly identical profiles reported for Xa and Xi in TSC (Calabrese et al., 2012). Even among genes subject to XCI, the pattern of CTCF binding on Xa and Xi were dramatically different (FIG. 4B; green versus violet peaks). Allele-specific binding profiles for escapee genes were also notable. For example, Kdm6a and Mid1 exhibited Xi-specific CTCF peaks (FIG. 4C and data not shown), with an Xi-specific interacting transcript located in close proximity. As was the case throughout the genome (FIG. 2E,F), the DNA binding sites on Xi were frequently located in proximity to CTCF-interacting transcripts in cis (FIG. 4C; 10A-D).

Example 3. CTCF is a High-Affinity and Specific RNA-Binding Protein

The large RNA interactome for CTCF is reminiscent of Polycomb repressive complex 2 (PRC2), for which an interactome of many thousands of transcripts has been reported by RIP-seq (Zhao et al., 2010; WO 2012/065143; WO 2012/087983). Recent work demonstrated that, while PRC2 has high affinity for a variety of transcripts (Davidovich et al., 2013), it binds RNA specifically with a dissociation constant ($K_d$) of ~80 nM for its strongest targets (Cifuentes-Rojas et al., 2014). Given a similarly large RNA interactome for CTCF, we sought to determine the biochemical specificity and binding affinities between RNA and CTCF.

To confirm a direct interaction with candidate RNAs, we first performed in vitro pulldown experiments with purified recombinant FLAG-CTCF and a control FLAG-GFP protein. Candidate RNAs identified in the CLIP-seq data were specifically pulled down from total cellular RNA by the purified FLAG-CTCF, whereas the negative controls, Gt12-as and Ppia, were not pulled down by CTCF significantly (FIG. 5A). Moreover, the negative control pulldowns using FLAG-GFP protein did not result in enrichment of any RNA (FIG. 5A; green bars all at ~0). Next, we performed in vivo UV-crosslinking followed by RNA immunoprecipitation (UV-RIP) in wild-type d3 ESC using either control IgG or αCTCF antibodies against the endogenous CTCF protein. Once again, target RNAs were specifically enriched in αCTCF pulldowns in UV-crosslinked cells, as compared to αCTCF RIPs in non-UV-crosslinked cells and/or in IgG pulldowns in UV-crosslinked cells (FIG. 5B).

We also performed RNA electrophoretic mobility shift assays (EMSA) with recombinant FLAG-CTCF and control FLAG-GFP proteins (FIG. 5C), testing in vitro-transcribed RNA fragments based on binding patterns informed by CLIP-seq (FIG. 3). EMSA showed specific RNA-protein shifts that were abrogated by unlabelled competitors at 40× molar excess, while control FLAG-GFP protein did not shift any of the RNA fragments (FIG. 5D). These experiments showed that, like the positive control Jpx RNA, the test RNAs (Tsix, Xist RepF, and Xite) could all bind CTCF, whereas the negative control Gapdh RNA could not. The imprinted lncRNAs, Nespas and Gt12, were also shifted by CTCF, consistent with CLIP-seq data (FIG. 10A-D). To map specific RNA-protein interaction domains, we focused on the 5' 400-nt region of Tsix (Tsix-d), which was identified as a strong binding site by CLIP-seq (FIG. 3E) and also shifted robustly by CTCF in the EMSA (FIG. 5D). We observed that within fragment d, subfragment c, but not b or a, could bind CTCF (FIG. 5E). To map the RNA-binding domain of CTCF, we carried out EMSA using domain-specific CTCF peptides. Interestingly, the fragment containing the Zn-finger region—a known nucleic-acids interaction domain—did not bind RNA; rather, the C-terminal region gave a specific RNA shift (FIG. 5F).

Example 4. Tsix RNA Recruits CTCF and Directs X-Chromosome Pairing

The genome-wide association identified here between CTCF-binding DNA and RNA sequences may suggest a functional relationship between the two. At the p53 locus, it has been proposed that binding of CTCF to an overlapping antisense transcript, Wrap53, regulates expression of p53 (Saldana-Meyer et al., 2014). Here we asked if CTCF RNA interactions may have other functions in epigenetic regulation. The association between CTCF and Tsix RNA was of particular interest because previous work strongly hinted that RNA may be required for inter-chromosomal interactions between the two X-inactivation centers (Xu et al., 2007). Random XCI is modeled ex vivo by mESCs undergoing cell differentiation, during which they recapitulate X-chromosome counting, choice, and spreading of silencing by Xist RNA (Starmer and Magnuson, 2009; Wutz, 2011; Disteche, 2012; Lee and Bartolomei, 2013). Xist is in turn controlled by the antisense Tsix locus and by Xite, a Tsix enhancer located between the major and minor promoters of Tsix and that produces short eRNAs (enhancer-associated RNAs)(Lee, 1999; Sado et al., 2001; Ogawa and Lee, 2003; Stavropoulos et al., 2005). Together, Tsix and Xite not only control allelic expression of Xist RNA, but also induce X-chromosome pairing, a transient event restricted to the Xic and observed prior to Xist upregulation between days 2-4 of mESC differentiation (Bacher et al., 2006; Xu et al., 2006; Xu et al., 2007; Masui et al., 2011). Genetic analyses have shown that pairing depends on a 15-kb region encompassing Tsix and Xite (Xu et al., 2006; Xu et al., 2007)(FIG. 6A). Interestingly, X-X pairing is rapidly disrupted by POL-II inhibitors, suggesting that newly synthesized transcripts—potentially Tsix and Xite themselves—may be required for the interchromosomal interactions.

Given a known requirement for Tsix/Xite and CTCF in X-X pairing (Xu et al., 2007) and in light of CTCF interactions with Tsix/Xite RNA (FIG. 3E), we investigated the functional relationship between CTCF-Tsix and CTCF-Xite interactions. First, we performed in vivo UV-RIP analysis to confirm the domains of interaction identified by CLIP-seq (FIG. 3E). Indeed, the regions of Tsix/Xite RNAs interacted specifically and directly with CTCF protein in vivo (FIG. 6B). We then knocked down Tsix RNA in female mESC using various strategies, including transiently transfected siRNAs, stably expressed shRNAs, and locked nucleic acid (LNA) gapmer oligonucleotides (which access nuclear lncRNAs more effectively (Sarma et al., 2010)). Whereas all tested siRNAs and most shRNAs were ineffective (data not shown), one shRNA directed at the Xite enhancer (Ogawa and Lee, 2003) and the overlapping minor Tsix transcript (Sado et al., 2001) achieved ~85% KD (FIG. 6C) and two LNAs directed at the major Tsix transcript, achieved 60-90% KD (FIG. 6D,E). To investigate effects on X-X pairing, we performed DNA fluorescence in situ hybridization (FISH) and measured Tsix inter-allelic distances. Knocking down Tsix (TsixKD) at all three positions reduced the number of X-X pairs between days 2-6 of differentiation (d2-d6) when pairing normally takes place (FIG. 6C-E; 11A-C). By contrast, scrambled shRNA or LNA (ScrKD) did not have any effect. Because the shRNA and LNAs yielded similar results, we henceforth show experiments using cell lines expressing the stably transfected shRNA, as these cells were more amenable to long-term differentiation assays.

We hypothesized that Tsix RNA may function as a locus-specific recruiting tool to recruit CTCF and thereby direct X-X pairing. In TsixKD cells, chromatin immunoprecipitations (ChIPs) of CTCF and OCT4, two transcriptional activators of Tsix/Xite known to regulate X-X pairing (Xu et al., 2006; Xu et al., 2007), showed reduced occupancy of CTCF at binding sites XiteC, XiteA, TsixA, and RS14 and decreased binding of OCT4 to binding sites XiteC, XiteA, and TsixA (FIG. 7A,B). Effects on binding were specific to this region, as CTCF and OCT4 binding to other X-linked regions was not altered (FIG. 12A-B). Other chromatin epitopes (e.g., H3K27me3) were also not affected by the knockdown (FIG. 12A-B). Consistent with disrupted pairing, TsixKD female cells exhibited defective embryoid body (EB) outgrowth (FIG. 7C), in spite of appropriate downregulation of pluripotency factors which indicated initiation of cell differentiation (FIG. 7D). Neither ScrKD female cells nor TsixKD male cells exhibited these anomalies (FIG. 7C). We furthermore observed that Xist induction was compromised, as only 1-2% of cells show full Xist upregulation between d2-d6 (P=0.03, FIG. 7E). Taken together, our functional analysis demonstrates that Tsix RNA is required for pairing and that it acts in this context by recruiting CTCF to the pairing center.

Example 5. Human CTCF Binding Sites

Using the methods and criteria described above, CTCF binding sites and their associated caRNAs were also identified in human HEK 293 kidney cells. Using a HEK 293 cell line expressing a FLAG-tagged CTCF construct (MacPherson, M. J., Beatty, L. G., Zhou, W., Du, M., and Sadowski, P. D. (2009) Mol Cell Biol 29:714-25), CLIP was performed to generate a CTCF-RNA interactome as described above for mESCs. Briefly, UV-crosslinking and immunoprecipitation of RNA followed by high-throughput sequencing was used to identify Ctcf-interacting RNAs. Peaks were called from uniquely mapped reads using the software Piranha. To produce non-overlapping peaks, entries from independent experiments were merged, then each entry was expanded by 500 nucleotides on each end, and then remerged. Human (hg19) data were obtained from 2 biological replicates using HEK293 cells. Approximately 170 million reads were obtained, of which about 4 million mapped uniquely to the human genome, producing about 51,000 statistically-significant peaks, covering about 8500 genes (sense or antisense). The peaks (representing CTCF binding sites), plus 500 nucleotides on either end, are listed in Table 1.

REFERENCES

Ahn, J. Y., and Lee, J. T. (2010). Retinoic acid accelerates downregulation of the Xist repressor, Oct4, and increases the likelihood of Xist activation when Tsix is deficient. BMC Dev Biol 10, 90

Bacher, C. P., Guggiari, M., Brors, B., Augui, S., Clerc, P., Avner, P., Eils, R., and Heard, E. (2006). Transient colocalization of X-inactivation centres accompanies the initiation of X inactivation. Nat Cell Biol 8, 293-299

Bell, A. C., and Felsenfeld, G. (2000). Methylation of a CTCF-dependent boundary controls imprinted expression of the Igf2 gene. Nature 405, 482-485.

Berletch, J. B., Yang, F., Xu, J., Carrel, L., and Disteche, C. M. (2011). Genes that escape from X inactivation. Hum Genet 130, 237-245

Calabrese, J. M., Sun, W., Song, L., Mugford, J. W., Williams, L., Yee, D., Starmer, J., Mieczkowski, P., Crawford, G. E., and Magnuson, T. (2012). Site-specific silencing of regulatory elements as a mechanism of X inactivation. Cell 151, 951-963

Carrel, L., and Willard, H. F. (2005). X-inactivation profile reveals extensive variability in X-linked gene expression in females. Nature 434, 400-404

Chao, W., Huynh, K. D., Spence, R. J., Davidow, L. S., and Lee, J. T. (2002). CTCF, a candidate trans-acting factor for X-inactivation choice. Science 295, 345-347

Chen, H., Tian, Y., Shu, W., Bo, X., and Wang, S. (2012). Comprehensive identification and annotation of cell type-specific and ubiquitous CTCF-binding sites in the human genome. PLoS ONE 7, e41374

Cifuentes-Rojas, C., Hernandez, A., Sarma, K., and Lee, J. T. (2014). Regulatory interactions between RNA and Polycomb repressive complex 2. Molecular Cell ePub May 29, 2014

Davidovich, C., Zheng, L., Goodrich, K. J., and Cech, T. R. (2013). Promiscuous RNA binding by Polycomb repressive complex 2. Nature structural & molecular biology 20, 1250-1257

DeMare, L. E., Leng, J., Cotney, J., Reilly, S. K., Yin, J., Sarro, R., and Noonan, J. P. (2013). The genomic landscape of cohesin-associated chromatin interactions. Genome Res 23, 1224-1234

Disteche, C. M. (2012). Dosage compensation of the sex chromosomes. Annual review of genetics 46, 537-560

Dixon, J. R., Selvaraj, S., Yue, F., Kim, A., Li, Y., Shen, Y., Hu, M., Liu, J. S., and Ren, B. (2012). Topological domains in mammalian genomes identified by analysis of chromatin interactions. Nature 485, 376-380

Donohoe, M. E., Silva, S. S., Pinter, S. F., Xu, N., and Lee, J. T. (2009). The pluripotency factor Oct4 interacts with Ctcf and also controls X-chromosome pairing and counting. Nature 460, 128-132

Donohoe, M. E., Zhang, L. F., Xu, N., Shi, Y., and Lee, J. T. (2007). Identification of a Ctcf cofactor, Yy1, for the X chromosome binary switch. Mol Cell 25, 43-56

Filippova, G. (2008). Genetics and epigenetics of the multifunctional protein CTCF. Curr Top Dev Biol 80, 337-360

Filippova, G. N., Cheng, M. K., Moore, J. M., Truong, J.-P., Hu, Y. J., Nguyen, D. K., Tsuchiya, K. D., and Disteche, C. M. (2005). Boundaries between Chromosomal domains of X inactivation and escape bind CTCF and lack CpG methylation during early development. Dev Cell 8, 31-42

Handoko, L., Xu, H., Li, G., Ngan, C. Y., Chew, E., Schnapp, M., Lee, C. W., Ye, C., Ping, J. L., Mulawadi, F., et al. (2011). CTCF-mediated functional chromatin interactome in pluripotent cells. Nat Genet 43, 630-638

Hark, A. T., Schoenherr, C. J., Katz, D. J., Ingram, R. S., Levorse, J. M., and Tilghman, S. M. (2000). CTCF mediates methylation-sensitive enhancer-blocking activity at the H19/Igf2 locus. Nature 405, 486-489

Heard, E., and Disteche, C. M. (2006). Dosage compensation in mammals: fine-tuning the expression of the X chromosome. Genes Dev 20, 1848-1867

Heintzman, N. D., Hon, G. C., Hawkins, R. D., Kheradpour, P., Stark, A., Harp, L. F., Ye, Z., Lee, L. K., Stuart, R. K., Ching, C. W., et al. (2009). Histone modifications at human enhancers reflect global cell-type-specific gene expression. Nature 459, 108-112

Jensen, K. B., and R. B., D. (2008). CLIP: crosslinking and immunoprecipitation of in vivo RNA targets of RNA-binding proteins. Methods Mol Biol 488, 85-98

Jeon, Y., and Lee, J. T. (2011). YY1 Tethers Xist RNA to the Inactive X Nucleation Center. Cell 146, 119-133

Kanduri, C., Fitzpatrick, G., Mukhopadhyay, R., Kanduri, M., Lobanenkov, V., Higgins, M., and Ohlsson, R. (2002). A differentially methylated imprinting control region within the Kcnql locus harbors a methylation-sensitive chromatin insulator. J Biol Chem 277, 18106-18110.

Kharchenko, P. V., Tolstorukov, M. Y., and Park, P. J. (2008). Design and analysis of ChIP-seq experiments for DNA-binding proteins. Nat Biotech 26, 1351-1359

Kim, D., Pertea, G., Trapnell, C., Pimentel, H., Kelley, R., and Salzberg, S. L. (2013). TopHat2: accurate alignment of transcriptomes in the presence of insertions, deletions and gene fusions. Genome Biol 14, R36

Kim, T. H., Abdullaev, Z. K., Smith, A. D., Ching, K. A., Loukinov, D. I., Green, R. D., Zhang, M. Q., Lobanenkov, V. V., and Ren, B. (2007). Analysis of the vertebrate insulator protein CTCF-binding sites in the human genome. Cell 128, 1231-1245

Kung, J. T., Colognori, D., and Lee, J. T. (2013). Long noncoding RNAs: Past, present, and future. Genetics 193, 651-669

Lai, F., Orom, U. A., Cesaroni, M., Beringer, M., Taatjes, D. J., Blobel, G. A., and Shiekhattar, R. (2013a). Activating RNAs associate with Mediator to enhance chromatin architecture and transcription. Nature 494, 497-501

Lai, F., Ørom, U. A., Cesaroni, M., Beringer, M., Taatjes, D. J., Blobel, G. A., and Shiekhattar, R. (2013b). Activating RNAs associate with Mediator to enhance chromatin architecture and transcription. Nature 494, 497-501

Lanz, R. B., McKenna, N. J., Onate, S. A., Albrecht, U., Wong, J., Tsai, S. Y., Tsai, M. J., and O'Malley, B. W. (1999). A steroid receptor coactivator, SRA, functions as an RNA and is present in an SRC-1 complex. Cell 97, 17-27

Lee, J. T., and Bartolomei, M. S. (2013). X-Inactivation, Imprinting, and Long Noncoding RNAs in Health and Disease. Cell 152, 1308-1323

Lee, J. T., Davidow, L. S., and Warshawsky, D. (1999). Tsix, a gene antisense to Xist at the X-inactivation centre. Nat Genet 21, 400-404

Lee, J. T., and Lu, N. (1999). Targeted mutagenesis of Tsix leads to nonrandom X inactivation. Cell 99, 47-57

Li, H., Handsaker, B., Wysoker, A., Fennell, T., Ruan, J., Homer, N., Marth, G., Abecasis, G., Durbin, R., and 1000 Genome Project Data Processing Subgroup (2009). The Sequence Alignment/Map format and SAMtools. Bioinformatics 25, 2078-2079

Li, N., and Carrel, L. (2008). Escape from X chromosome inactivation is an intrinsic property of the Jaridlc locus. Proc Natl Acad Sci USA 105, 17055-17060

Li, T., Hu, J. F., Qiu, X., Ling, J., Chen, H., Wang, S., Hou, A., Vu, T. H., and Hoffman, A. R. (2008). CTCF regulates allelic expression of Igf2 by orchestrating a promoter-polycomb repressive complex 2 intrachromosomal loop. Mol Cell Biol 28, 6473-6482

Li, W., Notani, D., Ma, Q., Tanasa, B., Nunez, E., Chen, A. Y., Merkurjev, D., Zhang, J., Ohgi, K., Song, X., et al. (2013). Functional roles of enhancer RNAs for oestrogen-dependent transcriptional activation. Nature 498, 516-520

Licatalosi, D. D., Mele, A., Fak, J. J., Ule, J., Kayikci, M., Chi, S. W., Clark, T. A., Schweitzer, A. C., Blume, J. E., Wang, X., et al. (2008). HITS-CLIP yields genome-wide insights into brain alternative RNA processing. Nature 456, 464-469

Ling, J. Q., Li, T., Hu, J. F., Vu, T. H., Chen, H. L., Qiu, X. W., Cherry, A. M., and Hoffman, A. R. (2006). CTCF mediates interchromosomal colocalization between Igf2/H19 and Wsb1/Nf1. Science 312, 269-272

Lobanenkov, V. V., Nicolas, R. H., Adler, V. V., Paterson, H., Klenova, E. M., Polotskaja, A. V., and Goodwin, G. H. (1990). A novel sequence-specific DNA binding protein which interacts with three regularly spaced direct repeats of the CCCTC-motif in the 5' flaking sequence of the chicken c-myc gene. Oncogene 5, 1743-1753

Martin, M. (2011). Cutadapt removes adapter sequences from high-throughput sequencing reads. EMBnet J 17, 10-12

Masui, O., Bonnet, I., Le Baccon, P., Brito, I., Pollex, T., Murphy, N., Hupe, P., Barillot, E., Belmont, A. S., and Heard, E. (2011). Live-cell chromosome dynamics and outcome of X chromosome pairing events during ES cell differentiation. Cell 145, 447-458

Mugford, J. W., Starmer, J., Williams, R. L., Jr., Calabrese, J. M., Mieczkowski, P., Yee, D., and Magnuson, T. (2014). Evidence for Local Regulatory Control of Escape from Imprinted X Chromosome Inactivation. Genetics Nakahashi, H., Kwon, Resch, W., Vian, L., Dose, M., Stavreva, D., Hakim, O., Pruett, N., Nelson, S., Yamane, A., et al. (2013). A genome-wide map of CTCF multivalency redefines the CTCF code. Cell Rep 3, 1678-1689

Navarro, P., Oldfield, A., Legoupi, J., Festuccia, N., Dubois, A., Attia, M., Schoorlemmer, J., Rougeulle, C., Chambers, I., and Avner, P. (2010). Molecular coupling of Tsix regulation and pluripotency. Nature 468, 457-460

Nora, E. P., Lajoie, B. R., Schulz, E. G., Giorgetti, L., Okamoto, I., Servant, N., Piolot, T., van Berkum, N. L., Meisig, J., Sedat, J., et al. (2012). Spatial partitioning of the regulatory landscape of the X-inactivation centre. Nature 485, 381-385

Ogawa, Y., and Lee, J. T. (2003). Xite, X-inactivation intergenic transcription elements that regulate the probability of choice. Mol Cell 11, 731-743

Ogawa, Y., Sun, B. K., and Lee, J. T. (2008). Intersection of the RNA interference and X-inactivation pathways. Science 320, 1336-1341

Ohlsson, R., Lobanenkov, V., and Klenova, E. (2010). Does CTCF mediate between nuclear organization and gene expression? BioEssays: news and reviews in molecular, cellular and developmental biology 32, 37-50

Ohlsson, R., Renkawitz, R., and Lobanenkov, V. V. (2001). CTCF is a uniquely versatile transcription regulator linked to epigenetics and disease. Trends Genet 7, 520-527

Ong, C.-T., and Corces, V. G. (2014). CTCF: an architectural protein bridging genome topology and function. Nat Rev Genet 15, 234-246

Palstra, R. J., Tolhuis, B., Splinter, E., Nijmeijer, R., Grosveld, F., and de Laat, W. (2003). The β-globin nuclear compartment in development and erythroid differentiation. Nat Genet 35, 190-194

Phillips-Cremins, J. E., Sauria, M. E., Sanyal, A., Gerasimova, T. I., Lajoie, B. R., Bell, J. S., Ong, C. T., Hookway, T. A., Guo, C., Sun, Y., et al. (2013). Architectural protein subclasses shape 3D organization of genomes during lineage commitment. Cell 153, 1281-1295

Pinter, S. F., Sadreyev, R. I., Yildirim, E., Jeon, Y., Ohsumi, T. K., Borowsky, M., and T., L. J. (2012). Spreading of X chromosome inactivation via a hierarchy of defined Polycomb stations. Genome Res 22, 1864-1876

Quinlan, A. R., and Hall, I. M. (2010). BEDTools: a flexible suite of utilities for comparing genomic features. Bioinformatics 26, 841-842

Sado, T., Wang, Z., Sasaki, H., and Li, E. (2001). Regulation of imprinted X-chromosome inactivation in mice by Tsix. Development 128, 1275-1286

Saldana-Meyer, R., Gonzalez-Buendia, E., Guerrero, G., Narendra, V., Bonasio, R., Recillas-Targa, F., and Reinberg, D. (2014). CTCF regulates the human p53 gene through direct interaction with its natural antisense transcript, Wrap53. Genes Dev 28, 723-734

Sanyal, A., Lajoie, B. R., Jain, G., and Dekker, J. (2012). The long-range interaction landscape of gene promoters. Nature 489, 109-113

Sarma, K., Levasseur, P., Aristarkhov, A., and Lee, J. T. (2010). Locked nucleic acids reveal sequence requirements and kinetics of Xist RNA localization to the X chromosome. Proc Natl Acad Sci USA 107, 22196-22201

Shen, Y., Yue, F., McCleary, D. F., Ye, Z., Edsall, L., Kuan, S., Wagner, U., Dixon, J., Lee, L., Lobanenkov, V. V., et al. (2012). A map of the cis-regulatory sequences in the mouse genome. Nature 488, 116-120

Shin, H., Liu, T., Manrai, A. K., and Liu, X. S. (2009). CEAS: cis-regulatory element annotation system. Bioinformatics 19, 2605-2606

Spencer, R. J., B. C., d. R., Pinter, S. F., Lessing, D., Sadreyev, R. I., and Lee, J. T. (2011). A boundary element between Tsix and Xist binds the chromatin insulator Ctcf and contributes to initiation of X-chromosome inactivation. Genetics 189, 441-454

Splinter, E., Heath, H., Kooren, J., Palstra, R. J., Klous, P., Grosveld, F., Galjart, N., and de Laat, W. (2006). CTCF mediates long-range chromatin looping and local histone modification in the beta-globin locus. Genes Dev 20, 2349-2354

Starmer, J., and Magnuson, T. (2009). A new model for random X chromosome inactivation. Development 136, 1-10

Stavropoulos, N., Rowntree, R. K., and Lee, J. T. (2005). Identification of developmentally specific enhancers for Tsix in the regulation of X chromosome inactivation. Mol Cell Biol 25, 2757-2769

Sun, S., del Rosario, B. C., Szanto, A., Ogawa, Y., Jeon, Y., and Lee, J. T. (2013). Jpx RNA activates Xist by evicting CTCF. Cell 153, 1537-1551

Takahashi, K., Saitoh, S., and Yanagida, M. (2000). Application of the chromatin immunoprecipitation method to identify in vivo protein-DNA associations in fission yeast. Sci STKE 2000, pl1

Trapnell, C., Roberts, A., Goff, L., Pertea, G., Kim, D., Kelley, D. R., Pimentel, H., Salzberg, S. L., Rinn, J. L., and Pachter, L. (2012). Differential gene and transcript expression analysis of RNA-seq experiments with TopHat and Cufflinks. Nat Protocols 7, 562-578

Tsai, C. L., Rowntree, R. K., Cohen, D. E., and Lee, J. T. (2008). Higher order chromatin structure at the X-inactivation center via looping DNA. Dev Biol 319, 416-425

Ule, J., Jensen, K., Mele, A., and Darnell, R. B. (2005). CLIP: a method for identifying protein-RNA interaction sites in living cells. Methods 37, 376-386

Ule, J., Jensen, K. B., Ruggiu, M., Mele, A., Ule, A., and Darnell, R. B. (2003). CLIP identifies Nova-regulated RNA networks in the brain. Science 302, 1212-1215

Uren, P. J., Bahrami-Samani, E., Burns, S. C., Qiao, M., Karginov, F. V., Hodges, E., Hannon, G. J., Sanford, J. R., Penalva, L. O. F., and Smith, A. D. (2012). Site identification in high-throughput RNA-protein interaction data. Bioinformatics 28, 3013-3020

Wan, L. B., and Bartolomei, M. S. (2008). Regulation of imprinting in clusters: Noncoding RNAs versus insulators. Adv Genet 61, 207-223

Wutz, A. (2011). Gene silencing in X-chromosome inactivation: advances in understanding facultative heterochromatin formation. Nat Rev Genet 12, 542-553

Xi, H., Shulha, H. P., Lin, J. M., Vales, T. R., Fu, Y., Bodine, D. M., McKay, R. D., Chenoweth, J. G., Tesar, P. J., Furey, T. S., et al. (2007). Identification and characterization of cell type-specific and ubiquitous chromatin regulatory structures in the human genome. PLoS genetics 3, e136

Xu, N., Donohoe, M. E., Silva, S. S., and Lee, J. T. (2007). Evidence that homologous X-chromosome pairing requires transcription and Ctcf protein. Nat Genet 39, 1390-1396

Xu, N., Tsai, C. L., and Lee, J. T. (2006). Transient homologous chromosome pairing marks the onset of X inactivation. Science 311, 1149-1152

Yang, F., Babak, T., Shendure, J., and Disteche, C. M. (2010). Global survey of escape from X inactivation by RNA-sequencing in mouse. Genome Res 20, 614-622

Yao, H., Brick, K., Evrard, Y., Xiao, T., Camerini-Otero, R. D., and Felsenfeld, G. (2010). Mediation of CTCF transcriptional insulation by DEAD-box RNA-binding protein p68 and steroid receptor RNA activator SRA. Genes Dev 24, 2543-2555

Yeo, G. W., Coufal, N. G., Liang, T. Y., Peng, G. E., Fu, X. D., and Gage, F. H. (2009). An RNA code for the FOX2 splicing regulator revealed by mapping RNA-protein interactions in stem cells. Nat Struct Mol Biol 16, 130-137

Zhang, H., Niu, B., Hu, J. F., Ge, S., Wang, H., Li, T., Ling, J., Steelman, B. N., Qian, G., and A. R., H. (2011). Interruption of intrachromosomal looping by CCCTC binding factor decoy proteins abrogates genomic imprinting of human insulin-like growth factor II. J Cell Biol 193, 475-487

Zhao, J., Ohsumi, T. K., Kung, J. T., Y., O., D. J., G., Sarma, K., Song, J. J., Kingston, R. E., Borowsky, M., and Lee, J. T. (2010). Genome-wide identification of polycomb-associated RNAs by RIP-seq. Mol Cell 40, 939-953

Zhao, J., Sun, B. K., Erwin, J. A., Song, J. J., and Lee, J. T. (2008). Polycomb proteins targeted by a short repeat RNA to the mouse X chromosome. Science 322, 750-756

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

Lengthy table referenced here

US11001841-20210511-T00001

Please refer to the end of the specification for access instructions.

Lengthy table referenced here

US11001841-20210511-T00002

Please refer to the end of the specification for access instructions.

Lengthy table referenced here

US11001841-20210511-T00003

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US11001841B2). An electronic copy of the table will also be available from the USPTO upon request and payment of the fee set forth in 37 CFR 1.19(b)(3).

SEQUENCE LISTING (139751 sequences)

SEQ ID NO: 1 - DNA, 1044 bp, Homo sapiens
cgccgaccgttgactattctctacaaaccacaaagacattggaacactatacctattattcggcgcatgagctggagtcctaggcacagctctaagcctccttattcgagccgaactgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttacccccctctctcctactcctgcttgcatctgctatagtggaggccggcgcaggaacaggttgaacagtctaccctcccttggcagggaactactcccaccctggagcctccgtagacctaaccatcttctccttacacctagcaggtatctcctctatcttaggagccatcaatttcatcacaacaattattaatataaaaccccctgccataacccaataccaaacgccccttttcgtctgatccgtcctaatcacagcagtcttacttctcctatctctcccagtcctagccgctggcatcactatactactaacagaccgtaacctcaacaccaccttcttcgacccagccggaggaggagaccccattctataccaacacctattctgatttttcggtcaccctgaagtttatattctcatcctaccaggcttcggaataatctcccatattgtaacttactactccgggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggatttatttttcttttcaccg

SEQ ID NO: 2 - DNA, 1005 bp, Homo sapiens
catcgtactacacgacacgtactacgttgtagcccacttccactatgtcctatcaataggagctgtatttgccatcataggaggcttcattcactgatttcccctattctcaggctacaccctagaccaaacctacgccaaaatccatttcgctatcatattcatcggcgtaaatctaactttcttcccacaacactttctcggcctatccggaatgccccgacgttactcggactatcccgatgcatacaccacatgaaatatcctatcatctgtaggctcattcatttctctaacagcagtaatattaataattttcataatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttcaaaaagatattagaaaaaccatttcataactttgtcaaagttaaattataggctaaatcctatatatcttaatggcacatgcagcgcaagtaggtctacaagacgctacttcccctatcatagaagagcttatcatctttcatgatcacgccctcataatcattttccttatctgcttcctagtcctgtacgcccttttcctaacactcacaacaaaactaactaatactaacatctcagacgctcaggaaatagaaaccgtctgaactatcctgcccgccatcatcctagtccttatcgccctcccatccctacgcatcctttacataacagacgaggtcaacgatccctcctttaccatcaaatcaattggccatcaatggtactgaacctacgaatacaccgactacggcggactaatcttcaactcctacatacttcccccattattcctagaaccaggcgacctgcgactccttgacgtt

SEQ ID NO: 3 - DNA, 1026 bp, Homo sapiens
gctttcgctctaagattaaaaatgccctagcccacttcttaccacaaggcacacctacaccccttatccctatactagttattatcgaaaccatcagcctactcattcaaccaatagccctggccgtacgcctaaccgctaacattactgcaggccacctactcatgcacctaattggaagcgccacactagcaatatcaactattaaccttccctctacacttatcatcttcacaattctaattctactgactatcctagaaatcgctgtcgccttaatccaagcctacgtttttacacttctagtaagcctctacctgcacgacaacacataatgacccaccaatcacatgcctatcatatagtaaaacccagcccatggcccctaacaggggccctctcagccctcctaatgacctccggcctagccatgtgatttcacttccactccacaaccctcctcatactaggcctactaaccaacacactaaccatataccaatgatggcgcgatgtaacacgagaaagcacataccaaggccaccacacaccacctgtccagaaaggccttcgatacgggataatcctatttattacctcagaagtttttttcttcgcaggatttttctgagccttttaccactccagcctagctcccaccccccaactagggggacactggcccccaacaggcatcaccccgctaaatcccctagaagtcccactcctaaacacatccgtattactcgcatcaggggtatcaatcacctgagctcaccatagtctaatagaaaacaaccgaaaccaaataattcaagcactgcttattacaattttactgggtctctattttaccctcctacaagcctcagagtacttcgaggttaaaatattagatatttcccctgatacagggctcaatctttttctttttaaagcaatatttctcaaagtacttttcacagaacttaagtttcattaagcacttcactaaaagaaaagtctgtgatctaataaatttggaaa

SEQ ID NO: 4 - DNA, 1096 bp, Homo sapiens
cctccccggtggagacaggggggccgcgcttgtcttagagcctccccttgggtgccttttagctgcttatcctcgagtcctgggtcagggtcttctccctgggaggagtaattcaacgtgggcctggcactgtgccctgtcaccgcttgggggtcaccgtgttctctggcccagctggtgaggtgtgattctgggacgacagcattttggggagctacaggcttgggtgtgagtgacttgtgtctctgggtgctgaaggccagagggtgcaagggcctggacgtcgaagtgtgtcctagggacgcagaggctagccaggggcagagtctttgcagtgtgggcctttggtgtccagggaactggagtcggaggctggttcaaggccccaacccagggtagacagctatggacaccctcactgagggagcaggcaggagagacggggatgctgggagctgccttctgctcagggaggcacctgcaccccctacccagtctccagccccctagttgggcagcaagggttagaggattgatctgaaaaggaagaatgcctgttgggaaggactagtttggagccaattagggccatggctgctgggggtgggggctgcaattcctgacacactcaggaaccccttcttccaggaaagggtaggagaggcagaggtgcaaaatgggcctgagggtcccgggcgtacctccgcttgcctgctttgggcctgaggtaggatgggggaggggatgcccaggggcctgtgagccatgagtgccgtagccagggagctgggcggctgcagacacacctgtgaagacggctggtccctcagacatacagcatgttgggcaggggaaggggacacagccgcacctcacccatgtgcccacctgacacacaatccgacatggacctgcacgcacaggcaggcagctcacagagttcccaggcaggtgtgcagacagccggcagccccctgtctgctgtcacagacctacccggggcaagaggcccagttccctcctttcaagcagctggtgctggagagggctcctctgggcagcccgctgcctagccttgggtctctgtttggatttg

SEQ ID NO: 5 - DNA, 1050 bp, Homo sapiens
tcctgaggctggggtcaggggcctccagagcaacatggaccttctgcttcccttcctgcagagtccacacccactgggacgtgaacatctctttccgagaggcgtcctgcaggtaggagccgtgctgtgcgtgcataagagggggccgtgactcccctccctccctcccacccctgaccgtgccctgctgtctgctgtccgctgtctcagcgtgagctgatgctgtgatgctggctgagtgtctgccaggtttgacatgtgctgcaaggttgtcccccatcccgggaggcagacagtgttgcacccagttgggactgagggaccccagacccagtcagatgcagctctcggcagcagctcaggtgtgagttctgggcagcccggccctggagttagagtgcacttcctcccatgtgagactggccatttgagcccaaaaatgaggctgtcacctcccccttcccaccctcctagagacccacaaggaggtgagaatgctgatgtgtgagtggggccctgaagggtgtgtaggagctctaaggcgaggggatgtctgcagagtagaggaacagggaagggcgtgtaggagggacgaggagtgaacctggcagctctggttcagttggatgctgaagagtcatggatgctgggcctgtgggcaccgtcctccaggcgggagccaccgaaagttcttgagcagggcagtgaccaggtgtatgtttggagaaggtccctctggaggccttcctggcagacaggggattggattcaggctgtggaagcaggacggtagggggtgtgattccaggatgtggaaaggagataaaaatgaagagccccggggaagaggtcaagggagttgggggacccgagttcctggctccagggggaagcgagtggtaagtctgtgaacagagcccagctgtggattctgtcaatggggtcaggtctcaccctgtggcttccagggcagcaaggcaggaaggaggcgtctgccacaaggccagcttcctggggccagagccgtgaaggcccaggggacctgcgtgt

SEQ ID NO: 6 - DNA, 1382 bp, Homo sapiens
ccagcggagccccaggccgtcctcctctgcctcaggaacccggggtggcagatgctcctcgagccattgtttgcaggcgggggcttggcccctctctcctgggcccctgagctggtgggaaaatgggcaagggctaggccgtgtggtcatcaatgaggggcggtggcgggaggcccatgcgtgggcagctggggtcacacctgccaggctctggcctccccctccccctctccttcctgcgcctcctgccccagccctgactgcttctcccagcttccccacctcctgacctgcagcccggccccaccacagagactctcaggggcttcgtcccttgtgcgaagcagggtgcagagggcattctgtggttcgaggaccatgcgctgatgtgcccgggccgggttcctgcttctccactctgggacgtccagggcgtgtttctttacataaaactggcataactggctcactgagtggccaagtgaccagaacaggttttcaggggccgggccaggccaggctgtgtcggaacctcaggagcaaactccaaggcagagaccaggggcggggagggcaggtggcacccagctccccaccaggtgccactgcccagccacagcccctccacccagctattaggccctccctcactttccttctgggcgccaggctcggggctcactgccagcccccaacctctggagtctctgggaaactagttctcctcctgcaggcgtcctggggacaccagaggggggacccctggggagaactccatggcagctgtggctactgccaggccagccctcagcccccaccccatgctgaggccagcagtcctctcctgacacccccgcgtcgattaggatcatggaagggatgagtctcgctgccgattaatcccataaagtacttactcccacccagctgccttcctatgtgcctggggggggcttcctttcccactgggagccggtgggggtgggggagagccgtcatctaggtctcctggaaggtttagagcccagcctgggagtctttggtgctgaaacggatctgcttaggggcagccttggattagcccagctccagccagcccaggtcaggggagccgggagctatttaacgaggtttagggtaggctcctaggtcactgcgcaggactgctccgttacaggtgggcaggggaggcggctgcgttacaggtgggcaggggaggcggctgcgttacaggtgggcaggggaggcggctgcgttacaggtgggcaggggaggcggctgcgttacaggtgggcaggggaggcggctccgttacaggtgggcaggggaggcggctgcgttacaggtgggcaggggaggcggctgcgttacaggtgggcagg

SEQ ID NO: 7 - DNA, 1069 bp, Homo sapiens
tgcgttacaggtgggcgggggaggcggctgcgttacaggtgggcggggggggcggctgcgttacaggtgggcgggggaggctgctccgttacaggtgggcgggggaggctgctccgttacaggtgggcggggggggcggctgcgttacaggtgggcggggggggcggctgcgttacaggtgggcgggggaggcggctgcgttacaggtgggcgggggaggcggctccgttacaggtgggcgggggaggcggctgcgttacaggtgggcgggggaggcggctgcgttacaggtgggcaggggaggcggctgcgttacaggtgggcaggggaggcggctgcgttacaggtgggcgggggaggcggctccgttacaggtgggcgggggaggcggctgcgttacaggtgggcgggggaggcggctgcgttacaggtgggcgggggaggcggctgcgttacaggtgggcggggggggcggctgcgttacaggtgggcgggcggtgctgcaggaggactgctcagggagtggcgcctggaccctgagccccttctctgctgactggggagaggctcacggaaccgggaaggggtggagggccgtgctccacacagttcgtctcattgctctctgggactctgtggatgtgggattgggctgaattagcaagaagaggagaaatgagggaagaaaagagttaaatgcatgttgattccaagcccccgcctgccggggggacagcgggaggttggagcacgcagccctggtgcctggtgcgagctgcacgtgtctgccggtgccgtgtgtgcgtggggcgcgtctcatcagctgcaggactgtggtctgggcctcagtttcctcgtgtgcagaaatcgggggtcaggggatggttcacatgtggcacattctctcctggggcctgtcctgcaggactgcccctgagcagatcggcctcttcccgggcgcccggtgggcccctcgaccccctttgaggcagggagtgagataactgtgattccctgtggagggcgtgaaggcagagccggctggctgctccacatagaccctccctgg

SEQ ID NO: 8 - DNA, 1047 bp, Homo sapiens
tggagtctggggtggacccaggtgagggtgggcagtgggcatgtcagcagcaccccccgaggagagcaagctcctggaccctgtggtctgtgagtcgtctatgcagccagtggacgccgacctgccagacgcctgccccaggagcctggggaggggcagtgagcagaaaggccgggctgggtgcagtgggcacttggccaccaggactccccaggtgctgaagagacgccagctggaggggctgccccttcccccgggtcggccctgaccctgtccaccccacctcaggacgttctccaggggtccctccgggatgcactcggaccccctgcccgctgcactcagcctcccaggccccagccgcccgcctggcaggggagcttggcttttcgggctagaggtgggtgggggcgccgggaaaggaggcaggattcctcacaccaggcaccgtcccccagggcagctcaggcaccaagagcctgaataattcaccaaatgttaataatgtaaaaatcctcctttttaattgctttccctgctctgcctggggccgctctgctggccgcgcgggggaggggcgccggccgccggggagcgcgctgtcaatcaggccgcgccgccgccccccccccccgccccgccgcggagccggccgtaaataaccctgtaactaacccggccgctagcgcgggggcgctgggccccgctgggatcgatgcgggcggccgcgccggctgggctctgcgggctggcacccggcccggggcgggacccacctccgctttcgggtaattaatttataaacagaggcggcggtggagctggcggagcctgcatagtgggggctgcggggactcgggaggcccgggcgggagggagaggccgagagacctgggacgcggcgccttagacgcgggcgctgcgtgcgcattggggcgagtgtggccacgcgggacagtgaccctgcgcagccgggactgggcgacccctgtgctagtgtggcgtgcgtgcgcgggcgctgccttgcctttgtgacaagctttggcc

SEQ ID NO: 9 - DNA, 1339 bp, Homo sapiens
gagaccctgccactgctgacggaggagcacctgctgaccaacatggggctgaagctggggcccgccctcaagatccgggcccaggtgagacgctggggagtgaggtcagggtctccagaccacagctgggcagaaagctctgggtgggtgtgcgacagcccccaccaggccatctctctgcaggtggccaggcgcctgggccgagttttctacgtggccagcttccccgtggctctgccactgcagccaccaaccctgcgggccccggagcgagaactcggcacaggagagcagcccttgtcccccacgacggccacgtccccctatggagggggccacgcccttgccggtcaaacttcacccaagcaggagaatgggaccttggctctacttccaggggcccccgacccttcccagcctctgtgttgaggttgccgggggtaggggtggggccacacaaatctccaggagccaccactcaacacaatggccctgcctcccaccgctttatttctttcggtttcggatgcaaaacaaaaaattttaaaagaaaatgtgacttcaaaggaaaggaacaaattttcaaagacttgggggagtgaaggcagagcctggtgcagatggacgaggtctgcagacggagggcagaggtggtggaaggggccaggggcctgcaggcctccccctggaactgggactggtctcggtctgctgacgtcagggtcagctcccccgcggagctgacttcagcagcccacagctgtggggcttcagcagccacaccagcccagcccagcccagctctcgatacgtttggtctttcatgctgaaaaataaataataaagcctgtcccgtgtctactgcctcccccaactgcacagacgccagcctctaggcctgactgccagggaggtggaaacactggccaccagcccggcagcccctacaggccccccagatgggctgcctcagtcgtcctctgagagctgcagatcctccagctcgtcctccggcccctgggccagctgctgcagctccccaggggccagccccgcctctgcgtctgggtctccatctgcggggagagatggaggctacataaattttgctttatcaggaagaagccagccttagaggttactcatcactaattaatcacggcactaattaatttatccctgttgctggctgccagagaacagagcatttggcctggccttcccagggagggaaaagcctggcccagagccccacgccccccgcccacgtggctctgccctcccgccagatgggctcacagggccacaccctctcaccccaagaccattcaccctccga

SEQ ID NO: 10 - DNA, 1407 bp, Homo sapiens
ctgctgagccgcgagggccacagcgtggcccacaactccaagcggcactaccacgatgccttcgtggccatgagccgcatgcgccagcgcggcctcctgtgcgacatcgtcctgcacgtggctgccaaggagatccgtgcgcacaaagtggtgctggcctcctgcagcccctacttccacgccatgttcacaagcaagtacccgcctgggcggcgctgggggctccgtgggtccctcgggtcagctcgtgtaacccgctgtccccgcagatgagatgagcgagagccgccagacccacgtgacgctgcacgacatcgaccctcaggccttggaccagctggtgcagtttgcctacacggctgagattgtggtgggcgagggcaatgtgcaggtgagggctccctcacccggatcccggtgtcccccgaccctgtgcctccctcacctgcctctcggtgccccgtagactctgctcccagccgccagtctcctgcagctgaatggcgtccgagacgcttgctgcaagtttctactgagtcagctcgacccctccaactgcctgggtatccggggctttgccgatgcgcactcctgcagcgacctgctcaaggccgcccacaggtacgtgctgcagcacttcgtggacgtggccaagaccgaggagtttatgctgctgcccctgaaacaggtaacagctggcgggcccagccctcgccccccaccccaccccaccccagtctttgtctttgactcccgaccccgttttgttcctgacacagccctgcccacaatccttagtgcctgctgtgtgtccccgagacctttctggatctgggccccccaggagcctcgtctgtggctcctgactctgctcggcccctcccagtatgaacactcagcccccacctgctaaccctccctcctaggcatcttcagggctccctgggtccacaggaccctccccagatctcaggtctgaggacccccactcccaggttctggaactggtctctagcgacagcctgaacgtgccttcagaggaggaggtctaccgagccgtcctgagctgggtgaaacacgacgtggacgcccgcaggcagcatgtcccacgggtgaggcgcggccgcggggggctcccacagcatccaggagggcatgcaggtggctgagggcctggtgcaccctgaccttccccgagttcagggactccgtgggggtggtgcccccacctgtctgaagaagaatccatcacacaggtggtacgggcatctggggggttgtctcagccctgacgcccagtgtgcccgagggtcccgcctgaccttggcgttccctgcaccccagctcatgaagtgtgtgcggctgcccttgctgagccgcgacttcctgctgggccacgtggatgcc

SEQ ID NO: 11 - DNA, 1051 bp, Homo sapiens
gacgggttgccaggtgcctacatcagagctcattaaattacacattaaatagatgcacgtgtgtgtgtcaagctcccctaattcaagttgtagaaaatcagactcagagttcttacactcgggggtgttttagcagctgcgcctcaagattctaaattcaaacgcacacggaataaaacatttcggtttatcgccaggcgcggcggctcacacctgccatcccagccctttgggaggccggggtgggtggatcacctgaggtcaggagttggagaccagcctggccaacatggtgaaaccccgtctctactaaaaatacaaagattagctgggtgtggtggtgggcgtctgtaatcccagctactcgggaggctgaggcaggagaatcgcttgaacccgggaggtaaaggttatggtgagccaagatcatgccactgcactctagcctgggcaacaagagcaaactctgtctcaaaaagaaaaagaaaagaaaaaagaaaaagtttattcccagtaaaacacgttcaactctccagatcgtggtgacatttccagcttgatgtggtaacgtgattgtgagcttcaggtatgaccttcagcataaatacgtgtgccatctcctgtgcaattcttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggctcctgtgcaattcttacagacccagcttggctgttctccagtgtctcctttgggagttgtacctgattttattaccagttttcatctgaatccactggggaatggg

SEQ ID NO: 12 - DNA, 1009 bp, Homo sapiens
atctcagctcactgcaacctccacctccagggctcaagcaattctcctgcctcagcctctcgagtagctgggactacaggtgtgagccaccacacccagctaatttttgcatttttagtagagatggggtttcaccatgttggctaggctggtcttgaactcctgacctcaagtgatttgcccgcctcgtcctcccaaagcgctgggatcacaggcgtgagccgccaccccgcctcctctttggttttcagatgctgacaattttggtgacccctgagatttgctgggagacggggaagggccaggattcatattcagaatatgttgatttttcactcttacacttgtttatttaaaaattatttatttatttatttgaatcttatttaaatattttatttatttgtttattactgagtcttagctatccttctcttgttatgtgctgtgtgtaacaacaacaatttgggaacagcctaagtattcagtgatgtgggatgggttttaactaaattaactctgtactgtaacaggctcattcttccatgggaaacatgcagttgttaaaacaacctgcacagatgcgtccaccaacacggatagatgcgtgtttttgttttttgggttttttttttttttttttgagacagggtctcgctctctcacccaggctggagtgcagtgaagcgatctcggctcactgcagcctccgcctcccaggctcaagtgattctcctgcctcagcctcccaagtatctgggattacaggtgcccaccaccacgcccagctaatttttgtatttttagtagagatggggtttcaccatgttggccaggctggtctcaaactgctgacctcaggtgatctacccgcctcggtctctcaaagtgctgggattacaggtgagccactgcgcccggcccatgcccagctaatttttcgcatttttagtagggacggagtttcaccatattggccaggctggtcttgaactcctgacctcaggtg

SEQ ID NO: 13 - DNA, 1052 bp, Homo sapiens
cggcagccccagccccccagatctgaggaaggggctgcttctcccggctttgttctcaggggagtgcgtgagtgcgtgggtccctgtccccgtgagggccgccaggtcggctgtagcctttaccacaggccaccgtcagagcagctgccctcagggccccaggagctgagaaggtggagggtggggcaccctgcactgcccaaacttgatttcgtggttcacaggctgccctgagtgcacagactgtagaagcccgaggaaggggcgtctcagcccagccacagggccaagctggccccttaccccaacgccccatccccctcctccactgcccaagcttgctgggaggtgggccctgagcactgggcaggtggggagaagtgtggaaggcaggcaccccaagccaggtgggcccccttcccaaattcggccttagctgatagggacgttattggagctggggtggctgaagttggttagacctgggggaggggatgtgttcacaggtgacgcatctctgagcgttcccgcatgggctgtggtggccagtgtgggcttcccccagcttccgcccagcgggctgactcagaggtctccccacatctctgcccagggcttgagtctactgtggacatttgccctaaacacctaaagcccccagtctagccccttccccaggagaggactaatgacacctaccgccatgtccaccccaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaaggtgcgtggtggggggctcgtgtgggggcctgtgggggtcagggcagtggccaagggggacaggttgcaggggtc

SEQ ID NO: 14 - DNA, 1050 bp, Homo sapiens
cagcaggggtgggtctccaagtgcttcctttgacagctgctctggatgggacgtggcttggggtgggtgagaacccttggctgagtttggattttcctgcagggtttcattggaacaccaggttccagggccgtagagatgtggaggcctcctgtctgggtgatggggcatggtgctggtccctggctgtggggtggaaaggagtcccaagagagggagctggcaagacaggaccttcccagctaaggtggggttggtgggatttggctggggcccttggaggagcctgaccaggaggtgagacagggcacctggaaggaaggaggcgttggggagagtccagatggaggccatggggttgaggggcccagacacccggctgggggactccaggaaggcagcaggtgtgggcagtgggtcctctggggtggactgaggtgaggcctgggtgtgaccacgcggtggcactggtggctgccggcagctgtcgtctgcagagtgggtgagaccgagtgtggcagatggcttggtccgcggtgctggaggggactggcggagcagaagcgccctggcgccgggtccttgctttcctggagctggggcttggggaatggggtcggtcattgcagggacagaggagagggcagggtaatgggtgcgcaggggtcccttccaaaggctgcgggtggccaggggtgtgcgggggcgctgaggtgcggtcgccgagagattctggcctccagggtggtcgggcctggcatggactctaggggatggtgcacacaccggaccggacgggcccctcccttacccccggatcccccggctgggcagcggccagggagaggggcgacctacgggggcgggtgtggggacgccggactacgcgtcaggagtcccagatgggcccagacccccattccccgccccgggccgcagtgacgtcagggcccggacgttcccggaacggcctcttgggggcgttccagccccacggacccgcagggagtccccgccgcaatttgcatggggctcatttgcatgaccccg

SEQ ID NO: 15 - DNA, 1021 bp, Homo sapiens
tatcaccgcagcccggggcgtgggcctggctggctgccccagtgagtacctgagctcagccccgaccccgggcctggtgcggctgtgcggccacgtgaccttgtcctgccctggcctttcaggtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacacgtgagtgacagggcccaggactggccaccggctatgccctcctacctgttcacccccatcactgtgcttctcctcacctgcccaggccctggcctgacccacacctggctgggggctgggcagagccagggttggggaccaggctctggaggaggtggggaagcccgtccaggtgcggacatcacgttcctccccgattttccccaaagcctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctggtgagtgagggccagcgctaccctggggcttcatggggtggggtggggtcacccgagccacagaggtttcccatgcccgtgccccagacgcttctgcgcctgcgacctgtgcggagatgcgctgtgagttcggtgcgcggtgcgtggaggagtctggctcagcccactgtgtctgcccgatgctcacctgtccagaggccaacgctaccaaggtgaggggtgtgggatgtgaaggggagtggggaggaggcctcgccttgaacatccttgttctctgccccaggtctgtgggtcagatggagtcacatacggcaacgagtgtcagctgaagaccatcgcctgccgccagggcctgcaaatctctatccagagcctgggccc

SEQ ID NO: 16 - DNA, 1718 bp, Homo sapiens
ggacatgtagatatgcgtgtgtgactatgcggccgtgtgtgtgcatggctccatgtatgtgtgtgtatatgagggagacatgcaggtatgtgtccgtgtgtgtgtgtgtgcatatgggtccatgtatgtgtgtgtatatgagggagacacgcaggtgtgtgtctgagtgtgtgcgcacatgggtccatgtatgtgtgtgtataggtgagggagacatgcatgtgtgtgtccgtgtgtgtgcatgggtccatgtgtgtatagtgtgtacacatgggtccatgtatgtgtgtgtatatgagggagacacgcaggtgtgtgtccgagtgtgtgtgcatgggtccatgtgtgtatagtgtgtgcacatgggtccatgtatgtgtgtgtatatgagggagacacgcaggtgtgtgtccgagtgtgtgtccatgggtccatgtatgtgtgtgtatatgtgggggagacaggtgtgtgtccgagtgtgtgcatgggtccgtgtatatgcgtgtatatatggggggatatgtagatgtgtgtgtgtatgaacaggtgtaagtggggagcactcaggtgtgtctgtgtgtgttcgtgtacacgtgtgtatgtgtgtgaacatggaggggtgtgtgtgtccgtgtgtaggtttgcgtgcatgcacacatgcatgtgtgtactggggcatccaagcccctggtctccactccataccaccctacgcctacctccttgatctctgcgcccagccttggctgtgctcccctgctgtctgcacgtgggtgtctgcacgtgggtgtctgcatgtgggtgtctgtgccctcaagtgtctcgtgtctgcacgtgggtgtctgcaccctcacgtgtctcgtgtccgcacaagcatgtgtaggtgtccctgctgggctctttggtgggcggccagtgatcctcgaggtcacgcatgtcttctgtgggtgcctgctccttgcaccccacagtgttgagatgggtttgcattggccccgcctgtcccctgctcacccgcctccctctcttcctgcttctaagccccgaaactctggattccggggcccttcacaggtgagcacgtggcagcagtgcctgcagacccctggctggcccatctgtcctcccgcccgtctctctgatctctctctgccaggctgcccctgtctccatccctcttctccctcccactgtcggtgtctgcccaccagccacccctgggtcccgtcacagcccttgtggcctccgcagctggggcccttgtcctcccgcctcccccaccctgtcctgttgccaccttcctagaggccctgacctgccctctgccctccagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacataggtgagtagggaacccagcgtgccgagaatagtggcgagggctgcccagacttgcccagctgggctgtgtccagtcacttgtgaccaggggtcagggaggacacgccttgctgcctgagccgaggtcactgccagtgggaggaggaagggccaagaagatg

SEQ ID NO: 17 - DNA, 1039 bp, Homo sapiens
tcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggaga

SEQ ID NO: 18 - DNA, 1545 bp, Homo sapiens
agcgtggactttgaatacatgacagagaaaagacaaggttcagaatgttggcggccaggcctaaggtggatcccttggggtcaggaattggagaccagcctggccaacatggtgaaaccccgtctctactaaaaatacaaaagtaagccaggtgtggaagtgcgtgcctgtaatcccaactgctcaggaggctgaggcaggagaatcgcttgaacctgggaagtggaggttgcagtgtactgagatcacgccactgcactctagcctgggcaatggggcgggactccatctcggtaaaaacaaacaaaaaaatactgggctgggcacagtggctcacacctttaatcccagcacttggggagaccaaggtgggcagatcatctgaagtcaggagttcaagaccatcctggccgacacggtgaaaccctgtctctactaaaaatacaaaagttagctgggcatggtggtgggtgcttgtaatcccagctactcagtaggctaaggcagaattacttgaacccgggaggcggagattgcagtgagctgagattgtgccattgcactccagcctgggcaacaagagcgagagtgtcaaaaacaaaaattggcaaaaaactagacttcttttaaatttaatttattcatttaaaacttgccgggtgcggtggctcatgcctgtaatcccagcactttgggaggctgaggcgggtggatcacctgaggttgggaattcaagaccagcctgaccaacacggaaaaagcccgtctctactaaaaatacaaaattagccggatgtggtggtgtgcgcctgtaatcccagctactcgggaggctgaggcaggagaactgcttgaacccgggaggcggaggttgcagtaagccgagatcgcgccactgcactccagcctgggcgacagagcgagactgtgtctcaaaaaaaaataaataaataaaattgagagacagggtggggctgtcacccaggctgcagtggcgcaatcatggctcactcaaactcctgggctcaagcgtcctcccgcctccacctccgcctcccaaatagctgggactataggcacgcacccaccacgccaggctaatttaaaaacaaaattttggccaggcgcagtggctcactcttgtaatcccagcactctgggagaccaaggcgggtggatcacctgagatcaggagttcaagaccagcctgaccaacatggtgaaacccccgtctctactaaaaaaaaatacaaaattaactgggtgtggtggcacacgcctgtaatcccagctactcgggaggctgaggcaggagaatcgcttgaacccagaaggcggaggttcaaggtgagctgagatcgcaccactgcactacagcctgggcaatgagagcgaaactccatctcaaaaaaaaaagaaaaaaaaaaagaattcaacagatgaatttaacaccatatgacacataaccagaagagaatccatgaactgaaagacaccagagggaatatccatcaggaaacaggaaagacaaacagatgacggagt

SEQ ID NO: 19 - DNA, 1029 bp, Homo sapiens
cggggccgcgcaggtcccagtggagcacgcgctggcggtcgtgcagccggtcctgggtccacaccatgcgcgggctctggcagcgcagcaccgcccgggcgcccgcctcccagctcaccgcggactcggacaccacggagctgccagcagcggcgggtaccgaggaccctggtgggggaggggagtcggtgggggaaggggtgggccccctagggccctggttgggggagtcagtgggggaggggcagggccctggtgggggagggatgtctgtaagggacgggcaggaccagagggccctggtggtggaggggaagtccgtggggtggggcagacccccgagggcctggataggggagggggagtcactgggggaggggcggaccctgatggtcctgatgggggagggtgaatcagtgggggaggggcgggctctgaggaccctggtggaggaggaggagtaactgggggaggggtgtgccccaaggactctggcggggttgggggcatctttgggggggtgtgggcccctgaggcccctcgtggtgggggagattccatgggggaggggcatgccccctagggcccatgtgggggaaggggaatcattgggggagtggtggacccccgagggccctggcaggggagggggagtccatgggggagggcaagtcagtcggggagacatggggcccaaggaccctagtgggggatggggagtccatgggggagtggtgggccccgagggccctggtggggaaggggactcagtaggggaggggcagaccccgaaggccctggttggggaaggggagtcagtgggggcatctgtgggggaggggtgggcccccgagggccctggtgggtgtgcgggagtctgtgggggagggccaggcccccaagggccctggtaggggaagaggagtcattgggggagggggagttattggcaaggggaggtgcccaagggtcctgatgagcaagggggaatcagtgggggaggggcagggcctgaggacccccgggggc

SEQ ID NO: 20 - DNA, 1053 bp, Homo sapiens
attaaattcagctaccaaggcagggcacggtgtctcgcctgtaatcccagcactttgggaggccaaggcaggcaggtcacctgaggtcggaagttcgagactagtctgaccaacatggagaaaccctgtctgtactaaaaaatacaagaaaaaaaaccacaaggccaggcgcggtggctcatgcctgtaatctgagcactttgggaggctgaggcaggcggatcaccaggtcaggagatcaagaccatcctggctaacacggtgaaaccctgtctctaccaaaaatacaaaaaaatgagctgggcatggtggtagtcacctgtagtctcagctactcaggaggctgaggcaggagaatggtgtgaacccgggaattggagctttcagtgagccaagatcgcgccacttcactccagcctgagcaacagagtgagattgtatccaaaaaaaaaaaggaacaaaaacacaaaattcggctaccgaggacaaagtggcctactacctgtgacctaactgtactacctgtgacctgtatgctttgtgcaaagtctgtctcctttctttctttcttttttttgaaacagagtctcactgtgtcgcccaagctggagtgcagtggtgcgatctcagctcattgcaagctccacctcccaggttcatgccattctcctgcctcagcctcacaagtagctgggactacaggtgcccgccaccgcacctggctactttttgtatttttagtagagatggtgtttcaccatgttagccaggatggtctcgatctcctgacctcgtgatccacccgcctcagcctcacaaagtgctgggattacaggcgtgagccaccgtgcccggccaagtatgtctcctttcttaactacagttccctgagtaaaatgggaaagtcaaacctcctaagcctaccctgaagatctttgtaaagcaccaaagagtgccttctgcaaaatacccaccccctcaaccttttaggaaaaacttaatgtacacaagcagagggactagcataatgaccagattcagtaatcaccaaga

SEQ ID NO: 21 - DNA, 1049 bp, Homo sapiens
aaagcgtcgctgcctctgtctaaatgcaacgagtgctccccacggcacttccccctgcgtcagtcacctccaaaaattacacctgagctgagaacagacgctgggctctagttagtgacgtgtttgctgcagttgactctgaaggcttaaaaaagtgagacgggctgcgggaggaagagagacgggaacaacgcaccaacccaggagcatcgggggtccctgcctactttacgtgtctttctgtgttagcagatttatatgtttatttatttatttgagatggagttgccgtccgtcgcccaggctggagtgcagtggtgcaacctcggttcatcgcaacatccacctcctgggttcaagcagttctccagccttggcctcccaagtagctgagatcacaggcgtgcaccactgtgccctgctctttttttgtctttttagtggagacagggtttcgccatgttggcccggatggagatttttcttttttaagtctctctctgtctagctggagtgcagcggtgcgatctgggttcactgcagcctctgtctccggggttcaagccatcctcccacctcagcctcagagtagctgggattacaggcgtccgccactgcgcccagctaatttttgtatatttagtagagatggggtttcaccacattggtcaggccggtctctaactcctggactcaagtgatccacccgtctcagcctctcaaagtgctgggagtacagtagtgagccaccgcgcccagccaaaagatttttatggtaaagttttatgatgggaaaactgtcatcccagaaaattttgagacctgatgctgaggcctcagcagctcagagaatacgtacttctgtcccacgacacccaaacatcgacctgtgtcagttcccctctaggaacaaaacgtaactgaggacgttgtcagatgcttgtcctcgtcaccctgagcttgttggctggtatcctattcttattcattccctttcttgcctgcatgtgcttgatagcagatcaatgacaacagccattggaagctta

SEQ ID NO: 22 - DNA, 1050 bp, Homo sapiens
gatgggcggatcatgaagtcaggaaatcaagaccatcctggctaacacggtggaaccccatctctaataaaaaatacaaaaaaaaaattagccagatgtggtggcgggtgcctgtagtcccagctacttgggaggctgaggcaggagaatggcatgaacccgggaggcagagcttgcagtgagccgagatcgcaccactgcactccagcctgggcgacagagcaagactctgtctcaaaaataaaaaaataaaaaataaaataataatttgggctgggcacggtggctcacacctgtaaccacagcactttgggaggctgaggcagtggatctccttgagttcaggtgatctgccccctttgtcctcccaaagtgctgggattacaggtgtgagccaccatgcacggcatcttgaattcttttctcataaaagggttttgaatttggtcgaatgcttttcctgcatcagatgagagggtcatgtagtttccttcctccactcggctaatattgattgatttttgtatgttgaacattttttatgtggaacattgattgatttttgtacgttgaactatccttgcattccaggaataaatcctgcttggtcagggtgtataatttttttattatactcctgaattggttttgctggcattttgttgaggacttttccaacgatgcttatcagggatattggcatgtcatttttcttgtggtgtctttgtctggctttgatatgagggtaatgctggcctcttaggatgagtgaggaaatgttcttcaatttgtccaagagtttgaggagtgatactgattcttcttaatgttttgtgaattcacatgtgaagacatcaggtccaggtcttgtctttcaacttttatagtttgaagattttaggttcccagaaaagttgcaagagtagcacagagacttcctgggcctgggaccttgccacgtggtgaacatcatgtgtcactgttggacccacctgtgactgggttttgccccagaatcccacccaggacgccacgtgacatttagctgtc

SEQ ID NO: 23 - DNA, 1031 bp, Homo sapiens
ctggtcagcggtggaccttcagcccctcctgcctggtggcctaccggcccgaggaggatgccaacctggacgtggccgagcgcgcccgggagaacaaaagtgcggcacagctcaggcggccagtgggaggtggggctgcccctggccaccactaacctcagccctgcccccaggctcactgagcgtggccctggacaagcttcgggcccagaagagtgacccagagcacccgggaaggctggtggtggaggtggcgctgggtaacgcagcccgggctctggacctgctgcggaggcgcccagagcaggcaagctcctgaccccgtcctcccatactggccagtctgagagtgaggggcagagggccagggactcacctgctggcactcttggcaggtggacaccaagaaccaaggcaggaccgctctgcaagtggctgcctacctgggccaggtggagttgatacggctgctgctacaagccagggcgggcgtggacctgccggacgacgagggcaacacggcactgcactacgcggccctggggtgaggcctgggaggggcccggccggcggggctgagcctgtgcgtcctggggtgaggcctgggaggggcccggccggcggggctgagcctgtgcgtcctggggtgaggcctgggaggggcccggcggggctgagcctgtgcgtcctggggtcgggcctggcggggctgagcctgtgcgtccagccaccgggcccggcgccctccctctcccacttcctctcctgtcaggaaccagcccgaggccaccagggtgctcctgagtgctgggtgccgggcggacgccatcaacagcacccagagcacagcactgcacgtggccgtgcagaggggcttcctggaggtggtgcgggccctgtgtgagcgcggctgtgacgtcaacctgcccgtgagtgctgctccctggcctgggtgccccctgcccgtgagtgcttgtccctggcctgggttccctctgcccatgtgtgctgctccctggcctgggtgcccc

SEQ ID NO: 24 - DNA, 1050 bp, Homo sapiens
atttattcctcattaactctaattaatgtatgattaattagattaattctaaaataacccatcggctgttaacattttaatgaaaagtgactattttcccaaacaaaatattcggcaagagagtggcaacatttttgcatctggttgagcagaacacggttgagccatcacacctgcctctgcgttcaggctgctgcagtgttgggttaagattgtgaggaaatccagtgtgtgaggaggcttggggtgaattccagtgtgtcaggaggcttggggtgaattccagtgtgtcaggaggcttggggcgttttaacagcttttcctctggtaaacgtgggtattcttctttgatatttctctgaaactcggcacgtggtcatttcttacatgtcagttgaaacatggaatctgaaactgtattggtgtcactttcctgcagttaccttaaaaatccgctggtctcttttgcgctcgaataggtttcttacgcgtgcgtgtgttttaaaaatcgtatgttggccgggcgcggtggctcacgcctgtagtcccagcactttgggagaccgaagcgggcagatcacttgaggtcaggagttcgagaccagcctggccaatgtgatgaaaccccatctctactaaaaatacaaaaattagccgggcatgcatggtggcggatgcctgtaattaatcctagctactcgggaggctgaggcacgagaatcacttggacctgggaggcggaggttgcggtgagccaagattgcaccactgcactccagcctgggcgagagagcgaaactctgtctcaaacagcaacaacaaaaaacatcgcatattggctgttaggaaatattgctccactgggttctgcaggtcttcctaagcgcagtggaaaattccccccacgctcatgagggcgagtgtgaagaaggcaggtgctgtccgcttcggattatggtcatagcttgcactcgcggctcccctgcctggtctctgggacccccaggcatccccagacctccctggcctcagccagttcccgccgcttca

SEQ ID NO: 25 - DNA, 1014 bp, Homo sapiens
ccgaggggcgtgggctcagcactgccagggcccgtgccctgtgtccccacaggatggtgctggccgtctcaccactgaggggatgccccccagccccctcaccctcagctgctccttccaggagcttaaggcccctaaagtctgccccggtccctggggtcagagcccaccctgggctggttttgaagaaacaccagtgcttctccaaggaggccccgtgcacatgtaggaatgaagccctcgtcctcccacagccgcgtgcccctcctgcgctgcgtgtgtggttttgctcatggcacctggcgtgggcgccctgggagcggcagccgggggcgtctcggagagagccagtgcaggggggaccccacaatctgggaggccatggatcctggttgtgggtttttggttttaacatttggtttacttattttcagacttttttccaaacaaatggtttatccatattaatttagctctccctgtggaatttgtaggacctcagttttcttgacattatgatctaagcagattattgaacacacgtcttaaatatcatcttttcaaactgccacatgtaccatcatatagatgtgctttaataaagaggtcagagagctgtggcccactgtagttcttgtttgtttttttgagctggagtctcactcttgttgcccaggctggactgcagtggtgcaatctcggttcactgcgacctccgcctcctgggttcaagcagtgctcctgcctcagcttcccaagtagctgggattacaggcgcttgccaccatgcccggctaatttttgtatttttagtagagacgggttggggttttaccacgttggccaggctgctctcgaactcctgacctcaggtgatctgcccgtcttggcctcccaaagtgctgggattatagaagtgagccaccgcgcctggcctgtttgttttttaattgtggtaaaatacctataacataaaattcaccattttaaccatttctaagtgtgtagttcagt

SEQ ID NO: 26 - DNA, 1630 bp, Homo sapiens
gagagtagcagtacgagccggagtggcggggtgaatagtttgacgggaaggatggttacagaacaggtgactcaggatgactaagaacagagcaggtgacaaggatgactaaggtcagagcaggtgaccaggggtgactaaggacagagcaggtgatagaggctaggcaggggttgtttactgaaactaggggcaaggatatgtaaagtacaaggaagttaaactttagaatgaagaacaaagaatggggatgtaaccatacggatacattgcttctttggagaggagctcagaattcattatacttaacaatttacaggctaaaacctttgaagaggaatttattatgttctacaggagcggtgccgctggcctgtggcttctgcagggacaagtagtggctgtggccgggaggcgttcggcagctgtgcttcagccccggccccagcttcagctcttcgagttgctggcttctctaaggcctgtcctgaagtggcctggagactgctgagttacttctggaatctgcaccgtgaaagtgaaacctggaccatgatgtgaggctggtgagagggtgccctctgccgtcacccccggccttgtagaaaactcattccaatggccctctggttctcactcaggaccaaatagtgatggttttttgtttgttttcgttttgttttgttttgttttgttttgttttgtttttttagacagagtctcgctctgtcgcccaggctggagtgcagtggcgtgatctcggctcactgcgagctccacctctcgggttcacaccattctcctgcctcagcctcccaagtagctgggactacaggcgcccaccaccacagttggctaattttttgtatatttagtggagatggggtttcaccatgttagccaggatggtcttgatttcctgacctcgtgatccacccacctcagcctcccaaagtgctgggatgacaggcgtgagccaccgcgccgggcccaatagtgatgtttttactgctctgggcctgatcgcatgcaccgttgtctgtgctgtgacttccgtcgttgtctgtgctgtgacttccgttgttgtctgtgctgtgacttccgttgttgtctgtgttgcgacttctgtgggatattcgttggagaaggagccacacagctgtgtgggacccggcactccttcatcaccatcatccagggccacggacaccccctctcacaagtcgctgggatatgaaattagggaataaatgggaattttcagtgcgatgcagctggcgctaggatcctcctcagtgtgacgtctgagaccttttcccagctggagccctgtcattcattcattcattcatcccatgccaggctgggcggctgccagaggcacaatccggaaccgccccttgctaatgggcggaccagtgaaagcaaagcgggctcactgtgcagaccaatgattgacagttccagggtgtgatggacacaggcggctgccaggaaggagccccttcagaagcagtgggcggggcggggtggggaaggccgtggggaggagtgacttccagatgaggctcacaggactgtacccggagggagggggcagcaaggaccctgtgggcagccgggggcacgg

SEQ ID NO: 27 - DNA, 1041 bp, Homo sapiens
caggccacgtcctcatcccctctgggtgagtgagaggcacagcctgggtgcgtggggccgtggcggctccgaggcgccaccgctgtgtcctctcatgagtgggtgccgtccaggtctgtcctgggctggctgcgaggaggaggttggcctcgcgcggccatgtgcgtgacagtggagacatcgccagcctcctgcttgcacagctgacggcagcccctctctctccagccatgtccccaggactcttgagtagttggcctggtggccgtgggagaagcaggccccgagtccccagggctgtgagcgaggctgtctgatgtgctccctggtcaccaccccctgcctgtccgtcttgcctgggcagatggaggtggatgaacttcctgcggccgctgtaacagtggccgccactggggggcttaaagcaacacgcatttgttagctcagcggtctggagggtgcgagtgcagatggagctcactgggccaaatttagtcaaggcaccagctgggtgggttctttctgggggctccagggagaccccgtttcccgccttctccggcgtctgaagccgcctgccccttggtgcagccctgagtcaccccagcctctgcctccgtctcacgtcaccgcctctgatacagccgcccccccatccctcttgtgaggaccccgcaatgacgtgggcccacccagatcatccaggaacatctccccatccccacgtccttcacttcatcgtctgcaaagtcccgtatgccacggaaggtgacacagtcttgggtcccgggacttgcatgtggggctgtctgggttttgcacagctgaccatgggtgcttccggatgcttggcattggaggtttctgtcctctgctggaaggattcctggagtgagggcagcagagggcacccagatggaggcactgccggacgcgcaggggcgatggtcggggggcacctgggagccaccttcccttgtctctggggggtgacccttgaccttggtggcctcagttttctcatctgtaaagtggtgcaca

SEQ ID NO: 28 - DNA, 1585 bp, Homo sapiens
ggggaagcctggagaggaagccaggtggccccaggctcctggagctcagaatctagtggaaatcgctgcccagggaagaagctccggagtctagaggtggcagcacccattttacctgcaccctcagtgacagctgcaccctggcttctggggacctctgggcccaagggcacctcactgtctccttgtcctcctggtcactgacctgggccaccatagaaggcacctggctatctgcatgtggcttgaccactgccttgcacccatccgggccccgcagggccgtcctgtggcactgctttgggctgtgctggtcaccctgtgtagcggggccatgtccagtgaacaggagaggcctcaagtgccccctgacctgctgccagggactcggcccctccctcaccgccaccgcacccaagggctgtcgcctgtcccagcctgctgctccgagtttagtgttttaaaacgtgttttctacgtcttgtcagagtgctcaaggcgcgagattgccatggaaactgagctccttagaattcctgtggccgtcctaattatagaatctcaaagacacgcacagagctccttgaggttgtcggagttaaggctgaaagaggaggagcggcccctgtgatccccacaattttgttccctgcttgcttcagcagagcctggcacccagggaggtggcaggatgggtccccaatgggcacgtgacatcgagccagctctgactccaaagcctgacccgtgtggctgcaccgtccactgtgcgctgtccactgcaggagaccccaggctgtgtccacacgtacccccggaaggacctcctgctaacctgggcttgactttgagaccctgttccacagaggtagccgggggactcgcggtgccaggcccacagcctcctcgccggtagtatctgggggccaggggccgtttccagagcacactccccagaagggctcccttctccttttcacagcgctgtctgtcgcttaggtcagaaataggcccatcgctttccaagcagaaacccaaacactgaaaattcgactgtgacttttgaggggtggggaccgccaggtccccccaacatccctgcctgcgggcccagaaaggcagagtggctgccggcccgcgtgtccaggccccttacactgagggaaccttctagtcaattgcctgaagttcgaaggtttggggggtttttgtggttgcttccgtttgttttggcagttgcagaatcccccgaaaaggtgggaatgtggatttttcaaggcaggtgctcctttgattcagaagctaaggaggccctaagtgcagtctcaccttgagaaaaatatcaggccagtcctaacggaggggcgtcctgcagacacccagcctgcactcagaactgtcacggtcagaaagcacggtcagaaagtctgagaaagtcacggtgcagcagggcccgagaggcaagacggtgacacgtgggctcctggaagaggcaggatggtgacacgtgggctccaggacaggaccctggggcggacgcagacagtgggtgaaaaccaaggaaaggtctgaatatcgcttaagg

SEQ ID NO: 29 - DNA, 1044 bp, Homo sapiens
aagcatcacaaagcctatttgcacccccatccccatcccaaccccaaatctacccaacccccatcccaaccccaaccccaatattcacccaacccccaccccaccccatccgaaccccaatatccatcccaaccccaaattcatccaaccctcaccccaccaccaacccaacccccagcccaactcccaccccaacccccaactcaacccccaccccaatatccacccaaccccactccaacccctacacccccaacccctccaacccctataatctggtggacagagccggggctgtgtgggccgggtgggctgtgtgagctcgcgcaccgccgggctggtctttgacatggccccacttgcgtggagccaaggctcctgtctcccagaagggtcagctgggaatgggggaccaccctccagggccccgaggagggatggggagacacatttcgtcctccggagccaggagagtgaggggccggacgagctcggcccatggcgcttcctggcaaccctcgactgtgctggcttggtgccgccaggagctagcggcacatgcgtcctgacctgtgagcacattggctgttggttccacagggatctgatagtgggggccggcctagagaagggcgtttgctttggtttcatggccggttttatcagcagttactggacaggaccagcagtcgcagcgttcacggcttgagctttagcgtcgggtattgaaggagagtgagtctgtggacagggtgcgacgtacactggctcgatttaggaatctgatttcggtggtgtgtgagcagggtgcattcggtagaaactactttgagttttgaccgttccccagctggccgtatgaggtcagtactctcctgtgatgaggggcggtgactgcagccccagcgggccacgtgatcaggagggggccgaatgtcccgaggggctctgcgtgcagggggttttgccggactgtaggctggcgtgtgtctgtcaggttaaggcaggtaaggctgcgccgcttggtcgtgggttctgtgtgga

SEQ ID NO: 30 - DNA, 1034 bp, Homo sapiens
cgatcctgggtgcagccttggtgccagccgggcccctgatcttgtctctcaaccactcttggtttaccgggagtggacagatgaggacagatggctgcctgtggagtgacgggctccttctcttcggagcactgtctaatctgagtgtgagtccaaccctgcccgagccggaactcaaggagaccatgaagccacccttggcctctagctgggagaggtctgcgtccctgcagcgagcacgccaggtgatctctggcacacacttgccgcgggctgtctctcggaaggtagtcagcggccctggcttcccacctgggtcccaccactgcagaatcacccccgtggctgcccacaggggcggcttccatcaccctgcttcttcctggctgctgcgggctgtgttgtgacttccatcccagcctgagaggcctgcgaagggcttgccaccgactgccagccctgcctctgccaccgaccgccggccctgcctctgccaccgaccgccgaccctgcctctgccgtttccttgccacccatcagctcttgaggcttttaggaagaagtgtggctgttttggccagattgctttagctgtcctcagcagggttggtgtggggtcaccaccacccccatgtgaccttggcagaaggaaggtcctcctcccattcacccaacgcctgcaactcagtggttctgagcaatcccagagttacatgacgtcatcgcgatcactttcatcaccctgtacccagagaagacccgaacccactccagcctctccccacaccctgcagtggctgctccgccaggctgtgtggctctgcctggtctgcacatgtcatggaagtggacctgggcacaccgcggcctttcgtgcctgccctcccctcagcattgtctccacaagctgcacccacacagtagcacgtggcactgcctccttcctgcgctgaaccccacccactgcgtccactgcgtggagactgcacctctgcatccgtcctcagtggacatagggtggcctccactttctg

SEQ ID NO: 31 - DNA, 1089 bp, Homo sapiens
cccttcgccccgcccgccttccccttcgcgcccccgggcgaggccgcggccgtgatcggccgtgagccggcggcggggggcggccggggtcggggccgcgggcgccgccggggcgcgcggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctc

SEQ ID NO: 32 - DNA, 1130 bp, Homo sapiens
ctggcctggctttgttgtttgccagttggaggatctatgggatccggcatgggcagctcccaggccacgaggtgccgaaattactcagtggggtcctcaggaactttccgttgcgtacctccccaagtatttgtaacttttcttttaaatatccaggcttattaaattgcacacacagaatgctgcattggctcagctattcttgggaggcctaattaattcagctattgcatcaaactttttttttctaaatctgtgaatagatgctccagcccggttttctctgggcgcccctccagcagagtgtcagatcgtggggaggaggggctgtggatggaagcgagggactgtcgcctctgctcggagggggctgcggagggtgcatgtgtgtgtgcatgtgtgtgtttgtgtgtgcgcgcttctgaccctgccaggccagggctcaggtggcagccgcctgcagacctgtgggctggggaaggatgctcgtggcagagctgcagacagacgtagcaggctggggcccttcgtgtcacacggggagttggttggggtgggcccgatggcgctccctgtgggctggggcctttctttttggggtggccgcaccctcgtcagtgcctgtggctggaggaagccacatgtcgggggggattgtgggctcgtgcaggctgcgtagtgggtcacctgtggccaaggcctgagctgctgggacacgctcacgtcactgtcttcagagctgatggcagaggatctcggttgagcagggtgtgtctgcgtttgtttttgtccgactgtgggtcatgtgtgtgcttgtggtctttctgtcttcctgggctttgctgggggcccattggagtggccagtggggcctcgttgtcacagctgacacagagcagggcccaggccacccggcttctctctccctgtggttgtgagcgccggggtccttgggccgccatagagacaggccagacaggctctggtcatctcagcggatgcctccgagccgcctttcccttttgaagtccccagcactgctctgaaatttcatttaccgattaaaaagcaattcccaggccatactgacgacgtgcacggtgtgagtgactgcgtcctctaggcctgag

SEQ ID NO: 33 - DNA, 1032 bp, Homo sapiens
agggggggtcctgctccgagggggccggggtttctgttccaacagggctggtggggggggtcctgttcccagaggtccgggatcctgttctgagggggccagggtcctgttctgggccgggggtcctgctccgagggggccgggcgtcctgttcctaggggcggtgggctgcctgtgtgagagctgttcttcacctgccacgtgcagtctgggcattctggtgactggagaatttgggttgtgttacagtgttgttgctctgtcctgcagatgcctgaattcccaggggtcttgcaggtccccttgcccttgcgctgtgtgggctggcgtgggtctcagtgggctgtgggttgagggtcgcttggttgggaagctctgcgcgcttcccagtggagggtccgcgacgggggttttctgatccctcatgctggcttttgacccgtgtcactgcaaggctgcccctggccccaggcagcgtttcttcaggcaggtgcccagccaggtggtcgggcttgagacctttgagtctcgaggtctgttctggggaatgactgagcttgtggaggccaggaaggggttgctgggcttggagagcctctggggaggagttgtgttttgctctttgctgttttaagctgaaatgatcacaggaagggacagcatcaagagtttctttctgggacacccctcactcagctcagcggccgtgtgtgggtttggggctgtgctctcccagacaccctcaggtccggggagcacttcgggggctatctgtccctttgtccaccagcttcctttggaaaaagtgtttgctgcaagtgtttttctccagcttttcgtggggttccctgtagtcttgggccatgctctggggtcaggctcccggcaggccctggtccccgtgcagaaggccagggtctgcgggtttgggctggtctgccccccaggtgagggttccggaaagacggccggctgctgagtcttctcaagcaggggaaacagcagctcgagagtggttcttgacctctgccc

SEQ ID NO: 34 - DNA, 1278 bp, Homo sapiens
ggggtttcaccatgttggccagcctggtctcgaactcctgacctcaagttatctgcccaccttggcctcccagagtgctgggattacaggcataagccactgtgcctggcccctggagtgggttctgccacggaaggcatccccggggtctgcgggctggaggggtcgcccccactgtgccacctgttctctcgaggcctggttgccctctgcagaccaggtgccatgccaggtgaccctcaggaagctctggctcaccccgggggctggggggcatgataagcgatagctcttaggtgctgctgctttgtgaatatgagagagttccagaagggccccgcttcccagagcctgcatgttggtttcactgtgtggtacttgatatttttccaggctgccttgctggggtggcctcgatggggggcccagggagcctccagctctggggacatgctgccacatgagcctgcttatttacgaaaatgaagaaccaggacttgagtgtgaattttaaatgagattgtggggacaatagtaaaatccagactaggaccagatggactgagcacctgcgttggccatggcccggaggtggcgtggtggtgcctggcgcctgtggccctcagcatgtgtcctgccggccgcctagtaggccttcgcttgaagtgcttattcctttgagtaatgctcctgtcttttgtttggggggaaacagataaagggggctttgagaggcgtctcggcgtgatcctgggaaacggccgagattctgttcggtgcttggtgttcgtgtcttctctgattttacctttttgactcataaagatggaaggagtgctctgcctcggtgcctctgcagctgcagatgctgaatcggggcgtttaggcctgcctcttgggctggcacacctggcggccttggtcaggccttcttgggctgcctctgctggggtgcttgtctcactggccgtgggggttgttgcctgtgtggttgtgttgctggcttcaggggctagggttagggacgcctggtcacgtctgggtccccagtttgggggccagattcaataactcactgaatgactcagtggaactctgcaggcactggcagtcaaggtttattggcaggtccattctttggctagaaggagaatgctgtttcttttctcactgtttcaccatttttttttttgagatggagtcttgctctgttgcccaggctggagtgcagtggcgtgatctcggctcactgcaacctcagcctcccgggttcaagca

SEQ ID NO: 35 - DNA, 1084 bp, Homo sapiens
cccgggaggctggcgccctctgtgggaggtctgaggttggcccatttgaccctatccaggacgggttacttaaggagtccaacgggccttgagaggctgatcaccctcgtgtggcgggcgtctctccccggtgccctcccgcctggtgctgtcaagggcttctctgtgccaggcgctgggctgtggcagccccaggtccccgcctggtgtggctgcccacggtccaggcagctccagggtgggcatccttggctccctccctcaccagctggccctgggaggtctgtctgagaggagttaggcctcattgtccgtgctcagagaacccgagccttccttaggaagcagtttgtccccgtgcctcccttcaggatcctgtggcctgagaagcctctgcgtggcagtggatggcagctccagctgcccgtggccctctttttttatggtttcccagatgactgggccaagctgggcctctgcatcctaggcatgctgttccctgcgcttccctggaaggtcggcggccctgcgtggacctacacggtacccaggacaggcctgccatggcaccggttgggcctctgggcacagggtgctctgcctccatggccctgacaggctctgatgcctgaggatgggggccgggcactcccagccttgagacttccctctgcagaggtggcacaagcccggggccccagagtgaggggactcttgcctgcctggtgagggtgagcgtggggtctggactctgacccctggtccaggcgggagaggagcacactggacagggcagccgagccaccctctgcggagctgtggacactgcgtgtgtggtgctgaaggtgtacacgtccactgaggccacctgcgccgctgcctgtgtcctgtgggctggcactcaccgagtgagagctgtgtgcagaacctccgctgtcagcgggccaggccacactggggagggaggtattccgtgtgcttgcactgaagcctgccccaggctgccttctgggttagggatacccaggacctccatagctggtgtggcgtctgtgagatctcagctgctgcttccctggacgcc

SEQ ID NO: 36 - DNA, 1032 bp, Homo sapiens
tggtcttgagctcccgttgggggaacgggagaaccttcatcccatgtgggtgtagccgttggcggcacctttgtacggggacacaccctggacctgaatggagtcaggaagggtttcaacctggatggcccgcgtgccggggacccgcaaggtgtgcagtggcaagggccggtcctggtggcgggctccctggtgatgctggtggatggttgtgcgtgggccttggggttcacagttcagtttgggagaggcgagaacccctcactttgaagtctttcctggccaacgggaggcttctcagagcagctttcacggctccggggctgagtgaggcctgtgtctaggctcatcctgccctccggggcgtcccagtgtgcctgggcagtggcgcagctggctccttccactgggtttaggtgtgcttctgctccccactgctgcttcagctgcgtcctttgcgggtccccgtaacttcagtgcccccacccctgttcggttccctgactgagctcggcgcctctagtgtagatgggtttttaattttcccagctgaacgtcgttatttggattgtgatttctttggtgtttcaatggactgtagatgaaggaggacctgttttctctcaggagtgtctgtggggtctcttgtcctggtttgctcagtgaagtgtggccccaagggctgagggaggtggccaggaccccgcagggtggcccccaccacagaggctgctgtcctccgggttcttctccactttctgggaccttggccgaggaggcctctgggagggtgaaatggccacaggcctggagaagcgacaccggtgggaagccaccggcagagaagtcagggaggagggagtcctgggcctggaggaacgtgggaggggcaggcgcctcctagcagcctcaagaaatgtgggccaggcaggtctggctacgggcaggagtgtgtctgggactctgaactgccagaagcacttggcggcaagccacatgctgtcacaatgttgcctggcccccatgaggagg

SEQ ID NO: 37 - DNA, 1247 bp, Homo sapiens
tggaacttacttagtgtctggggcatgggccgtgttttggtatcgcaagagatgcttcagggcgcgtgtcagcacaaacacatcacacgggcttcgtgaccatgtgctggctgcacgagatgtcagtgtgctccgcgtaccacctgcttcatccccgccctgccctctcgtgctcctcggcagggggccgccatccttatgccccgcctgccctttctgcagctgtgggtgcaggctggccgttgtgctctgttgcaggagctcctgtcaggctgctggtctgcgcgtgtgctctccgagtgcctgtcactctggctgactcactgtgtcagtgtcaccgtgcagctttgctcgtcctgttcttgtgccttgggacgagtgggcagagtgcttgctgttgggtaggctgtggtgcaccatgtgggcctgggagtgaaacagcttggtcagagggcatgtcggtcacgccaggctgtcttccaaagcgtcccaacactccctgtcatcggtcttgttggctgtaaacgagttctctgctgcatgggatgctaggggtgtggtgagtttcttgtagacgtggcaggtcagaggggaggcacactgtctgccaggcaccctgttatttactgatacacgcacacgcaatacacatctctatagattgcttttgtatgttcactcagctgggatgattctgtgtgtgcttagatctttgttcacgtttctgatcatttccttagtggactctgagattcccctaaaaggtgggattgttttacccaaacttttctttctttctttctttctttttttgacacagagtctcgctctgtcacccaggctggagtgcaatggcatgatctcggctcattgcaagctccgcctcccgggttcatcccattctcctgcctcagtctcctgagtagctgggtctacaggtgcccgccaccacacccggataattttttgtatttttagtagagatggggtttcaccgtgttagccaggatggtctcatctcctgacctcgtgatccgcctgcctcggcctcccaaagtgctgggattacaggcgtgagccactgcacctggcccctcctgacaacttttaagattctgtcatttaggctgggcatggtggctcacacctgtaatcccagcactttgggaggccaaggtgggtggatcacttgaggtcaggttttcaagaccagcctggccaacatggtgacaccatgtttctactag

SEQ ID NO: 38 - DNA, 1113 bp, Homo sapiens
tgcacctggccctatttttccttcttttttttttttttttttttttttttgaggcagggtctcactctgttgcccaggccagagtgcggtggcacagtctcggctcactgcaacctccgcctcccaggttcaagtgattctcctgcctcagcctcctgagtagctggggctataggtgtgtgccaccacacctggctaatttttgtttttttagtagagacgggtttcgccacgttggccaggctggtctctgactcctggcctcaagccgtcatcccgcctcggcctcccaaagtgctgggattacaggcgtgagccaccgcattcagcccgtttttctttttaaagaaccgactgtttttcatagtggctgcagcattttccactcccagcaacagcgttcgagcagcactgtctttgcatcctctccagcacttgttctgttttttgacagcggccatcctaatgggtgtgaggtggcatctcattgtggttttggttctcatttccctgatgattagtatgttgggcattttttcgtgtgcttattggccactcctatatcctctttgaggaatgtctgagtccctctttgagtcgagttgtgtgtgggggcctttgctcagttgtacgtctttatctactctggttagtgatcctgttctacttgtaaatttctgtctcctgtttgtctactgcgtgcaccgtggtcggatcctgcctctgttgctggaggctgcctctgtcctctgctgtggtggtcaggaagctggagcgtctcggcgccagattcatgtttgtaagaggagacgctctgtgagcctcggtgtgcagcgctgtctgcaagtcagactccccacccctcctttgtgcgagctgggcgggggctctgccgggactggtggtgttcatggagagggcttctgtgtgatgaagagatgacagtgacctgctggggccgaaggctgtgagtgccattgggggagggagtctcagagagtgcggcagtcgggcctgatggggctgctcttctgtgaaggggcacctaccgtgtgcctggcctgtagcagcagcaaagaggaacctgatggggggggcctcaggaacctccac

SEQ ID NO: 39 - DNA, 1859 bp, Homo sapiens
tggagggtcctcactttttgttttgcaaataacgctggggcccctgcgccactggggcaatgcaactgtgacggtgctggttggattcaaaaggaagcctggcagtggcggggcctggacaggcagcctttgacctgaggcggggcggcgctctgcgctggttcagaaaagccgtggggcagcctctctggcaggcactggctgtacctgttggttttcctttgcccacagtgaagtgaaagtcactgcagctgggtttgctgtttaactcactgtctttccttctcacgtcttctctgtgcaaatagtggtcagtgtactttttgattatttcagtcaagtggaagtttctaggagcgtagagaggcagcgtggcttagggtttaggagcatggctgggctaccttcctactctgagtgtgggccacgttacttttctaggcctcagtttcccattggcccctctcctgtttggaagaggcagctgggtcccacaagccatctcaggagccgcgtctgggcgctggcacggggactgtgcccacagccagccagcctggtggtcagctgatggattcccgtaggtacttagcaaaatgcctggagtgtgcgaggctgtcaggccagtggcagatgcggtcgagtgctgttgtttcttggtgctgcctggcactgccaccctgatggtcggctctgagttggaggccagctttcatggcagcgttgttggtgggcgtgcagggtgtgtctgacctgggcctgggcatcaggtcccattgtggttgggtccacagggccccttgcctcattcgtggaggtgctgggggaattctacaggctgaggacgtgtgaggctccagggtccagcgtgcaggccggatgttcctagcgttgccggccacgcagacagccgtgccaccaggaggttccctggcaatgggagacaattgtctgctcagttcagccttcagtgccccagggctgttttgagatcaaggctgagggggaccctttcaagtgtctctgcctttggtggtcccgggtggccggctcctcacccatggtgtggtctgagtgggctgaaaccgaccccaggtgattcttattcggaagagatgtttctggaaatgagagcaaggcagtgagtggagagccagctgagagatgcttgactccccacctgctgctgttggggccaaaagcgtggaggagggaagagccagcacagagggctcacggtgtcccctgctccaaccgactcactggccgcggcctcatggggcctccctgtcctgcctcctgctcaacaggccacaggttttgttggattcgtcaattatgacccaggttgttgaactggaattggagatgtttttacagttggagagtttgttacagtcagaacatttcgggttgttggagttcggtgtcttgctgctgttgcagcttgcatcttttggccacagtttttttttttgatacagtgtcactctgtctcccaggctggagtgcagtggtgtgatcttggctcacagcaacctccgcctcctggattcaagtgattctcctgcctcagcctcccgaatagctgggattacaggcgcccgcccaccacgcccggctaatatttgtatttttagtagagacggggtttcaccatgttggccaagctagtctcgaactcctgacctcaagtgatgcagccgccttggcctcccaaagtgctgggattacaggcatgagccatcgcacctggccatggccacctgttttaaggaaaccactcagtgtcttaaaagttaagggtgctcattgccctgctcaacagagagtcccgtgtggtgctgggtagccctcgt

SEQ ID NO: 40 - DNA, 1104 bp, Homo sapiens
aaggctttcgtccgtctgagctgctgactgagggtctttatttccacactcgagagaaacctggcggcccagcagtcagtgcccgcggagcaggtacagctcagggaagggagcagccccttgctcacggtcctttctggcacagtctgtggccctctggagtacccggccagcgtcctcacagctgtccccaaacgcgtggtatgggttcctccctcagggccagcaccaggctggtgctcagctcttctggaagagccgtcccatggtcccagcgcatccgtggaagagtgaaatattgaacgttacaagaaggaagtgaggccaggcgcggtatctcgtgcctgtaatcccagcacttttggagttggcgatgggcagatcacttgaggtcaggagtttgagaccagcctggatcaaaatggcaaaactccatctctactgaaaatacaaaaattagccgggcgtggttgcaggtgcctgtaatcccagctacttgggaggctgaggcatgagaagagcttgaatccgggaggcagaggttgcagtgagcccaggtcatgccactgtactgcagcctgggtgatggagtgagaccctgtctgaaaaaaaaaaaaaaaatagagttgctaaattggagtaaatatttcataacgcgattcagttcagttgctttagctgctctgtgagtccagcacccgcctgcagcgcagcctcccctgtggagtctggagcacccaggcctacatcacaggctccagagcacccgggccggtatcacgggctccagagcacccaggttggtatcatgggctccagagcacccaggccggtatcacgggctccagcacagcgggcaaaaggtgggaggctccccagactttaggtgtctggagttatccataaagggggcttcctgagttttggtgtatcccttggtttacaacccagggagaagcctggccacttgtgagtgcaggtcgtccttggacacacacttggaggaatcggaaggaacaggacacgcagccttatgttcctgtcagcccttcctgcacatatgccctgtctcagggggctgctggcctctgccagggcctcctc

SEQ ID NO: 41 - DNA, 1048 bp, Homo sapiens
acatggctgggcactgccccacagtgtcacctctgtgtcctgtggtgcgtgctgtggactggcaccacaccccacgtgcttgttaggccagtttctctcaggtgtcggtcaccctaccatgcggcctttcttttgtcttttatctttagctaaggagtccatggcataccaaaagctgaatgatgacagccagtgtccccatcctgtcctccccaactttccacaggcagggacgctccccattcttgctgcatagtcttctgttgaccccatgtacctgagtgacccccacgtacctgagtgtgacaagcactatggtgcttgacctcagtccagctgcttagacctgtacctgccacagccccacgtgctgacaccttgcgtcttgagttttgataaatctatcctttggctgattaatatgactgagtggtgtcttctgaccccatttcttatctggaacactgtgtcctgacttcatttcctgtctggagcacactgtcctgacctcatttcctgtctggaacacactgtgtcctgacctcatttcctgcctggagctctctgtgtcctgacctcatttcctgtctgtgccgctctgtcctgacctcattttctgtctgtgccaccctttgtcctgacctcatttcctgtctggaacatgctgtgtcctaactgcatttcctgtctggagctctctctgtcctgacctcatttcctgtctggatctctctatgtcctgacctcatttcctgtctggaacatgctgtatcctgatatcatttcctgtctgtgccactttgtccggacctcattttctgtctggagcactctgtatcctgacctcatttcctgtttgtgccaccctttgtcctgacctcatttcctgtctggaacatgctgtgtccggattgcatttcctctctggagctctctctgtcctgacctcatttcctgtctggagccagtgacctcatttcctgtctgtgtcactctgtcctgacctcatttcctgtctgtgccactctttgtcctgacctcatttcct

SEQ ID NO: 42 - DNA, 3733 bp, Homo sapiens
cctggtgagggattctaggggttcccctcctgggttcatccttacctgagtagccacagcacactgtgcagttgggtgcctgggaggcacgtgctttgggtgttgcatggctgacctggtaactgggcacccgtgtatggagggctggaacagaacacttgtcggcgctcctcagcgtcttgcctctggtgtccccatggcgaagtcccctgccatctgctttgggctctgacatgtgacctgactgtgcccttcaggagctttcagaacctcctcttagatctggcattcaaaatgtcttgtcagacacctcgaggcggcttgtgtttggccctgtgttgggcgcctattgggcccttgtcaggtttttgttgccaggaggctcgcgccccgatcttcgggatggtgcccgtggcatcttctgctcggtgctccctagggctggacgttggtcctcctggcactggtgctccggttgctgtggtctccctgctgttcccttgtggctcaggattactctctggaggtctccgccttatcatgagcactttctttgttggctacttttagtttcatgatttcattttcgtttctaagatatctatctctttgtaaaagctcccaccttttgtgacttgtggatgctgtatctttctcctgttgctgcagacattaatgatgtttttcttgacagtttgtcctgctggtttcctctgcattcctttggttggtttcagacctcggctttaaaggggcatttccccacattgccaattcttgaccatctggtcacgtcaaggctgacgtgccaatggctgcaagggggagggcacctgggagcccgcggatggctcttatgcagacgtgcgggccagccccgatcctgcttctgcaaggcctcccctcccatggtggcgctttggtgccagagcgcgtcggcgtggctccctagcgtctgcctctgcagctgcttggcccccagccgcctcctcccagctgcctcctgccctatgtgtgcttgagctcgagacaatgcttccttcatccaagagccgggctctcggcgatttttgagaggagaatggggttgaagcgatgttgctcttccgtcttaaaactggatttctttcctcatgcttttgaattattatatcttcttgacatgtttctctggatttgcaaaagatttttatattttatatatttatttatttacttatttatttatttttgaggtggaactttgctcttgttgcccaggctggagtgcaatggtgtgatctgggctcactgcagcctccgcctcctgagttcaagcaattctcctaccttagcctgctgagtagctgggattacaggcatgtgccaccatgcctggctaattttgtagttttagtagagatggggtttctccatgttggttaggttggtctcgaactcccgacctcaggtgatctgcccgcctcagcctcccaaagtgctgggattacaggcttgatccactgtgcccagcctgcacaacattttaagtaaatgttgacattttaagcattgagcaaggaagagtgtgaagaggtactttataaagggaaatatggcaatactgattatttgcgactttaaccagaagtaatctttggacagccagatgttattgtcttggaatgtggtgttttatctagtgacaatgtgtgtgcatgcacacgtggacacacaggattcctggtccttaaacccgtatgttcggtgtctgcagcatagaatggtctcggctggtatgtgtgggaccagctcagatgcccctattctagatgccgaggccgaatcgccccctagggaggatgggacagtggctgtgctgagcgtgctacggcgtcatggaagaacagcagaggcgtttgagaattgtgttttttaaaaagagttgaaacttgtcagtcaggaaatggagtaacaggtttatcaggagtgtcattttccttttttttttttttttctcccatgagtggcttggtcggggaactcatgtttttttttgtttttgtttttgagtcagagtctaggtctgtcacccaggctggagtgctgtgatgtggtcttggctcactgcaacctctgcctcccaggttcaagggattctcctgcctcagcctcctgagtagctgggattataggcgcctgccaccatgcccggctaattttttaatttttagtagagacggggtttgttggtcaggctgatcttgaactcctgaccttgtgagctacccaccttggcctcccaaagtgctgggattacaggcgtgagccaccgtgcctggcgggagctcatgttttatctgaggtggcccagggccccacctgggagcagggtcagcagtgcctggcccttgagtgtttgcctcggggtgtgttccttttaaatcagatcagctcatcacttggccggttttctagaccagcatattcaaacccaaggtttggaatcttgggctggcttctgaaatgacatgctgtgggctccatccccagaattctgggttcccaggtccgaggtagggactgagaatgtgcatctctagcaagttcccagatgacatggtggctcctccggaacccctgcctccttttgtgggtaaagttttacaggtgcatggccacgccccaccgccctcgccggtgctgtctgtggctgttttgtgccacagcagaaaggctgagtaggtgcgagagagaccatgtggcctacaaacccaaaatatgtgtgatttggtcccttacggaaaacacttgcaggttcctgatctagagaaagaataattgtaacgcagggctacattgtttttgtgaaactctttaggatggaaaagggcatctctgaggtcagcgacagaagccgtggtggtttcatgccaccagtttacctttgtcctgagctgtggaggttgtttaaagctatagatcaaatgaagcctggaatataagggtgcagttaggatgattgctgtgtagttattttttaaaacggctttttgaggcataattaacataagctgcgtatatttaaagatacagttagataacttttgatgtatgcaaacacatataaaacatgtataaaaccctcgctgccgtccagatgatgaacctgtccgtcacccagaagctctctcctacccacacccctttctccccaggctgcagcagtctgcttttgggcctgtagattcgttgccttccttagagctttgtctaaatgaaatcctacaatatgttcttcttttggtctggcttccttccctcagcgtcattattttgggctccttggatgcgtggcgtgtgctgggcagtgttcccctgcgtggatgtcgcgtttgttcctccatttgcccgttggagcgtgtggagtgtttccagttcttgactgtcacaaagaaagcggctgtgaacattcgggtacaagttgttgtcgggatacacggttttatttccctggatagatacctaggtgtggaatggctggatcatatatttgtgcttatgtttaacttttagaaactgccagactatcttccaaggtggctgcaccattcctcgtcctaccagcagtgagtgagagttcctgctgctccacgtcctggccagcgtgtgtggtgggcgggcttaggcgttcagccgtcctgatgggtgtgcggcggcatctccttgaggtttaagttgcgcttccccaatc

SEQ ID NO: 43 - DNA, 1096 bp, Homo sapiens
aagtgctgagattacaggtgtgagccactacgtccggcctcagtttgttcttttggtttggacttcggtttcctagctgggaactttgtccctaactcaaggtcacagagattatctcctgtattctagaaattttgtagctttaagttgtatatttaggtctgtgatccattttgagttaatttttgtgtgcaatgcaaggtgtggacctgagttcatttctttgcctaaggtgttcagatgtttcagtggagtttgttgtaaagattagttctctactggattgtctttgtgcctttgtcagaaatcagctgtgcagatgtgtattcagttgatccacttgtttatctttttacatcaacgccatgctgttttggattattgtagctttgaaataattgttgaggtcaggtgatattcgcgctctaaccctgcactttttcagagctgttacagctattcgggatcttccacttttccatatgaattttagaatcagtttgtcaatttctgtgaacatttctgggaaattttgattgggattgtattgagtccatagataaattgggaatatcttaacaatcgggagttttccgaccaacggaaagctctctgtttatgggttgttattaatttagtattttgtaatttttagtgcacaggtttttaccatcttttgtcagatttattgatttatctattgaggttttttcttggtcttgtaaataatatattttaaaaattcgattactggatataaacggccactacagttcttatatgttgatcctgcagcctgtaaccttcctaacttgctcatgagtcctagtggcttttattgtagttgccattgggttttctgtgtagatgatcatgtcgtctgcagtaaaagcagtttcacttcttcctttccagtctggatgcttttttatttgtcctgcttaatggcaccggctagggcctccagggcagtttgaataggagtggtgggagtggacgccctcgctcctgatctcctgatctggaaggcgtggaatcagagtttggatgggagtggtgggagtggacgccctcactcctgatctcctggtctgga

SEQ ID NO: 44 - DNA, 1054 bp, Homo sapiens
atttggcaccgtcgagtgtgatggtgcatgttgggttttcgccagtgccctttatgagtccgaggaagtccccagaatacggttcctagtttgatcaggaaggatattgggttttgtcaggtgtttttttttcttaatttattgagattattaatatggtgagtgtctttctatttcaggttactaatgtgatgaattatattgactgattcttgaatgctaaaccaattgttcattcctgggatagccccccttcagtcgtgatgtattattattttagaatattgttgaatttgtttttttttgtttttgtttttgagaccgagtcttgctctgcacccaggctggagtgcaatggcgctatctcggctcactgtaacccccgccttccaggttcaaatgattctcctgcctcagcctcctaagttgctgggataacaggtgtccaccgccacacccagctaattttttgtattttcagtagagacagggtttcaccatgttggtcaggctggtcccgaactcctgacctcaagtgatctgtctgcctcggcctcccaaagtgctgggattacaggcatgtgccactgtgtttggcctcttgagttttatttgctaaaattttgcttagaattttttttttttttttttttggagacggagtcttgctctgtcgcccaggctggagtgcagtgacacgatcttggcttgctggaacctccgcctcctgggttcaagcgattctcctgtctcagccttccaagtagtagggattacaggcgcatgccactgtgcctggctaatttttgtatttttaatagagacggggtttcagcatgttggccaggcagtcttgaacttctgatattaggtgatcctcctgcctcagcctcccaaagtgctgggattacaggcgtgagccactgcgcctgccaagaatttttgcatttatattcatgagggatgttggtgtgtgtttttttttcttcttcttcccgtgtatctttgtctggttttggtgttaacagagtaatgttcttgtagaatgatttga

SEQ ID NO: 45 - DNA, 1067 bp, Homo sapiens
aggtcaggagttcaagaccagcatggccaacatggtgaaacccaatctctactgaaaatacaaaaaaattagctgagcgtggtggcgggtgcctgtaatcccagctactagggaggctgaggcaggagaattgcttgaacctgggaggcggaggttgcagtgagctgagatcgtgccactgcactccagcctgggtgacaaaagcaaaagtctgtctcaaaaacaaacaataaacaaacaactcttcctttgaaagttttgttttgttgtttttgttttttttttgagacggaatcttgctctgtcacccaggctggagtgcagtggcgtgatctcagctcactacaacctccgcctcccgggttcaggcagttctctgcctcagcctccctagtagctgggattacaggtgcccgccaccatgcccagccaatttttgtatttgtagcagagatgggggtttttaccatgttggccaggatggtctcgaacacctgacctcacatgatctgctcatctggacctcctaaagtgctgggattacaggcgtgagccaccgcaccagccagaaggtttttttttttttttttttttgaaacggagtctcgcactgttgcccaggctggagcacagtggcacgatctcggctcactgcaagctctgcctccccggttcacgccattctcctgcctcagcctcccgagtagctgggactacaggcacgcactgccacacccggctaatttttgtatttttagtagagatggggtttcaccacattggccaggctagtcttgaactcctgacctcgtcgtccacccaccttggcctcccaaagtgctgggattacaggcatgggccaccacgcccagcctactgttcatctttaccttgtgtaatgccagtttaagacgcaaatgcaggtcgggtgcagtggctcactcctgtcattccagtgctttggaaggacaaggtgggcagatcacttgagcccaggagaccagcctgggcaacatggagaaaccccatctctacaaaaatacaaaaattagctgggtgtggtagtg

SEQ ID NO: 46 - DNA, 1053 bp, Homo sapiens
ggatggataatgtccaaatgttttatccaagtccaaatagcagtgttggtggtaggtgtgctctgcctgtgggtgggggtggtctctgtctcaaggtgggctacgagggtctgccgcagggggggtgtggacgggtcttgcatgcgtcaccttccctgtgtggggcgtgggggtggtctccccctagaaggacagggcttgtggcagccgtgagatggatggattcccagggatctcccctcaccttgggggatgagcccaggctcctttctggggtctccagtgtgtccccgatggaccagcttcctgcatggcaccgccctccggccccaccccgagccctgagccccgccttgagccctgggcgctcctggccctggcctggcactcaagggctgctttcagggctgtttctcgtctgtcttttttcttttctttcttttttttttttcttccttgagacggagtttcactcttgttgcccaggctggactgcaatggcacgatctcggctcaccccaacctccacctcccgggttcaagtgattctcctgcctcagcctcccaagtagctgggatcacaggcgtgtgccaccacgcctggctaatttttgtatttagtagagatggggtttctccacatgggccaggctggtctcgaacttctgacctcaggtgatccacccgcctcagcctcccaaatagctgggattacaggtgtgcaccaccattcccagctaatttttgtatttttagtagagacagggtttctccacatgggccaggctggtctctaactcctaacctcaggtgatctacctgacttggtctcccaaagtgctgagattacaggcatgagccactgtgcccagcagggctgtttacttaaaggtacatgttccgatccctgaattcggttttattttgaggttaggagtgagaacacgattggttgtcgtcgtttcctgtgggagtggctcttttcagaggcagacagttgtctttgctcgtgcgtgcacatttgtttgcatgcgcgtgagacccccaggtggt

SEQ ID NO: 47 - DNA, 1033 bp, Homo sapiens
ttccttccacagaatatggtttaatggtttttcagtatatgcagccatcatcatctaagttgagaacatttttgtcacccccaacaagaagccccatgcacatggtccgtcactccccaggccccaaatcccagccagcactgatcttggccattggcctgtcctggtcattccatagaagtagagccacgtgactgtgtgtgtgtctgggccacgcgtggctgtgtgtatgagagccatgcgtgactgtgtccgggtcacacgtgactgtgtgtccgggccacgtgtggctatgtgtccaggccacgtgtgactgtgtgtgtccggcctcagcacagtattttcaaggctccttccttccttttcatgactgaatcatactccattgtctgcacagaccacaatctatcccgtcatttgtctctggatgcttgggtggctgcactttgctgctgtgagcacttgtgcacaagctgtcgtgtggatgtgtgttttcagtaacctgcgtgtacgccgaggactggaattgctgggcgatgtaactgtgttaagcttccgaggacctgccagactgttttccacagcagctaaataattgtacgttcctcttagcaatgcataggggttcctgtgtctccatgtcatcaccaacacttgtccaaactaaaaaattctaggccaggcgctcatgcctgtagtcccagcaatttgggaggccaaggtgggcagattgcatgagttcaggagttcaggaccagccagggcaacaaagtgaaaccttgtctctaggaaaaaaaacaaaaaaaaaaaaacaaaaaattagctgggcatggtggcacatgcttgtagtcccagctactcaggaggctgaggtaggaggattgcttgagccctgggtggttgaggctgcagtgagctgagatcgtgccactacactccagcctgggtgacagagcaagactccgtctcaaaaacaaacaaacccagttctagccatcgttgtgggcgtgagttgacgtctccctgcggtgtg

SEQ ID NO: 48 - DNA, 1007 bp, Homo sapiens
cttgggggccctggaggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgaggtgccaggaagggctgcgtggcgcgggaacggccgggcagcgccgcctccgcttcttccgggctgtcaaggccgcgggcgggcggggccgcgctgagggccgggcggggagggccgtcggggcccgggtggccgcggggaccgtgttcccgacccgcggccctgaggggtacgggtcgcgcctcggggtcgggcccgggacggggtgctggggggtgcggcggagccctggggcctgcgagggtcgggggagcgggagaggggccgggcgggggctgcagccctcgagccacccgggccgcatctcgtccgcatcccctgcttggcatctgggggaagcgggcagtcgcggcccccacagcgctgcgagttgggctgtattccagagtaatgtgccctgtccccatcctgcgtccaggtcagcgcttatctgtaggatttagtgttaagctctggggtgaaggcgttactgacgggctgaagggaaactagttacatcggttttgatcgtattctaaataggcaataaaatcataaattctccaggctgacttagtactggtctgtggccccactgataaaggtatcgttcgtttctctgccaggtgtctcacagcacagagggctgctttcagcctaagtaccttcagtgggcttttgcccttttccctttatgaagagtagagactggccgctagtcctggaagcactttatttttagttgagttgacatttcccaggaagatgcagttatccccgtaagtggataaagggttctcagtaattcagactctcacatggcttctgccgtatgcctgaggtgacggcgacggcggtaacagtgtgtcag

SEQ ID NO: 49 - DNA, 1078 bp, Homo sapiens
cccttggggccagcacaatgtcacagtctcctaggagattgttttgtaatagtcttgcttaagagatgaacctgcttcaggaattattgaaaataaactttggattaattgtagtcacttctttgtgctgatacatagatgatctcttgctattttaactcactcttttagctgttttaaaaattgaaagccaaccctagcagaaggtacattttgtggcagggtcagtacagaagttacaggacctgcttcatgcttttggactcttgtctttctagatttatcagtcctggctagacaagtccacaccctacacggctgtgcgatgggtcgtgacactgggcctgagctttgtctacatgattcgagtttacctgctgcaggtaggtgtgggctgaagtgacgagacttggctctgtccacgttacctgggcgtgatgtttgtggggatgttgttgatccagtctgtcttgcaggaagtggtctctagtaatcaattttcagctaaacgccaaatgtcagaaagatctcagtgactgtctttaacgaacagggttgtttatgattcacccggagtcgcctcgccaggcttctcagtatacccaggccgtcctgagcccagcctggccctgccctgggcacgtccaggcctggacagtggagccgctggtgtccctccgaccctgctgcatgatgctcaggacaaggttgcgctctgtggctgcctcattccttgggtgaagagtccatgccttgggtgtcatgaatgactcggcgtccaaagggtttatgtagcttttcctgagctctcccttgtgtgaggccaaagcacagtgcaggttgagacgccgagtcaagtaagagagacagtgaccgaagggggtcttgagggtttccttcgtgtgttttcgggcacccctaggtcaggtgatgtcgtctcagacttcacctgggtgctcctttacttgctggtaaacacggggtttctaggagcaaacctgtaagatgggaattcttcgtcggtctttagaggaggttacataatcttatgtgcagagcagggcatgttgaaagcctt

SEQ ID NO: 50 - DNA, 1048 bp, Homo sapiens
aaaaggtcaggcagcgcgtccagttcagggagcgtgtccagttgtgtcacgagtgggagacctgggttcagaaccgtccagctgtgtcgggagcaggaggcctgggctcaggaccacctctgggctcctgctgggaccttggagatcagcacctcccggcgctgatgtccagtgggaaggggaagcctctacacagaggctcccacagagaggggattgtgtggagctgtccggagcgccattcagctgggggacggagcttccctggaacatagtgccccgcttgattcttgaagagaggacgtggacagcagaggagacgcaggcctggggacggacagttgggcagcaggcatggcacgggcatgggctgggcgggggccaatgcccccaaagtcaggaagatgcccccaaagttggggccgaggggccacgctcatgcccatcaccccctcctgccctcccctcccgcacagcctctggcatcagaactcgcacccttgtgcactcctgggaagccccgtcctgcttagacctactccgagggcgcgtggagcccgcctccccctggaaggggaaataggaaaaagaaccgtgaaaagctccggagttaaccgtggcggcttgaaggaccttgacctaattggtccagaaaagtcaacatcggcacctagagtgttcagaaagtgaagattaaacttaaagcgattagacaacttatttttcttttccaagacattagctggtcaaaaatgacaaaaatgtccttaagcctagctgaggcagaggcggcaaacaggcggccttttgtttggcagaggggcctgaccacccgaacccgcgtgggacacccgggagcccacctcctgagagcccggcgaggggatcgggccgggtattagccggggattagacggccgagctgctggcctggtaggggagctgccggggagctgccggccacccgcaggctgggcctgggaggccctcctggtccgcgtgctgctgcccccgggtcaggggcttctggaaggtgccacccccgggt

SEQ ID NO: 51 - DNA, 1043 bp, Homo sapiens
cagcctccccctaggtcccccaaggctccctgtgagaacagggtgctccggagcctcctgcccttttccttcctccctttctttcttccttagggaaaataaggattggatgtgaagggagtatgacagaggcatgtggcctctgtatgggcctggtgggcacctgccgtgtgccctggtctctgtgaggctctgtctacactgggaccctcccagctgtgctgtgattaggacacagccaccctcgctctgacaggggaacccggggctgagaaggaaggaatagctcccagcccccaggtttgtccatgcaggggcccagaggcaggtgtgggtcccgctcagtgaccccagcaggagctcactgggggcagccaggctcttgccaggtgggagaggcacaggtgagctccagcaggggcggcagctgggcccagacccggttcctgcccccactaacagcatgtaggtggggcagtctcaactctgcgccttgcaggccgattgcctgggcccagtgcctcatgctcctgcctgaacatggctctgtcctctgcaggtccctgacccagccgggccctggaacttgacttcactacagccgatggccctctctgggcttgggggaattctgtgtcgtaaacatgacctcagccccactttttctcagaagctgctgtccccttgtttgaaagcaggtcccaaatgtagacccatgggcccttgtggggcctgagaatgctggggacacttggcagagagtgaggctcaccgcccggtgcccctgcctgaagctgggattctgcggtggccccagggtgcccgtggcaccagagaggggttcagccaggaaccgcaggggttcctgacccagatggtcagcctgtgagacccccacccaattccaggccacattctctacctactactggctgagagttcccgggggaggtcccaggagtctgcattctgagaagcgatcattgtggggcacttggaggagtccagcccaggaggaggccctgggaaaggggcccgccctg

SEQ ID NO: 52 - DNA, 1066 bp, Homo sapiens
ggtcgggcgtggtggctcatgcctgtaatcccagcactttgggaggccgaggcaggcggatcatgaggtcaggagatcaagaccatcctggctaacacggtgaaaccccatctctactaaaaatacaaaaattagccgggcatggtggcgggcgcctgtagtcccagctactagggaggctgaggcaggagaatggcgtgaacccaggaggcagagcttgcagtgagccgagatggcaccactgcactccagcctgggcgacagagtgcgactccatctcaaaataaataaataaataaataaagtcttcattaaaaaagagttttctggaagtggcacatcgtatgcaaacacatgcacatgcataaggacacacgtgtctgaaaaggctgattggaaatagttttgaatgataatatgccttattgctgagataatggatggtttttttaaatgaacaccgatgggggtgttttacttgttaatacgttaagtgacgcacgtagggctgtgctggcctgcagcaaacactcagtaagtggcgaaggtagtcaatgaacactggtagtacctggcaggccgcggagggctcttcgagttggttggattctaaaatccttgtggtccagggttgtggatcattccttcatgtgtgtgggtgccactggcacagctgaccccagtttctggctctctgccttccaggaacgaggtaggatgagactctctgcccacctggggttgggtggagcatcaggccggtgagtatgagggagggcactgctgctctaggccgggcaccagctgctggtgtggtccctccagagttctctgctctccaacactgcaaccagagagtcccagagagctcctcaagtttttaccacaagcagagctgccctgccaagtcacactgggcttaggaaaaaaataaaagtcacatgtttatttaggaaaaataagactttgttacttggttaagacaatgagttttagaagctgtttgttacattggcataaaccttgctcaccctgactgatctgcttagtgagttccttgtgtctg

SEQ ID NO: 53 - DNA, 1044 bp, Homo sapiens
tcacaccggcccaaggggaggctcgagtcaccctcagcttacccacgaggagggtccaggcaggcgccggaagcagaagatcccagggattccctccaggggctgcagctggggctggggagacatcgcctgggcctcgttcaccatgatgactgtgcctgggcgtggcagcaccctccgtgtgcaaagtcaggccatattgggctcaggcctgggtggtagaggccaccccttgcagctcgccaagggatgatcttagggcacaactggtgagttctgggggccacacagcagccctgtgaggcagctgcctttcttcccctccacataatcatgagaaaactgcattcaagcaggtaaactcaccacccaaggccacataggcagtaagcggcaaatcaggcccccccaagaaagccctgaaacccagaccaactagtgaacaggaggctggggcaagaggggacccagtgaagtgttttgcagcgtagcctgcagccccgcatgctctgggctgtccaggtttctgaggttggaaagagtgtggtccccacaaccagccccaagcaagggacttctgcgtgagccacctccgtgggcctgggatgcgcctctccactgggcctgggatatgcctcccctctccatggtcaggtctggtcccagctgtccctccctcgttagtgcagcaggtgccgtctgtgtgtccctcatccaggcttccttacagggcacccaggatcttccattactaagctgtggccctcaaactctccccatagtatcctccaagccccctgcacttctttgggcccctggttttccagcatcacacacccttcccacctccccatacaactccagggaagacttgcatctcccctgcggtgtacccctcagagaccaccttctgaaaccccactctcaaaaagaaactctttgcttttcaaacagctttagttgtgtgaacccaagcaactacccacaccctggcctagcagggagcactcctgattgtctggattcctgtggttctggggggcc

SEQ ID NO: 54 - DNA, 1020 bp, Homo sapiens
cgcacagggcctggagcggggctgggtggacctcagaccctgaacacctctgggagctcctcggtcagcccagcctgcaggcaaggcgaggaggccccaggctcttcaaaactaacattgggaagtggaaacactttttgtgtctgagactgcatctttttttattctgaattgtcacttggcagggcaccccctcaagaccttctctggtggccttttaagactctggagacaaaatagcccaaatccaggtgtggccgccccatgcagaactctgcctgtgaggtctttgctggaggaggcggcaccacaggccggctggagaggctgtttccaaggagaagcctggagctctgcagcagccctcggggggtcctgccccctctgcctcccttagatgtggacacccagtcccaacagcccctcagcccccgccctgccctcccaggcccacccagaggcgttgtctttcaacgctcatcccacggtcaggaccaacaacggcggcggccccgggcagggattctgttgcccggcagaaagttatttgaccccagcactgatctggttactgatgcagagcgtatcagccgctgcacatggctgccgcccatgacatctgggccagaagctgagccttttcttggaggcggaggttacagtggcagggatgggcacagtggatgatggcgtgcgggtactagaggggatgccaaggcccactcaaagcgccaccactgcacttggcccccacccacctgcaggggagacctcaagagattcacagtaaccccacatgggggtcccagagcctcaggaggcccctcgcctgccccccagcactggctgatgctggcagtgccctgggaagccaaggccactgttacccccattccacagatggggttcagcggcccagagtgtgtgacctcacccacagcacagaaatacaagttcacacaagcaaacaagttggaaaatgctgggttttctcagagaccccttgggaaaaggagcagg

SEQ ID NO: 55 - DNA, 1056 bp, Homo sapiens
ggccttggagattaaatcgggttccccaaagagcaagctgtggagaggggaagggaaagttgcctccctcttccctacggggttcttgtcaataaacgattgacaaaagacagactcacaagagacaacagttttaaggctgtgcccccgcccggaagtgccataaaaacaggagactcagcagtaaccagatgggagcggtgcagatgtccgtcctctgtgacagaaaggaaagggggcctgggcttctggggagcggtagagacaaatgaggagagggtgagggaggaaacgtctgggcataaaggctgcctcgtggtgcagctatcagtctcatggtgagaaaatgcgtcttggcgcgcggctctcttcctggcacacagaccattactaatgaaaatgtcctttatagatgtcaattttctttagaaaagagagttttttactttattttagggagctgaagagctttttttctgttggctggttctcagttgcttttagctcaaagtaatcaacatgtcaacatggcatattttggggtgacgtattctggtctcctacagtcatattttggggtgacgtattctggtctcctacagtcatattttggggtgacgtattctagtctcctacagtcatatttaggggtggcgtattctggtctcctacagtcatattttggggtggcgtattctggtctcctacagtcatattttggggtggcgtattctggtctcctacagtcatattttggggtgacgtattctggtctcctatagtcatatttaggggtggcgtattctggtctcctacagtcatactttggggtgatgtgtcctgagccccattgtttcctagtctgaaacttccccaagaagctccacggtacagaaactgggtgggtgtgttgtcccataatgctttgaagaggcatttctatggaaacaaaagaaaaaaaaaaaaagctaatcattggagctgactaaaaaccagtttctgagcctgggggccgtggcggggcaggtttgtagatgttgggctccgagcatcttc

SEQ ID NO: 56 - DNA, 1107 bp, Homo sapiens
agcctggaaacacccccaggcccacccaatacctggggcagatctttcccttcctgcaggcccgccttcaccttttcccgagcccgtccttgcctggacgccagccctggcccctgtgcctggctctgtgtttctgagaccacttttgatcccaagcccctgcacgcttgctggctggtttgtttactgtcgtcagcatggagggccggggtcgtgtctcgtgccggctgccatcttcctgcacctgggagggtgctaggatgtcaagcctaggaaatgggtgtgaagaggagacctgcctttgcaggagctgaccaaggccagtgcactgggcgggaccatccgtcactcctgagcccactaactggggaggggacaggcagagcggggctgggtgattcctgagcaagcatgctgctgtctctctggctctggggcctctgccctctgcctcgatggccccccacagccgtcctggaccgccttctccacctttgggctcctgctccaatgtccgcttatcaccgagggccatcggaggtggcacgccccgtgactgcctccccctccctgtaccctgcactgcacgtgtcataattcaagttctcggctcagccacccattctcggctcagccactaatgtgtgctggaaggtgtccaggaagccctgctaagcatctgtcagtgtctccagcacagcaggaggctgttacaggtggcgcctgattcacatctgcaggacaggtggatggatgggcagacagatgggcaggggcatgtgtgcaaggacacaggatgtcagggctgacacctgggttgggctctggggtgctggcagcagggttcggagaggggagagaagcgtgtgtgagctgtgccttccccctcgtcttcccgggcactcggcattctgggtgggagggcctggaccagcccgtttccaggtggttaaataaagtctgtgcatcctgttggccacctgcctctcataggcagcagcacagggcctgatggggatacagcctggataccccactggggcctcccgcagacactcagggtccaggctgcccctcgccacaacctggaagggaggggctggtggg

SEQ ID NO: 57 - DNA, 1081 bp, Homo sapiens
tggattgattgatattgaatggatgggtgggtggatggatggttggatggggtgggtggatggatggggttcgtggatggatggggttggtggatggatgcatggatggatattgaatggatgggtaggtggatggatgggtagataataaatgggggagtggatggatggatggatagatgggtgggtggatggatggggttggtggatggatggatggatggatggatgaatagataaatgggttcgatggatggatggatggacggatggatggatggatggggtgggttggtggatggatgaatgagtggacagatatacaaatggcaacaactatagagcagggcatccccctgcctacgtggagccaggaccagacatggagctgggggctgccaccttagtggattggggctgcgtgctgatgctagcccctctccctgctcccccatgtgcaggtggggacggaattcaccaccatcctgtacaacttcatgtgtaacagcagctgtgtagggggcatgaaccggcggcccatcctcatcatcatcaccctggagatgcgggagtgagtcccgggcacacggggtggaggtgggacagggctgggcaggcacggccgggggagaaggggagctgtcatggagacctgcaggccaaggctagcttggggaagagactttggggtgtgctgctggaggaaggaaccgccccctggcctgcagggcctgcctgggcacaagctgggcctccggagggaggtgggagtccccggcgaggtctcagggcagcctcacagctttgagcctctgactccctctagcgggaacactcgctgccggcactgggtgctctgtggtgaccgagggctctcaaggccggtcctgcagggtccgaggtgggtggggaaggtgggcaggttgagggtgggcagggttgagctcacaattctggctgtgcccacccgacagtgggcaggtgctgggccgccggtcctttgagggccgcatctgcgcctgtcctggccgcgaccgaaaagctgatgaggaccactaccgggagcagcaggccctgaacg

SEQ ID NO: 58 - DNA, 1029 bp, Homo sapiens
aatcatgtatctaatacgggacttgcatcagaatatataaagaatccttataacttaatagtaaaaagataacccaattaaacatgggcaaaggttctgaaaagaaagaaatgtctccaaggaagatattcaagtggtcgtaagcacaggaaaaggtgcttgagatcatcagtcgtcagggaactgcaaatcaaaaccacagtgagatgctacttcacacccactaggataacaaccagtgtgggcgaggatgcagagcggctggaaccctcaggccccattgatgggaagggaaaacggtgcagctgctgtggaaaatagtctggcagtttctcaacaattacacagaatcgccatgtgacccagcagctccactcctaggtatgtacccaagagaaatgaaaacacgtccacaccaaaactcgtccgtgagcgtttacagtagctttattcataatagccaaaaggtagaaaccacctaagtctccaatgatgaacacttggatcaatagagtgtggcacatccatacaatggaagtactcaccatgaagaggaatgaaacacagcatggccgagccttgaaaccatgccaagtcaagaagcctgcacatacagtagggttccattcataggaaatacccagaacggggatgttagagagatggaaaatagattagtggttgtttagggttgggggtagggtagaggggagggaggttggtagctaaagagtatgaggtttctttttgaggtggtgaaaatgttctgaaattgactgtggatgtggctgcacaactctgggaatataataaaacccattgtattgtacactttatttattttatttattttttttgagatgaagtcttgctctctccccaggctggagtacagtggcgcgatctcggctcactgcaacctctgcctcctgggttcaagcgattctcttgcctcagcctcccgagtagctggggttacaggcatgcaccactgcgcccagctaatttttgtatttttagtagagacag

SEQ ID NO: 59 - DNA, 1049 bp, Homo sapiens
atgcaatcttggctcactgcaacctccgcctctcaggttcaagtggttctccttcctcagcctcccaagtagctgggattacaggcacctaccaccagggccagctaatttttgtatgtttagtagaaacggggtttcaccatgttggccaggctgttctcgaactcctgacctcaggtgatctgcccgcctcggtctcccaaagtgctgggattacaggcatgagccactgcacctgacctgctgaattgtttataatggcaagaaataggaaaccccccaatgtctgttgaacagctatcacgttgaaccacgtgaaactgctgttttctaggccaaaaatggtgagcgatcatttatttcatgattcaacctgatacatttacatagtgcaaaactgtgtcacagtttcaggcttttatgaggaaagcgtttctgtgtagaaactggaagctgttcagggcatcggcagctgaaccctgctccgttggtcagcgttactatcatctcggatcatatggagctcatgtcagccgtgtgggtggcgggtgcacagagacggtctggaaggaaacacgcggatctgaacagcagtaatcctgggggatacgggggttgggctagattacagagggctcattttctacgtcatgtattttatgatacttgaattttttgaaatgggcatttattttataacatgttaaaatgtactttttaaattaagtcattttgtaatatttgaatttttacatttgttgtacaatcaggaaaagcaataaagatttttcaaaaatagacatgtcaagaaagtttgcactcattgaggatgctgaaaataaggataaaaataaggagtctgtgatattttacaaattgacttcatttacaaattgagtcattttacaaattgacttcaattttacaaattgactacattttcttcacagagctaaagcaataccttagaattaacccagtcctgtgtggggaatttctagaagtcccatctatggtacggtgatgtttatctgctctgatcagggaag

SEQ ID NO: 60 - DNA, 1067 bp, Homo sapiens
tcctatttcccttttttttttttggatggagtttcactcttgttgcccaggctggagtgcaatgatgtgatcttggctaaccacaacctccgcctacttggttcaagccattctccagcctcagcctcccgagtagctgggattacaggcatgcgccaccacgcccggctaattttgtatttttagtagagacagggtttctccatgttggtcaggttggtcttgaactcccgacctcaggtgatctgcctgcctcagcttcccaaagtgctgggattacaggcgtgagccactgcacccggccccccttttttttttttttttttgagatggggtcttgccatgttgcccaagctggttttgaaattcccgggctcaagtgatcctcccgcctcatcctcccaaaatgctgggattacaggtgttagccaccgtgccaagcctctttatcttccattaagtagttcatttctgctatcttgttttgcatgtccaacagctctttctgtaccccgtttcttttgatggcatcctgttgtttcagggacacaatatcttacacctctgaggctaatagtttattttttccttttggaattttctccctgaagtgtttcctcccaattgctttttgcttgtgaaggtctttgtttgtttgagacagtctcgctctgccgcccaggctggagtgcaatggcgccatctcagctctcactgcagcctccacctcccaggttcaatcgattctcctgcctcagcctccagagtagctgggattacaggtgtgtgccaccacgccctctaagcttgtgtaggtttctatcttccaggctgaaggtttttctcagatgtcaggtcacccttgagtatctgctcatattaggagtggggcagggctggagccatgaggcagatcggaagctctgagcacaagggtggtacttccttggaggagatcagggtgggtgggctcttgcttttatggaatgccccgaggtcagttttagatccctttccagtccttcctgggaagcctgtctgtggagcatctgtatgcacactgggtt

SEQ ID NO: 61 - DNA, 1070 bp, Homo sapiens
gctattacaatttttatttttacatttaatggagacaaggttttgctctgttgcccaggctggtctcaaactcctgggctcaatcgatccacccaccctggcctcccaaagtgctggaattataggtgtgagccaccatgcccagcccccaggggctattttatgttttttgtttgtttttgtttttgagttggagtcttgctctgtcaccaggctagagtgcagtagcgtgatctcagctcagtgcaacctctgcctcctgggttcaagtgattcctctgcttcagcctcccaaatagctgggattacaggcacatgccaccacacccggctaattttttgtattttagtagagacggggtttcaccatgatggccatgatggtctcaatctcctgaccttgtgatccacccgccttggcctcccaaagtgctgggattacaggtgtgagccaccatgctcagcctatgttgtttttcattttattttatttttttgagacggagtctcactctgttgccaggctggagtgcagtggcatgagatcggctcactgcaacctccgcctcctgggttcaagcgattctcctgtctcagcctcccgagtagctgggattacaggtgcctgccaccacgcctggctaatatttgtatttttagtagagatggggcttcactatcttggccaggctggtcttgaactcctgaccttgtgatccacctgcctcggcctcccaaagtgctgggactacaggcatgagccactgcgcccagcctgttatttttttttttttttttgagacagtctcactgtgtcgcccaggttggagtgcagtggcatgatcttggctcactgcaacttctgtctcccaggtttaagcgattctcctgcctcagcctcctcagtagctgggactacaggtgcgcaccactacgcccagctaattgttttacttttttttttttttttttttgagatggagtctcccctctgtcgcccaggctggagtgtggtggctccgtctaagctcactacaacctctgcctcccaggttcaagcgattctcctg

SEQ ID NO: 62 - DNA, 1622 bp, Homo sapiens
tcgagtggcagttggaagtgttctcgtcagtagagttaatgggtttcatggaagcccagctgatggcgaggaatgatgggaatttctcttccctccttgagagtatctttccttccagatgacgattcctgggacctcgtgacctgcttctgcatgaagccatttgccggccgccccatgatcgagtgtaatgagtgccacacctggattcacctgtcctgtgcgaaaatccggaaatccaatgttccagaagtgtttgtctgccaaaagtgccgggactccaagtttgacatccgccgttccaaccgctcgcggacgggctcccggaagctgttcctggactgactgctggctggcgaggaggctgcgagcgtggaatcggaagcgaccgcgggcttttttgcccttctcttagttgagcacagaaccctcagctctggtgcgggcagatccctgccatttaggtgcctaagcaaaaggacaggctgtccaaggtagaaactgtacatagccggtgaccgaatgcgacctttgccagccagagctgctgccagagctgcgttccctgcagtggaggtggactggacacccacgtgcagcgggtttggctcatttgaaaatgagggtccgtggtagctgtgcgttttgctatcattgctaagagattcccgctgattgggctcagtgccagctgttattctgcttccactgtgttggggagaggtgttcggtttccccagcctgttaatgaacagccatacgtgtaagctttttcttgagtgttaagtcttttaccaaaagtgtctgtacagcagccatccaagttgcccctacttagtggcttgccctctgcctgcctcagctgctgcctgaccggctgggggaggcactggcgggaggcctcgggctcccctggaagggcgctgggctggcgggtcagctggtggttcttaggtttccttctgtttgttaaaagggacaatgtggccacttctctgtggaaagggagttggttggggggttgagatggcccgtgttcataactcagtttcctgttttgcacgatgtaaaaaccctgtctttttgcacgatacagccaaaagtattggctgatttcttgctgagtgccctcttagttggtgtgtgaggtcttggtgggctcaggccagctgtttgcgagtgtgggaactcataggttctgtctttgtctcttcctttcacctcattctggtagcagcataaaggttaggcaatcactgggacccgcatggtgttcctccaaagaatagggtaaaggagagctgggagggagccctctccgttgggtgactcttgtgtgccctttagacaggctggcctgccggttccacagggtacagttaggacttgagtctttctttttctgttttgagttggtgagtgagtgatagggtaacatgggccttcaggatgaccccttggaactgtgccgagttccttaaatctcagctgggatcctggacctgggaggcccctgtgagggccagctctggaaaaacctgggagttgatgccggaggctgtggaagaactctgctcgagggcagggtgccctggaacactggtagttctggggctgggagg

SEQ ID NO: 63 - DNA, 1062 bp, Homo sapiens
agccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaatttaaatttattaaaaaagatgtacaacaccaaaatgttcatagttattctgtatgacagatctgaggtctttgttcagacatagatgagggttcatagttttggaaaatagacttaaataatatatgattacagatgaaaaatatttgctaacctcagactttttatgtttaaggtagtatttatattcatttagttgtactttctggagttgattaatataactgttattaaaatctatcgattcccagtaattcagtaaatgaagactcttcctatttagaaactcgtgtggattggggagttgctgtgggcccactgtcattgatcatatcacatcttcacttgaacctgctccctgggcctcctataggcctcgcgtttggagaggccgtgaacataatttatttttggaagtttctttcatttttaaagatactgagaggcaagttgaagttcctggtgttcgtgtaaacattccctgccttatcctttccatctcagccattatgaaatgttctggctgaatcatttgctttcacaaagctttgatgaaagtttcttcctcatttggttttcttgatagaggctgttgtgctaaaaagaaagctataacaagttagaagggtggagagtgggcacttaacatttttgaagtacttgtctttcttcctaggggtcctccagaaattgatcatagataacttgaccaaattcaaggcccagagatttcttccaggcattctgggagggaaggaacatcaggctttctgtactgaatctaattattctaaatatttcccactgcagcttgtatgagtgt

SEQ ID NO: 64 - DNA, 1172 bp, Homo sapiens
gtgatcatctcactctggtcgactatgaaagaaggttggttagatccagcagcctgctgatcatttagagggtcttagagtgagaggagattgtgtgagaagctggttatcatagcagggggtcctggcacctcaaactctgtccccatcaaacagtgtaaaagaaaagatattgactcctaaaggagtgtcttatgttcagatgctatagagttttgcagagaaagtgttcagtgtagctacagatagaaggccaagtgtccttggtcagccagcctgggtgtgtgtggagtaagttagtggtaggtgtagtaactgtctcaaagctttttctttgtctctctctctctcttttttttttttgagacaaggtcttattctgtcgcccaggctggagtgcagtagcacaatttcagctcactgaagcctcgacagcctgggctcaagtgatcctcccacctcagccccccaagctgaggacttagctggaaaacacaggcatatgccacaacgcccggctgatttttatgtttttagtagagacaggggtttcattatgttgcctaggctggtcttgaactcttggccagctcaagcaatccacctgcctcagtctctcaaagggctgggattacaggcgtgagccaccgtgcccggccccagaactttttctttgaatagtggagaagcagaacaccttggaatgctatggtctgtgcggtctttgccctgtgggtgttctcaggtggaatcaggcagtttgggtgatgtcagtatcatttgaggtcttccacagttcagctatttgggtgggcttccccacttttccccttgttttgggtcggtaaacataaaaggatggagatgtgtatccttagtaagaatgggagacgttgccttcagaatgggtagaaagcagaaaacaagcggggaagaaaacagaaaacagcctctctttaagtgtatgtggctgcctgtgtgcacagtccttcaccttttccttagtatatccctcctgcctctgatctcttgttgttcttgatttttcatggtagaaggaggaaacaaaattatagaagacaggtggaatactgtgaaagaatagtagtttggagataactatgtaaagggctactagcctgcgcaccgttgaattctctgaatttacagct

SEQ ID NO: 65 - DNA, 1023 bp, Homo sapiens
tttgccacaggtcaacttctgaaggtggtaggccttcacgccacagcggtggcacaatgtgtgtgtcctattgcaacactttccaaacggtcatctcacttctgtggctgagaccagagagacctttttaatttttttttttgagacagagtcgtgctctgttgtcctggctggagtgtagtggcgcaatcataacttaccgcagcctcgaccttccgggctcaagctatcctcccacctcagccttctgagtagctgggtctataggcgtgtgccacgcccagctaatttatacattgtttttggagatggaatctcgctcgccatgttgcccaggctggtcttgaactcctgggctcaagcagtcttcctgcctcagcctcccaaagtgctgggattatgggtgggagctcccgcccacactcggccaattcagtagtttttaatacatctacaaagttgtgtagccatcgccactacctaagttcagaacatttttcatcaccccgcagccttctggactgagtggagtcagcatgctcaggggttggcagcatctgttcagggggctcgaggttcttctttggtgtcttttcaagtttctatacctgtccagtactgaagctggaattggagattgaccttttgtccaagtcataacttaatatgctatttcctgaaactgcttttaagaaatgttaaggtgcaaatgaggatccagtttgggcccacatttttctaagttggatgaagagcagttgagtggagtttctagttgcactcgagactctgtactgtgcagacagtttattggtggagttgcctcaggataaaaatacccagctcttctcagtagtgggtgggagactttgggtgatggtgatttccgtaaaggagaagctgagcctggttggaaggaaaaaggaagaatatacggagaggctggcattctttagctgagtggatttaggcttgagctggagtcagaatcacctgggaggcttgttcaaacacagattgctg

SEQ ID NO: 66 - DNA, 1027 bp, Homo sapiens
ttttccttgaggatagttttattagtatgagagtaacttaaccatcctcattgtgcagttcttccgcctcagtctcccaggtagctgggattacaggcacgcaccaccatgccctgctaattttagtatttttagtagaggcagggtttcaccatgttggccaggctggtctcaaagtcctgatctcaggtgatccacctgcctcagcttcccaaagtgctgggattataggcatgagccactgcgcccggccccaaacttttttataattctctatgacattgacatactcccacaacagcttcagtataatttagatgcccttatacatctgcgtggccaaattaaaaaagacaccatcaggtgtcagcaagaaacagagcagggggagctttcatgtactgctgatgggaatctacattagtttaaccactttgggaaactagaattatctatgagagtggaagatttgcacaccataaagcccagcagttctactccttatgtatattcttgacagactgtatagctgtgaaaactaatgaattgatgaatattcaagaagtgagtaactctcacaaacataatgttgagagaaagaaaccagacactcagaatatatattgtttgattctgtatacaggttcaaaacaaaggcaaaattaatttatggtgttgcaagtcaggagatgtagttacctttggagagtagggaggatatattagcagggcttctggggtgttggtaatgttctttcttgatgacaggtgtgatacacatgcacacatacacacaaatatatttacaatttgtgctgtttcctgtttgtatataatattttaataaaaagttcactgaaatggggctgggcacagtggctcgcgccagtaatcccagcactttgggaggctgaggcaggcagatgctggagcccaggagttcaagaccagcctgggcaacatgacaaaaccattgcattacaaaaaaaaaaaaaaaaaaaatgcaaaaattagcccagcatagagg

SEQ ID NO: 67 - DNA, 1034 bp, Homo sapiens
cagattcagggaagggaatcctgagaaaattctagcctaaccaaattgagttaaaagctgcaatagtgatggttgcacaactctgtgcatatattaaaaaatatactttaagtgagtggactttatgatttgtgaattatatctcaataaagctgttatttacttaaacaaaactgccacatgttgaaaactttaaagaaacaatgttaccatggatgatttaagtgctgcttcttggagatatggaagtttcagtttagtaattgcttcttagcaggttgtatctatgttactctacactgctattctttggaaagctagagcgtagtaactaagatctgtttgttaatgacagacctcaaggtctcctgacaggtctgggaataagttttgaaaataggttaatgggatattgtattagtccgttctcatgctcctagtaaagacatacctgagactggataatttataaaggaaagaggtttaatggactcacaattccacatggctggggaggcctcacaatcatggcagaaggcaaaggagaagcaaaggcatgtcatacatggcagacgagagaatgtgcaggggaactcccgtttataaaaccatcagatctcttgagactcattcactaccatgagaacaatatgggggaaacagtccccatgattcaattatctccacctggccccgcccttgacacatgggaattattacagttcaaggtgagatttgggtggggacacagccaaaccatataagatacattttctcacttttcaccatgtatatttggttttaaaatttgaactaggatttctttacttatacttaaaagtaggttttacagattcattaaaactttcatatcaaatctgttttgataatctgagatattctcatcatctcaaactattggaaaatgcccttatctactctccatttacgtggagccacttttcatttgaatgtttgttatggctctttttattctctttataaggagacaattgcccaaataaagatatgca

SEQ ID NO: 68 - DNA, 1046 bp, Homo sapiens
aagaagtgggattggcacttctagatggatatatgggttgtgtttaactgctttgaatgttagtaagggaaaagtatccacttactattgttcatttcttttttcccagccttaagagccaaaatgattttctgcccacaaacgtcttggttttctttttctagcctgtcttttcatggctaagatatttgcagaaatttctggctagccaccagtccataactttttctcttctttgcagacactgtgtttagtggtatctgaaaaaccctacgaatccaaagttgtttaccctacgaaagttgagattccagttcatttgctaacctgcagtttcttatttcttgtcttggtacttcagttggctcattaaatatttcttaaaattggttgaggagcttaaatatttgttaaaattgtaatgtgtcctgatttagaggaaactaattattatgtacatcttactagatccatctgttgcccattcctcagatacagtgatagaaggagagagaaattctgggccgggcacggtggctcaaacctgtaatctcagcactctgggaggccgaggcaggcagatcacgaggtcaggagatcgagaccatcctggctaacacggtgaaaccccgtctctactaaaaatagaaaaaattagctgggcatggtggcgggtgcctgtagtcccagctactcgggaggctgaggcaggagaatggtgtgaacccaggaggcggagcttgcagtgagctgagatcgcaccactatactccagcctgggtgacagagcaagagcccatctccaaaaataaacaaacaaacaaaaggagatagaaattctgtctccaggcagataagttatagttcatagagtgtgagagaatgggctcataatggaacagttatcctgggtggagttggtgcttcgtgatggtacagatgctttccagggatatgctcaggaaagatactggaaagagattttcctaagtctcatctcaaatgagctttgctttgcttcaactggcctaactcagcaggcccag

SEQ ID NO: 69 - DNA, 1137 bp, Homo sapiens
cagccacccttggttcattttctacacgaggccccacacggccccggagctggagcttctaccgaagggttgccctctgtccccttctcggcttcctctgcagaggggctcagagccagtccagtcagacctgcgaggcctgggctgtggctgctgtggctttgccagcatctattgtctaagagggctggggaagctcactgtttgaaacacacacacacaacagaacataaatcagaggcagaatcttttaacatttacagttttaagtgaaattcctgttgagagtctcttaagctagatttatatctgattttgcattgaactgtgtcgttatgtggggctgagaaactcttacgaaattaagcataatgcgaaaacatgctgaaaagacagttctgtagaaatgtgaaacattattatgttatagaatattggagtgaagaaatacgcataaaggcacaattaccatggacattttccttttaatgatccttgtacaatccttggcagaaaggtttgctgacgtctcctcgtagataaaggaaaattgagacgatattgatattctacatccgttttgaattccaaagaatatcaggagagcgaaccagtctgtcttcatattcaaaacagcaaggcctagactatctcgataccttgggaggatctgtcattagtgtttggggatttgactgaagcctccacactatggacagaccaagtggtggcaataatgtgtgcaggggttaacgtctgaatgctctgatctggaagcttctagaagctcctagaatgggttgaggttgttggatgcttgtccctggagagtttttagggtttaaagcatctgtctagaatgtcttgagagtgtccttggggatagggtgatagaggtgcttgcttgtgctaaggtttgttccaggataccctgttcagctttgttttccacaggagaattcccctcctccagcctctgacttctgctgccctggcttagggctaaggggatattgatcatggcccctgggattttatctttcctttcagtctccagaatgactcccaaagcagatgctgcttctcttgcctcctcgtcccccttccctgggctgccctggcaccatagcctgggta

SEQ ID NO: 70 - DNA, 1084 bp, Homo sapiens
ccgaaaacatacagaagaatgcttgttattggcaagaaatcctgttgttattaagttactctgcgatctctcttctgggctaattggtgggtagagtgggcaggatgaggaagagggcttaggagaggcctcttgatgccagactagacaagactgaatttctacctttggagaatcagggcatctgatataacaatacaacagtaacaaaggattcagctgctgttaatgggagacttccttgcagactttctcacctggggtttcataagagaattaagccgtacagaaaatgatgtgcgtggccttttctcagtccttctgaggatggtgcatagctagtaccattctgatgcacagcagagaagttagtttgtcaccatggatacctgtgggccaagttagggctgaactcccccaaggaaccctcatgagaacctttcgaccaactgtcacatttaatccttacaaccaccccgagataggtataattattatcaccattctacagatgaggaaaccgaggctgagtaactggctcaagatcacacagatggcaaatggaggaatgaggaccagaactcagatctgtctaacttggtgttagttatctgttcctctgtaacaaattaccccacactgagtggcataacacaacacatgatccttatctcacagtttctgagggtcaggaacccaggcctggcttagctgtgttctctgcttcaatgtccctcatgaagctgcagtcaaagtgtcagttgaggctacggtctcataggaaggcttggctaaggcaggactggtgtccaagctcacataggcctggcagggttcaattcctcacaggttgttggacaggggcctcagttccgtgctggctgtgggtggagaccacctttagttcctggacatgtgggcccttcaaggtggctgcttgcttcatcagagccagcaggggagagagagcctgctagcaagatggacgttcctgctggccgtatgtgaacaaatcacagaagtactatcccattgcctttgccgttctgttggtgagaagcaaagctcacattctgcccacatt

SEQ ID NO: 71 - DNA, 1026 bp, Homo sapiens
tgaggcctcattcaatacatcaaagtcccgctcacatgccaaagcccctcccacacattgacctgcctctcttcctgagaagtccctcctgaggaaaaggcttgaacacttaaaagaacaaggaggtccgttctcttttctgtatagcttttgttcctctctctgtgctcagggctgccagaactggtgcagagtgtagggccataggaaatatccctcactatttctccccaccatgctctatctctgccactatttttaaaatgctcttttaaagggtttgtcaacagttatcccccgtttgtctctgccctgatttatatttctagtgactattaattgcctaccaaatgaaggctcagcatttgtaattaggctggcaaattctacctgacatcttcggctctgtgttggggcaggaagggagcatgtgttaatggtgttgaactaagccacacccctcccccagcccgctgattaaccccaggttcactaatcaatgaagtctaactgattctctttgcatttacatcctgccttgactcttagccaagggctgagggctttggttccaaaatgctttctatgcccagagaggatgcctctctgccttgttcctgcagaaggaactctcaccctgaatgggtagggtgggggttccgtaaagagctagagggagaagggcacttgcggagtagccaagctgcagagagctccctgtagctgttctggagaatgaagccctcctcagcctcctttataaaaagtctgccataattcagctgaacacaacatggtaccaagaagccacaacctcagggatttccttggttttctgttctgttaatcttttcaaaacacgattggattggaagcatccattctcagccacagcaggttgcttggcagtggccgtggaggagctgtccaggatgctggctgtgtgaaccagggaacagcccaggattcatgtatacttattggcacaattggtgccctaagtgaggaacaccagtaccaacatcc

SEQ ID NO: 72 - DNA, 1030 bp, Homo sapiens
atcagacttttttgtagaaactggcaagctatttttaaaatttacatatagcataagaatgaccaagaatagctaaaaggatttataaaaatcaaagtaaagttaaaagaattgccctacttaatttcaatacttaatctaaagctacagtaatcaagatgatgtgatactggtatcactgagttgatattccaaagaggtagatttcagggttcagtttctgaactttctgaggagccaaactagagaactaaattaatctttccaagcaatggtgtgtgtgtgtgtgtgtgtgtgtgtgtgtgtgtgtaagagagagagactcattctcattctcattctcatttttgaattaacttacagataaactgagtttcccaagaaggccctccatggcagactatatatcatctcctctctatctcccccttctcagaataaaagcagttttttcttctttatggtttgaaaatgaatttatatttattgtagaagacttcagatagtagataaagacaaggaagacattgatataatggcctatgatgtccatctttctgaatgcttttcacatacacacacatacacacactttttttttttactaaaataaggggttatatcatatatgctattttgtatttttttacttgactccatgttaagtgatttacatatttttaaatgactctgtgtgatatcatatacttaacctgttcactgacattagacattgagactattactactatttgccattagaaatcacaccgtgagaaagatccttgtatctttatttatagtaagccctcaacaaatatttatttgaggagttactaggtaccaggcttttcatacctgaacaattgttttctggagaatattcctagaaatgaaatagtagtgctgggttaaacgatataactgcctaaaaattagctccatatggctacatcatccttcagaaaggctgtgttaatttacaactgctctagggatgtttgagaagtcctgctgattaacaaacatg

SEQ ID NO: 73 - DNA, 1049 bp, Homo sapiens
atttgaggaagtgctagaatgcttcccaagctccctgcttatagggtaagaccctcctgtcccaagtatgacatccctggggttagtaaaagtctatgaccttaagaagaggtttctgcagaagcagcttggctctggctgtgcactgctgagtgtaatggtggcaggatgctaagggtgggcccagggtgccacgtggatgtcagaaagagcaaccaagggcaagcccttcttggagaggcagcattataattgccatgtggcaccggtttgcagtcactgttcaggtaattgctttgtaattgactgcatcaccttcttcctgtttaataaatagcacaaatgaaaccaacccgccagtggtgggattgtaattcaaattccattgactatagttgcgcatttttcatttagcatgtaaaggcagtttctatgtaaattatttcaaaaggttctccatggactaatgacattagcgtctggaaggataggaattgtcatagtaattgataggacaatggcgtggtgcatcatggagaaagaaattggcgctgtaacttgtacactttttaaaaataaagccaaattaggagagaactgctgaaaaacaaaaacacatatttcataaacaagaatccaaaatgtgacacatttgttttgacttaaagagccaaattatttacaaacacagaattaattattccattgatgaactttctgcagaaaaattatgagcactggcaaatatggacatattctctttttattcacccaaccagccactttacctaaacaaagggtacctctatgtctagttcccctactggcagcagaaattatattaaagacattcgttcagtttgaaaaacacagacttgtaactttttttctttataactggcagaatattaattctgcaaaccaattcaagaatctctttgaaatgtggccttttgggtttcaaggttgtaggtatatatttaataaattgagttgctttacagttaatatgtcaaaggcctggtctgccacatggagaaaataaaagt

SEQ ID NO: 74 - DNA, 1049 bp, Homo sapiens
actatcccagcacccatcccctgcctcccacctgtgtcccccacactgagcacccctcattggcaggaacagtggatgccggattctctctgtgtcctagagccccaggagggtccccaggagcaggagccacagagagatgttgttttgcagagagtcctcctgcccctatacccgccaggtcccctgagaccctctatgtccctgaacccctgggtgcacagtcacatagttgcaggtttggatgagacctggtgttaccttttattttgttaatcttaccctctcttattccagaaagaactcaaggtggaaaagtgtagcctctccgtttctgcgatatcactgctagaagccagccgtgtggcctttgaaaagctcctgtgaggagccacttgtttagcctgttcctttaccgggaagttccaactgttagaaaatttcatttttttttcttttcactgagtcacaatctgtctgccaggacttctaacttcatattgaactgttagtacagaatggtcaggtatttttaataaaaggaagtcatatggtgtgtgtgtgtgtgtatgtgtgtgtatgagcatctgggtacctgtgtatatgcacaacacatatgcaccatgctttgtacaaaagagagcacttcttggatttgggtctctgtccctccacattctgccaggatccttttaactcccgtaggggatgagaagggagttgctgctgtttaaagatcaaatctgctttgtagcctgtgttccttacacgtggcccaagcttccagggcttcccggtagggcacttctctgccccagcagctgcccatgggtcctctaggcccatcacgggtggggcgcattcctgctttggcactctgaggtccctcctgagcattttggtggtggcagacctcagcgtcgtaggaaacctaggaattgtggggactaggcagcgtgacccccaggacttgacagagacagggccatctgccaaagtgagcattttctcagggagagcatccatggcctcacgcttttcccaggcac

SEQ ID NO: 75 - DNA, 1035 bp, Homo sapiens
ggagtccagacccagcctggggaagtcctgggctgagcgtgcacctctcttctttactgttgcacccctgccccacccgggctctgacctctccctgaagcttctacgccagtagtgtggcttgggctcacagtgtcaagaacagccaggtcttcctgggttgaggctgccaggcttagccgtcctcctatcctaaatccctccccaacctcccttaatctccagccaccgccagagcccatccttgcccttcagaagctgctctccttcgtgcaatatgggtgaggccattgcaggtcctttaggggacagcacagacctgcttgatgccaataagcacaaatctaggtaagactgaaaatgttggtgagatttttgtgagtatccttgctgtatgtgtttagttttttgtttgttgtttagttaaactagcatgcagtttctttttcaaaagctcaaaagtatccacatcctaccccaccgtctagtcgagctgcacgtctttcctgggctgggtctgttgcaggctgatcactgagcagctgcggacgtagtgggcccgtgattgggcatctcgcgttattacgtagccttgcccgtgaacacgtctctgtgtttctcaatcaacttcatcaccgtcagtgttaataattacaatcgccacagtgatggagccccgtgccagcgctgccatgagtgctttgtgtgtaggagctaatttgatacccacagcagccttggagccccatgtgctcttattaccctgtcgcacagaagtgatgcacagagagatgagacacgtggcttccggttgcagagctagtcggcaataggaccaggatctgaacccaaaacagccatctagagccgcccgcatagccaccatcctacaatgcttctccctttcaatggctgcaccctggtggagcaaaggggccaggccccattgaagtggccctgggccaaccaggtagtgcttccacagtgcctttactcagagctctgtcaccaacctggtgtcaccgtagaagctcc

SEQ ID NO: 76 - DNA, 1026 bp, Homo sapiens
tttggcccaggtcatatggctaaggggcgcttggtgtcccgcacttctggagatacaattaacatatggtaaaaattccgactttctgtggccattctgagagctttggcaaatgtatgtggtttccatcagcttggtccagtgatcaccaccacaatcaatatggagatggtttctatcagctcaaaaactcactgcacctctttgtcagataagctgctcggcgtactccagcctctgggaatgaatggcctgttttcagtccctatagcattgccttttccagaatgtcatataaatgaaatcatacaggatgtggccttttgagtctggcttctttcgccagacataatgatcctgagatttatccatgtagttgcatgtatcagtacttccttcctttttatgggtgagtggtgttccatggtgtggatatacagcaatttgtttaaccattcacctattgaaggatgtctgggctgtttccagttgacattacatgccaaggactctacacatttgcatacaggttttggtgtcatcatacatttttatttctcttgggaaaatatatagaggtaagattgccaggtcgtatagtaaatctgtttaacttaatgagaaactacccaactgtgttccaaagagactactactttgcattcccatcaggaatatataagagttttagttggctgggcactgtggctcatgcctgtaattccaacactttgggaggccaaggtgagaggattgcttgaggccaggagtttgagaccctccaaacctcaacatggtgagacccccatcttttttttttttttttgagtcagttttgctcttgttacccaggctggaacgcaatggtgcaatctcagctcaccgcaacctccacctcccaggttcaagtgattctcctgcctcagcctcaggagtagctgggattacaggcatgtgccaccacacccagctgattttgtatttttagtagagtccgggtttctccatgttggtcaggctggtccc

SEQ ID NO: 77 - DNA, 1003 bp, Homo sapiens
ccaaagctgtcatgttgcagctcggataaggtgaaatgggtccttggccaagttcaacagtctgggcctgcagtggggaagccatccctgtccctaaaaaccgctccactctgacataaagataataatgtgtgggtttgtcatggtggcgctcatcctcccagaacgctgtcttctagccagcagttgaggggacaagaagggagtgtccctgcatagggagggagggaggcaggatggacttggcttcacttccaggggggctcggggaatccaatctgtgcccttagacctgagagcactgcttatttacttttgggagaacttgaatgtatctgagaattggaccaaagctgagaacctagtccccataaacaaagtgtacaccggctcactattctcacgtttgtaaggtctcaaagagcccacagaccccaggccaagaggccttgatccaggactgtggggaagacttcctgctctgagaagaggctcagagaaggtgcactgcccaaagctcagggaagacagagcgaggcttgcaggtggcccttccatggtgccctgaggagaggccgcacagttccctgggggccagcggggctcttggcattatggtctgggtgctcaggtggcacctagaccctgggaaagaggccctggcagtcccctagcccatgtcagtcatcctctgtgaatggcgatgggggcaggaaggacagtcctctaggagtttgtctggggtggacgctgcaaggccagggtccttcagagcagcctccatggcagataaagggagagtgtgaatgaggctgccaggtgggaagctatgggtcggggtgtctaaagagccaggcacttcttgctgtcagaggagagtcagagggggcaggagcaatcccccctccaccatactgccccttctctatgactcaaagacgtcaggcatggctgctacccaccgagagcccttctgggactggcagggtccatccacctcact

SEQ ID NO: 78 - DNA, 1050 bp, Homo sapiens
ttcaggatttcatgttcttcatttctccaccccaagacaagaggaatgctagggaactgtcctgcaaaacccacacagaaaagaggaagggactgaggtggtcacacccacaagagaccacagaaggccagcagaatgtcacagacctgttttccactccccacaggccagaagaaggggctcactgggaagaaatgttgcatatttttagacaaatggaaggaagccctgtctgccagcaaagggagtcacacaggagaccctgagagggctcttgtttgtaaaatgggcatagctctattgttatttctcattatgaaaataatccatgcccatgtttaaaaatctaatcattaaaaaaaggtagaatggtaataaaaatcgtgtgaaatcccaccttccaaagatagtaactcttcagattttagtgtctgaacttctgagctctttctgggcagatattagccactgctatcttgtaatctactttttttgctgacatgagcatcttttcaagctgatggacatagatctgcataatcctttctcgtggccacgttatattccattctccaaatactccatcacttatctagccagtccgtgagcgtgggatgtttggattattcctaattactcatcattaataaccaggatccttctaattatccttttcatgttggtctggttatacccttgggataaatccctagagatgggattgctgggtcacaggggaacctcacaggagagttccacttctacctgcaaccttggccaaggactttaatttccctaaagctgttccccaacctgtgaaatgggtacacgaatcctgttctgataatggcaaggattgcaggacctggcacagaacctggcatttagtaggttctactaaatgttagctccttttctgagtagttgctgctaactctcctttcacaaagtgctttggtatatatcatctctttaatgttatgattccaaaggaaggaaaaagtaaaacagatatgaagtctcaagaagggttggggaaattcctgggtg

SEQ ID NO: 79 - DNA, 1033 bp, Homo sapiens
tatcaatggtattgtgtttgtgattgtggtggccacatatttatgatgaacatatagaaatgcaatcaatttttctgtgttgatcttgtatcctccagctttactggattcactaattagttctagattttttttgtagatttcttggaattttctatttaggcaatcatgtcatctgtacagacagttgtatttcttcctgtcccatcagtgtggcttttacgtctttctcctgctttactgcctcagaacttcctgtactgtgttgggtgagggcggtgcaagcagacatccttgccccattcctcatctgtggaagagcactcagtcttccaccattaaattgatgtgagccagagggattttgtagatgctttttatcaagctgagataatttcctgctattcctgacttgctgagagcagttccctcatttgttaaactttgctgcccctgaaatcagaaactttgggacccaccagtttgtaccatacccaggactgcttttcattcacatcctgcccctcacaggatcctggagggcccggtgggtaaggggtccacagcctcccgctcaggtttttgactcgcaatcctgtcctctaccccaccgatccctctccccttggctgagccttctgtcctgtgccatgttcccggcccctcaggaaaaggaaccctgacaaaccagtgtggaccattcacacattcacatatccactcattcattcattcattcagcaaggcctgcaccctgtggtacagaaatcaagggctgcagacctgcccttgagaaatgcagtctaacacccaaactccacccgcccccgcgtcggcccccgtcgcgctgcatgagacttgcatcccctctccagggggctggccagggctggctgaggctccaggagttgctctgctctaccattttccttttccaggaaatgtgtatcccagacagcccccagcacccactcttctccgggccgccctgcagcagggtgggagcagtgtggtggtcctcaggcccccatct

SEQ ID NO: 80 - DNA, 1034 bp, Homo sapiens
taagatggcacttgttgggcagcaatgtgtgacactccctctagaggctcagatcaattctcgtgcttttatcttttcttgaggctcagcatgatgaaaagtggcctatatctacagctgataaataaccagaaacttgctgtatctgttttcattttattttcttgaacaattaccgccagcatgccttacattcagaggctgagattttaagtggccaaaagaacttcccaactgagcctgccagggactcgtttgaaatgttctttgctgcatcgaaaagcaccagacatgatctgtgaaagagctgggaggaaaatgttgcatgttcacagcacaagcgtgtcctcctctccaggggatgggaacatggaggatggttcccacctccaacctcaaaccctaggagaggcctgtcccactgatgagagaggacagcgccagcccaggagccatccaaaggatcatcagggtgaggaggggtttggagcccctgggatggctggggaggaaatggggagtgtggagctgcaggatccttagatgctgtctacattcctctagttgagcactcaagtcattgtgtgaccctagtcacatgtctgcctcagcaccaggagagttagctccttgaagccaggaactgcttcttttaatactcagagtggtatcagcatttaacaacaggtgctcaatacatgttaaatagaagggaggacggatgcatggatggttggatgggtggatggatggaggagtaggtgggtagatggaaggatggatggatggatggatggatggatggatggatggttagatgggtggttggatggaatgatgagtggatggatggatgggtaggtggatggatggaagataggtggatgggcagctggatggatgggtgaatgggtgggtagctggatggatggatggatggatgggtgtgtggatggttggatggaatggtaggtgggtggatggatggatgggtcaatggatagatggaagataggtggatgggtagatggatg

SEQ ID NO: 81 - DNA, 1025 bp, Homo sapiens
ctggatgggcgttggtattcaggatgtcgagccccactggtctgggggaccagttggcgcttcctgcaaaggcatgtgctctgggaagggcctggcctgctgcagcagctctgcagaggggccggccccagacttgcctatgtcattagtatagcaggtcccgttattacccgaggaggcttacaggttatcagcgagctccaggagccactggagaaaggaagaagataaagaaggatttaaaaagaaaataacaaaaagaaaaactgtattttctaatccaaaccttgccctgcagtggctttgttaacccccagtcactccttcaagacataaactgttgagagccacaattacttcagtgattacacgttatcttgtcctaccaaggtattaaagaggaactggggaacacattaaaaaaacatacagcccaatttaatcatgattccctctaaaacaattgctggaatctcaccattacagatgccagagcataaaaatcctgtagatgcttgatggaccgggcacaattcatcctctgctgcctccacggccagcccatttgtcagtcaagggagagctttggggtttaggtctttaacaggattgagtgcaggggctccccaggtgctcctccagagcagaggaagggtggccccatcccaacctcccagatttccctgcttggatcacctgccctgccatcactaccaccaggaagacactaaacagaaagcccaccaaacatctcgggaccctactcatagtcaaggttgtgaagaagtttgctggccgggaagcagccttgttctgaatgccacttgtggtgaacagcaaccagctctgcttttctgcaaattctctctgcaaagcgagggaggtgtaatcatttgcttcagaaggttctgaacatcaggaagaggcaaagctgagagacagcagagggtgggggtcgggtgcagctccctgtcctcactctctacctgtctgctgcgtgacgttcaactcagagtctctcttgc

SEQ ID NO: 82 - DNA, 1049 bp, Homo sapiens
ccttaagccctgggagctccttttccccttggggagaagcgggtgaccatgcctgtgttgggggcatcccgcaagctgtgagggggcaacgcgtgttgggcgtgaaggagggagagggcagtggctgtggtgcgaggtcagggatgttgggctggagggaatttgacctcatgcccgtggttcccagttacacacatatcagcttatgtgtaggtcagagtttctcaaccaggggtgatcttgccccctaggggacactgggcaatgtctgaagacttctccaggggtcacagccggagggggaggggcctaatgacatctagtgggtagaggccagcgagtctgctaatatcccacatgcgccggacagcccccaccacagaaccatctggctgcaaccgtcagcagtgtgaggtcaagagagccgggtgtctggggcctcagtctctgcctgcacctgcggggttgggggcggccctgaccctggtgggctccatgccaccctcatgctgccagtctctgctctccccacagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgtgtgagtggccttggccggcctggcgcccccacgctgggaaccaggctggcatcaaccaggcggggccaggaaggtcctctgtggccttggggatgcgggtccggagccccatcttgctggaatgacagtggcaccgtgagcttagcttttgccccaccttcacttggccccttgtaagctccctatacaacagccagggcacaaaatgccaggcccacgtgacagatgaaaagagtgaggtttggagacacagagcatgtagaggaagaagcaggccaagagtgggccaggaccgggtctccggggccacagacaggagtggaggccggctggggagggaaagtatggaacaggggagggg

SEQ ID NO: 83 - DNA, 1046 bp, Homo sapiens
gctggagtgcagcagcatgattgaagctcactgtggcctccaccttctgggctcacgtgatccccccatctcagcctccagagtagctgggactacaggctcatgccaccgtgcccagctaatttttttatgttttgttgagatagggtcttactatgtggcccaggctggtctccaactcctgagttcaagtgatcctcctgcctcagcctcaaagtgctgggattacaggcatgagacactgtgcccagctaatattcttaagtcattttatccattaggacctattttattagcccctaataataaagataaaatattggacagatattttatccagaatccagctatttattttaaaatatgtacatttcattctactaagttgggaaggacttatttacctatatgttttccagattttgtagcactatgaaaaacattataattaataaacttgtgagttctggaacagaagtctctcatgtagaatccagtattcagaaaaatacatatttttggaacgtcttgggctttaactctcacaagttagcaagacagttagcaccgtctgtgcagatggtccccctagagttagttctgagagccaagccttgccaatagcagtcctaaataatgtatggagaatgagcttggcacaactaatgaggatccagcaatcccaccactgcgtctgtagccaaaggaaatgaaattaggatgtcagagagagatctgcactcctgtgtttattgcaacactgttcacaataaccaggatacggtagcaccctgagtgtccatctgtggatgaatgtgtaaggaaaatgtggtctgtgtctacagtggagtactattcagccataaaacagaatgaaatcctgccattgccaacatcagagctgaatatggacagcattctgtgaagtgaagtaagccaggcacagaaagacaaatgccacatgatctcactcctaggcagagtcttaaaaagttgatctcatggcagtggacaatagaatagtcattaccagaggctgggaatgg

SEQ ID NO: 84 - DNA, 1028 bp, Homo sapiens
agaatcacatcttctttcatgacactgtggttaatactttccagatagattttgttttcaagaaaattaccttaacaccactcttctttaggccacttcagacaaaccagaatgtctgcaagttaagtcgtgctagactttttcctcctttcttctagtctgatcctcaaactttgaatgaatgtgtgggtaacgtgggagcaaaattgcataaagtcctacactcatctcccttttgtttttgccaaagctgtgtcccgtgtttactttgggagagttaagagaatgagatatttaaacaaaacataaattcatgaaaggttgcccccacaaagtaagctgaacaaaggagtcctttcacttttgtttttagagttctctttctgtaaactggtagaggaaaatttcatgaagatttttgccttaagtataaattttaactgttaataaccttataagatggataacaagaaggttcattatgaagagaacatcagatacgggctctggattcctgtgcattaattggaatgaaataaaaaatgttattggctctttacttgaccatttacagtttagatgttagaaaaataggcaaattttaatagcctctgtaataagatcagtattcacttcccatttctatatattcaattaatatgttcaatcttgaagaaatcctaaaaatctatcctggaagtttgttttaaactgatattttctttaggatgtgtgtaatcctattttcattctgggttgagttatttaatgttattttaaaagaaactattcatgtctgttgtccttagaagcattaaaatcttattaagatagaaaaccttggccaggtgcggtggctcacgcctgtaatctcagtactttgggaggccgaggcaggcagatcacttgaggtcaggagtttgagaccagcctggccgacatggtgaaaccctgtctctactaaagatacaaaaaattagctgggcgtggtggtacgcacctgtaatcccagctacttgggaggctgg

SEQ ID NO: 85 - DNA, 1050 bp, Homo sapiens
agaaaacaaaaatcccctccaaaaaattacaagttaattgcgaaagaccacatttaaatttttgcccatgaaattcagtttagtcgtttctctgaaacagtgcttcaaaaaagactgtttccccgcattgtgtgaaatgcaggagacccacgtacttgtatttttaaaaaacccatttgcaacatactattaaagttggatttaagagaacatggtagaagaaaatctaagcaatactacaccttttagcaccctcattatgttttcatctcagagcaattaaaactgctatacaaatcaacgttaagataactaaactgctgcttttttcgtattcagttgtctatgaaaaccgtttccctaggaagtacttactctgcttgaaaatgctcctaaactttaaattttggggtatctcagggttgcaatgaaagttttttgaaatctttttttttttttttttttaaggcttgtaaacatataacataaaaatggcttccaaaagagctctggtcatcctggctaaaggagcagaggaaatggagacggtcatccctgtagatgtcatgaggcgagctggggtaagtcccacatcgatttttagccattcctgttttaaatgtttttggatttttaaatcattttgaataaaatattcaaagtgctctatgaaatatttcaaatatacacaaaatttcagagatgacataagaataaatacctgttgatccactgctcacatttaacgcttgttaatgtcttgccatatttccttcagacccatttctcttttgttttgagctctgtcgtccaggctggagtgcgatggcaggatcttggctcatttcggtctctgcctcctgggcccaaaccatcttcccacctcagcctcccaaatagctgagactacagatgcgtgccaccacacctggctaatttttgtatgttttgtagagacagggttttgccatgttgcccaggctgctctccaactcctgagctcaagttgtccacccgcctcaggcctcccaaagtgttaggactacaggc

SEQ ID NO: 86 - DNA, 1116 bp, Homo sapiens
aaatgtttgagaaccgtggcattaggggctgggaagaaccacagaggttgaccaccctggcaggtcttgtacgtgggcttactacaagagtcaccactagccttttgacctgccctgaggctcaggtaattatctctgccaaagggcactgcagtcactgcagcccaagcagctgctcccctctttggagagaaagtcacagatccttgagtttggttttctttggctctgctgctgtgaagcaagcctcagtcctagattctttgaccaaaggaagaaagagtttgggctgagtttgtttccttatgattctgctgaaagtaaaaaccacatgtcagtttgtcctgtgccacaaaagtagcaaaatcacttaaggtcaggagttcgaaaccagcctggccaccatggtgaaaccccatctctactaaaaatacagaaattagccaggcgtggtggcgcgtgcctgtaatcccagctgcttgggaggctgaggcaggagaatcgcttgaacctgggaagtggaggttgcagtgagccaagattgcgccattgcactccagcctgggcaacaagagtgaaactccgtctcaaaaaataaataaaataaaataataaaaataaaaataacaaaaattagcagggcatggtggcgcatgcctgtcgtcctagctacttgggaggctgaggcaggagaatcgcttgaacccgggaggcggagattgcagtgagccgagatcgtgccactgcactccagcctgagcgacagagcaagacttcgtttcaaaaaaaaaaaaaaaaaatcaaccacatttggcttactgttttgtgctgaggctagatggaatgccatgctaagaagcatgggccttatagtactttaaatcaacattaaaaaataaacaggctggctgtggtggctcatagctgtaatcctagcactttgggagactgaggtgggaggatcacttgaacccaggagttcaagaccagcctgggcaacatagtgagacccccccaccgacctctacaaaaaaatattttaaaaaatcagcctggtgtggtggtgcacacttgtagtcccagctactcaggaggctgaggtgggaggatcacttt

SEQ ID NO: 87 - DNA, 1032 bp, Homo sapiens
cttttaaattggcaaacagaaaaataagattcttttttttttttttttttgttgaaatgggagctttgctcttgttgcccaagctggagtgcagtggtgcaatttcggctcactgcaacctccacctcccaggttcaagcgattctcctgcctcaggctcccgagtagctagaattacaggcacctgccaccatgcccagctaatttttgtatttttggtagagacggggtttcaccatgttagccaggctggtctcgaactcctgatctcgtgatccgcccaccttggcctcccaaagtgctaggattacaggcgtgagccaccgcacccagccaagattattctgaagtgttgcagttagggattggaaacattttgaacacaaagaatattagcctagtccttaatattgagtgaatgaggaacgcaaattggaagggagtctatgttgagaagaaaattaaatgatatttactttgagtaggggagggggaggaagtgtggagttggaggagtggacagttgtcagctgagatgcccaggtctaggaatgaggcctctggaagcaaggtcttggccacctggaggagctggggagttggcagaggtggtcattttgcatgttaccacagggtggtgctgttggctgcagaaggggacatggtcagctgcgccctctgcactgtagtgcagagtacagagcgttttcatccatcagaatcccaggtcctgggagagtgaaacgtctcttctccagtattccaaatagggttctgacgccccagaaagcagtgattatgagcttacctgataagtatgaaagacatcagtaaattcctgaatccaactgtaacataaatttattcacatcgtagcagtgattttattaccaccttgaagggagcagcctaaaaattctcgttcaccgatcactttcctcactgtgctatcatctattaaagtttactttaaaatgcaagatgatgtaggaatttcttcttaaattcttaccaaataaaaattaaaaacaa

SEQ ID NO: 88 - DNA, 1035 bp, Homo sapiens
gggttggtagtggggaacctgatttatagcctttgcctatatctgtggtgtaaatattctgacgttggccaacttcaaatacactataatagaatatcttcacctcatagatgcagtggatataaataatatcaagagcatagatattagtgaaatgtagtcagatgattaggaagtaatgagttttgagtatttattacctttctttttaatttaatggtttttttttttgagacagagtctcactctgtcacccaggctggagtgcagtggtgcaatctctgctcactgcagcctccgcctcctgggttcaagcaattattctgcctcagcctcccaagtagctgggattacaggcacccgccaccacacccagctaacttttgtatttttagtagaaacgggtttttgccatgttgcccaggctggtctcaatctcctgggctcaagtagtcctcccgtctcagtctcccaaagtgctgggattacaggacaggtgcctaaagatgggatgaggattctctgagatgagagaggaacaaggaccccagagcccgatctggaagcttttgtccccattctggcccttagggcagtgaatgcagatcagaggtcattgatagcaggcttgatttttatctgcattgatgggttcagcataaatggaccagaacaggaagattgcaaaaaacagacaaaaaacaacaaaaacaaaaaccttgggttggctattgtaaaaagactaggcacatcaccttgtgctttagtttcaaatgatctttagtttgaacttttgttttactcccacatgttctttttaaaaaattccaaactcatgggtcatgatttgaagaaaatttcccttcctcctgcctggcgcacagaaggtaacgtcaaaagctgggaaagggaacagggcagcagcagacattgacctttacctcccgctcctctctcccaccccttgtctgctgggcatagaggattagaactgcttcctcctgtggtttaccagaaaacgctctgcggctagag

SEQ ID NO: 89 - DNA, 1049 bp, Homo sapiens
ggctggagtgcagtggtgcgatcatggctcactgcagcctggacctctcgggctcaagcagtcctcagcctcctgagtagctgagactacagacatgtgccaccacgcccagctagtttttaaatattttttgtagagatgggggtctcgctgtgttgcccaggctggtctggaagtcctgggctcaagtgatcctcctgccttggcctcccagagtgccgggattataggcatgagccactgtgcctggcctaattagctgacttaattagatcacgaagttaggcagtggtcttgagcccaggtccttggaccccaatgcttccttcttctgcttgacaaaggaagctgtttagcatcgtgactgagggtccaggctttgtggcttgacagtttccttcacctcccagtttcctcgtctgtagaatgagactcctcacagaacctcctccacaagactgttgtgaggaatgattggaaaggtgcgtttaagtcatctggcacacgccgactacttggttaacataggtattattattggattcaggaacaaccagtttttacaaggggatgggcgcatgaaaccatttgagactgtttcgaaacacctgtgttaggacccaccctacacctactggatcagaatgtctctgtcttgagaaagggagcaggaggcgaggaccgcgtgtttgttctgatgccctcctttgatgagaactgctgctctggtgctcgctgctcagtattccggagtctcactactcaaagtgtgctcttggaccagctgtcagcacttcaggtcctcttccttctgcatcagaatgtccttttaaaaagatccccaggaaattcaaatgctcattaaagtttgagaaacactgtaaaggttaaaaaaacataaaaaaaaaaatacccacacatactacccccacccatttaggaaagagttgttttttagttgttttgcaaccacagagtaagcaatcatgttgtaatacccaatatcttggatttgtttaaaggagtgctggcaacataacagataaggg

SEQ ID NO: 90 - DNA, 1016 bp, Homo sapiens
ttgttttgttggcaggtcttgctgcctcagcagaaaagaggcgcttttgatatgggaacggaaacttgggaccatgttagaaatagtgtgttcggcagagaggaccttggtcctcctccagctgtggaaactccacgcctggcgggaagatggcagcctgtggggctggggagggtccccgcagcacctgggtctgcggtctgagccgcctgtgctgtgatgtggccggccttccctgccaccgaggggcgtgggatgcacccgtcccctgctcgcccctctgcctgcaaaggtaacatgctgctgttttttattttatggaaagtccagcttgcagaggaaatacctttctcaacgcagcctgtctgatgtcgcggagcagctctgcccagcaaggcgagcacatgaaacgcacatttgtagtcctcctgtgtacctggctgcggtgcggggaggcagagtgggaaggggagaagactggtctagctcaaaaggccagtcctgggcttcaatttccaacactgggctgactctgctgggacaagcaactgcctctgttcttgtctcttcctcctcgggccctgattgctggcctggactagcccattcaatggatattgggccaatttcccttttttccacttcccctttcttccccttgtgttctcaaaatgtgataaatggaataggcacaccccagatccaagttgcttttctgagaaacttcccgcagtacttaggtcctggccccccggcctcagaacagagaggcacggtacacacaccactccccaccagggcactgcagacctatgtccaggctgccaccccttcccaagggcatgagggaggcagtgggggagagttcggagatgcaggtagaacctccgccagcagccccttcccctgaagcttgcactcattgttcagatgattgggtgttgcctgcctccccccactagactgagctccctgagggcagcaagttctgcctgttctgtgtatccagtaggtgc

SEQ ID NO: 91 - DNA, 1064 bp, Homo sapiens
gttgtgtgaggaaggtcctttcgggagttcccaacccaccgttttatggctgtttttctctcttgacccttcctgatctttactttaatctgatcttacttgtgggaaaatgttgctaggagttcccaacccagagtgactggtgagctccctgtcacccatgaggaggacggtcctgcagttagagctcctgtacatacatatgcatacacacacacagacacacgccacacacgcagacacaggcagacacgacacacgtgtacctacatgcacacacagcacatatatacacacatgaagacacaccacacacatatacacacatccagacacaccacacacacagatacatacacgcctcacatatctacacacacacacacacccctaccacccgcacaggtacacacacacattctttctcctggttgaaataccctcacggcatttatgcctgtgatgagattacaacctggtcttcaggaagcaccagacattggacccctgcgtgtgacagctgagccttgcagcctgagggctgcggacaggagaactgtcattatttagagtgagtagagtttggtggggcaggaggggtacaggccaggcattggtttgttgtggggcttggctgagacagctgtgcagaggaggaggcaggcgcggtcctggggacgtggtgactaatgcaagagtgtgcttttggggatgaaaactttcactaagggaatggagagcaggcgccgccggccagggcactgcctggactatgacgcctctgtcctgcttgttagtctcagctgctgcctttgctctcactgtgtaggcacacagtgtacacgtgtgtgcatgtgtgtgcatgtaggcatgcgtgcatgcgtgtgtgtggtgggtggcggtggcagcagcagggccacatctgtcctctgctctcccgttccagccctgcagggcagtacgagccacgccctttgcgtctgctcctcctgggtggggatgaaggctgagtcctcccacctcctggaaactcaccaactgctcagcagtcccaggccctgatg

SEQ ID NO: 92 - DNA, 1055 bp, Homo sapiens
agacacagatattttcaaaattcaatgttttcccacctagtatgggcagctgttgccaggtatactcaggtacttgtcctgcaaattaaatctttatcagctaatggttagttttttttttttttctttttttgaagcagcatctctctgtgtagcccaggctggagtgcagtggtgacatctcggctcgctgcaacctccacctcccgggttcaagcaattctcgtgcctcagcctcccgaggagctgtaattacaggcacgtgccaccatgcccggctgttttttgtatttttagtagagaccaggtttcaccatgttggccagactggtctcgaactactgacctcaggtgatctgcccatctcagcctccaaaagtgctgggattacaggcgtgagccaccgagcccaggcaatgccaggtttcaagtaaaactttccaagaatttacagtgtatacagaaaagcacctaatgttttttaaatagcacgatagaggtagcaggtgaaatggcggttaccaaacctccaaagattaggattgcaggatgtctggcagtatcatttgttggcaaaatgtggataagctgtgagcctggaaagcagtttaccatcagtggggtagtgattattatcagaaagagcatacaggccttggttttagtgcccgatatgcatgtatgcatagggagcagaggctgttgttgaagacagttggtttttacaaattttccttgatagtttaaactcagagttaaaaagcacaattctgtgtgcataatttaaaattttatgacttctgatcacataaagttactttttttaaaatcccagtatatattatagtagtaacgttgtagttttactctgctgtcaactggaggtgaggtgcctaagccacaaggggaaaaattaaactagggaggcatgggtgtaaaaggattagaaggttaactgtatcttcatgtaataaatacaaaacttcagttttggaaaggaataatgagagaaggtagaggaatggggaggggagtttttttgtttttggtggttt

SEQ ID NO: 93 - DNA, 1050 bp, Homo sapiens
tttgtaacttttgcaaagttaacttagaacccttgataaataaagcagacctcaaggaagttcttaaaaccagtgtcagccgggcttggtggctcacgcctgtaatcccagcactttgggaggccgaggcgagcggatcacgaggtcaggagatcgagaccatcctggctaacacggtgaaaccctgtctctactaaaaatacaaaaaaaaaaaaattagccaggcgcggtggcgggcacctgtagtcccagctgctcgggaggctgagtcaggtgaatggcgtcaacccgggaggcggagcttgcagtgagccgagatcgcgccactgcactccagcctgcgacagagcaagactcccatctcaaaaaaaaagaaaaaaccagtgtcttcctagtatcaaattaatctgcttccacagcactatagagggtgtgaggtattacagaagagatactgtatgtcagactgataccatggtgttgctttttttggttgtcctagaatgattcacagtgttaggtgagggaggtttggctgggtgtgttggctcatgcttgtaatcccagcattgtgggaggctgaggctggaggatcccttgagcccaggaattgagactagcctgagcaacaagggagacccgtctctacaaaaaaaaaaaaaaaaatttttttaaagagatggagaaggcatactcaccaaatggttatcatataaccaaataagcagatcagtcttaaaagttaaattatttctggatctgaggcttataaattgaggtttaggacagttacaattttcagtaggaatcacattaacacagatatcaacaccaccacctacaggttgaaaagactagaagggattctagaaaattaagagaaatttattttagatccagcaataccaatagatgttacacttaatggggaaactgaagcttctatctgcaggatagaaatataactgcttcctactgtctttttattaggccattgaaatccctatttcaaagtttattatatgataatagacatctttaataagtatg

SEQ ID NO: 94 - DNA, 1105 bp, Homo sapiens
aaaagagccttctaacatgcatcaggtataatcatttgaacagaccacttgttcagactcttttgatgaatctgttcctctcagggtaaattcctaattcagcagtcctgtagttttccaaaaatgtcatgtgcttttattgctctgtctccccacatatgctgtccctcaccagagattcccccttccccttcctggtcatgctgtcacctgttgtggaagcctttggtaattcctcctaattccaagtgtcccatagtaaactcatatcacttctgtttagcaagggataaatgcgtccatcagctgagagcctgtatatgtattcttgtcattctgcctaatgatggtgctcaagaatactttagaactttgggtgagctctgttaatatttgtctctcagcagtgaatatttgttgcttgcactagtcactagggaaacagcagggaattaagacctagcttctaggaacttacagcttcacagataagataattaaagtttggtgggataaggttgctgagggtgccactagaccttcaagagtcacccagtacaggttgggttaagagagagaaggttgggagggccttcagaggcagcagcacccaactcccatcttaagaatagccaggtgggctttgccgtgtctactgtgaaaatgaagaccattcacagcaatcagactgttgtcattccagaaaatgtcaacattaccctgaagagatgcacagttactgtgaatggccccagaggaaccatgcagagggacttcagtcacatcaatgtagaactcagtctaaagaggctctggagtgccacacggtggggtaacagaaaggaactggctaccgttcgaactgttggtagttatgtgcagaacacgatcaagggtgttacactgggcttctgttacaagatgaggtctgcgtatgctcacttccccaccgacattgttatccaggaggatgggtctcttgttgaaatccgaaatttcttggatgaaaaatacacccgcagggttcagatgagaccaggtgttgcttgttcagtatctcaagcctagaaagatgaatttaatccttgaaggaaatgacatcgag

SEQ ID NO: 95 - DNA, 1035 bp, Homo sapiens
aggactatggctcacccgtcagagagctcacattctgatagaaagcactgggattgtttaaatatcctagttcaacattaaaaaaaaaaaaaatttaatcccagcactttgggaggccaaggcgggcagatcacgaggtcaggagatcgagaccatcctggctaacacggtgaaaccccgtctctactaaaaaaatacaaaaaaattggccatgcgtggtggcgggcacccatagtcccagctactcgggaggctgaggcaggagaatggcgtgaacctgggaggcggagcttgcagtgagctgagatggcgccactgcactccagcctgggccacagagtgcgactccatctcaaaaaaaaaaaaaaaaccaggatgttacccccttggttttaaagcaaatttaataagggaacaaaaagatgatactaagaagaaggcaagtaaaacccctagtcttccattagctctttcactggaatttgagtatattgtacatgaaggttggttttcaatttgaacgtctagaaagatactcatttctaatacctatgcactgtagtttcaggtttacttgcagacaccctggtagggttaagaggaggatatttccaagttattttaaattgagtttacttttaactggggttcttgactctagtgtaattgctccaacaactacgtagaagtcaaaatgagtgactttagtgaagcttctgtactttacaatacatgacagtaatgctattccagaagttttgttttgttttgttttgagatggagtctcgctctgtctctcccaggctggagtgcagtggcacaatctcggctcactacagcctccacctcccggtttcaagcaattctcctgtcttagcctcctgagtagctgggactacaggcatgcgccaccacacctggctaattttgtatttttagtagagatggggtttcaccatgttggccaggctggtctcaaactcttgacctcaggtgatctacccgcctcggcctcccaaagtactgggattaca

SEQ ID NO: 96 - DNA, 1030 bp, Homo sapiens
cccagggagtcctgtcacctcaagaggcaggtcccagctggggcccagagacactggctttcctggggtccagcctgggagggagggagaacagaggtgaactcaggccaaggcagggatggggaacctgcgagaaggggaaggcaggggtgacttggcagccaggcagcttttcggcatgcttggtcgcagcaagggatcacactcctgaccctcctggccttgcaggccaaaacgtttgcttcctcagaaacagggagggagagttgcagtgctgcacgtctaagggctgagaaggaggggacttgtcttctgggctatttcagaagctgaaagaaaccttcacctgccacaaagacaggcctggccaggggctctctagcattcaagcggaagggcaagcgccacagtcggggttgtccatctgccccactccaggcagtgtcagcccgcagccaccttcccccatgttcacccaccttcttggagctctgcatctggggagcagaccctgagctcctggcctgcgggtgcgtccctggagcaacagaaccttgttagtgtccccatcacttgtgggccctgccctggattggctctaactcccggtagtccacatggctctacacagtgggcatttgtcctgttgggcagaggggaagcaggttcaaagtggggttgacttgcccccggtcatcccctagtaagtggcaggtcaggatctgattccacgtctgacctgtaagatggaggcagctcatccacccctgcagatgccgagcctgttcccccaaccccacagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacaggtgagaggcggcatccacagggcgggggtgggggtgttgagtttgttcagg

SEQ ID NO: 97 - DNA, 1047 bp, Homo sapiens
gcagcgcctcttggtccccatttctgtatagcaggcgtgtgtgtgtgtgtcgaggttttttattttttgcttaatcaaactccattcccaaatgcactccatctctggctctgagggcgctccctcctctcagccgggcagcctggcctctcctgcccagacctgcggtcccagcatcccccagagccagggaacaggcccagcgggagggggttttatgttttgtttcaaacagaaaacacaaccttatttttctttacaaaagcaaaaaaggaaaccaaaaaagatacagcctttgaatgatgcctgctggctgtctgtattcgtttgcttgggcagctcgggccttccaggtagggcagggtccctgctaagggggctctcatccactttctctttcctcttcaacggggggttctggagtggggggctcgggttggggtggccacagtgtgaccagacagtgtccctggaggggcttagggatttggacaggagactcgctgcctggctgagcctgggccggaaggacaccccagagtttgctgcgcagagaagggtgtccaggcaggaaatgctcagctcagctcttcagaaaagcctgagcccaccagccatccctgaccgtccttgcccctggctgcagggaccacggtcaggttgtgaaaaagacctcgtcttcctcagagagggcttagagctgctgcacggctccatgctgaggcggcggggatggggaatggccagggtgtcacagcacaagctctggggtcacctttctggtgactgggatctgcatttctgttggcttcagtttgacacgggagtaacaggacggccatccggggctgatatggggacccttaagccacagcacaacgcagagggagctctaccaaggtgggctgtcattctggcccagtgcccagcgggcaggaggaccacagccagtgagcagggggaccggctcccaggggccggcaggaccaacctgaaccagaccctgagggcagatgagggtgcagggctgggacggcttcccatcag

SEQ ID NO: 98 - DNA, 1050 bp, Homo sapiens
cacatggaatgagatttacaggctaaatgtggtggctcatgcctgtaatcccagcactttgggaggctgaggcaggaggatcgcttaagcccaggagttcgagaccatcctgggcaacgtagggaaatcctctctctacataaaataaaaaacaagccaggtattgtggcacatgcttgtgatcccagctacttgggaggctgaggtgggaggattgcttgagcctgagaggttgaggctgcagtgagccatgatcataccagtgcactccagcctgggtgacagagtgagaccctgtctcaaaaacaaaaaagagagagagagagagagacagagagagacttctagtgtgaaagacagagacccaaatgaacagaaaaaaaaatttgagaagtcacaaacagggtcgtatggggaaaaaaaggcacattcataaaataataagctgttaggtattaagatagcagaagtaaaaatagaagaagtaaaaatttcaacagaagagttggaagagtgaaaaacaaatttccagaaagtagaacacaaagacttaagagatggaaaataggaaagaaaatatagaaaaatttgacttcagtccaggagacccagcatgcaccacataggagctcaagaaaaaaaggcaagagaaacggaggaaggaaaagtatgtaggaaacaattctagaactgaaggcatttctacttttaaacagtctcgaagtagtacccaataccatgaataataaaaggcccacgctataggacatcatcatgaactttcaaactccagagatagagagaagttactaaatgtcatcagagaaaaaaaggccacatacagatcagagaatgagatggctttagacttttcaaaagcaacagtagaaactacaagacaggccaggcgcaatggctcacacctgtaatcccggcactttgggaggccgaggcgggcagatcactaggtcaggagttcaagaccagcctggccaacatggtgaaaccctgtctctactaaaaatacaaaaattagctgggcgtggtggc

SEQ ID NO: 99 - DNA, 1046 bp, Homo sapiens
atccccttctgcccttgcactctttgctgaatcaactgcagtcaggcgagggttcccgtggttgctctgtggttgctctgagtcactgtctggtctgacccatcagcctcattagacatggctttcacccacttctcctggaaacacgtttttcttttggcttccagaacagcacattctcctggttttcatgcattctctgtatctgttccttcttcactctttgcctggttccttttcatttccctgacttctaaatgttaggattcaagggctcaatatttaacctcttgtcctttccatccagctttattctcttactgttgtcatccagtgtcctggctttaattaccctcatttgatgattcctaagcttttatctccaacgtggacctgctccttgaacctcagattgacacatccagcgctttacctgacatctctgcttggatgtctaacaggcatgtcacagctagcatgccccaaatcaagctttgctgttgcctcacattttatcttctcccaggtttccatctcaataaatgacaattcatgttttctagacctggattggcaaactctttctgttaagggccagatagtaaatatttttggctttggaggctgtgaggttagaactgtttatctctgcttctgtagcacaaaagcagccatagaacatatgtaaatgagcaagtgtaactgtgttccagtaaaacttcacttacaaaaacaggcagtagcccagatttggcctgtggactagagcttgcttggccctgctctagacctgtcagaaaactagaagcagaccagattctcaccacctgtttcttctcatcacctccaccgctattacccaggtccaaggcaccagcatctcttgcctggatttctggaacagcctcctaactggtcatctcatgcccacccttgcttcacttgagtctgttctcagtgtagagccagaggggccccactaaagcataagtgcaacactgtgtaacagcccatatgctgttatcacaaactaacagaaaggcttg

SEQ ID NO: 100 - DNA, 1044 bp, Homo sapiens
gttagttatctcaagtttttctttgatttttctcttctttcctccctttctcaactaatttagcctctatgaaagtagtccggctcccactcccagtttctggagctctgttcccgtgatgggcccgtctcttgcctcaccttcccgtgcagccagccagttggctgtgccttccactcccctcagtcctcacagtgcagcctctggaactgctgcgggaagccagccttcatccccgcggtatcgcccctacactgtcactcacccatgggcgtcctcaggcgtctccattctgtcgagctccccaagtccccctgccctcgccagtagcccccaagcagtgcccgccagcagttccagacagaggcccagcagcacgggtccacccctaccacccgcctcacccagtgccacgagcagacgcccctcctccctgaggatctctcctaggtatttatcccacaggagagttgcatgtgtgtttgcggtgcagggaaaggagattaacacggtttggaagaagtgctgtgtgacactgactctgttaaattgttgttttgggttattaacctgtgtggctaactagtttggtaggcacgtactctgagtccatgcttctgccaggctctaatcatgctggaaagtttgggttgctctattctattgtgaatccctttcttccctttgagagttggggcacacaggaaccctttttggccttttgtcctgttgccagtggtagttgaaatgctatcagaccaagcaggtgtgggagcaaatctgggcctggtgttttttacttctggtgagtggggtgggtcggttcatgtcctgacgtgttgagttttagttatatgtaagttcagtctcttagaaggaagcagtatcagaattccactaatccagtggccccttctctcaaatgtacctgtatgtgtttctataatttaggtgaattatgtttctgcatgtcagtggccaaaagttttagtgtatggtttatttaaaaggacagcagttgcaaaagcttctccccgtcttgtt

SEQ ID NO: 101 - DNA, 1050 bp, Homo sapiens
gtcacccaagctggagtgcagtggagcgatctcggctcactgcaacctccacctcctgggtttaagcaattctcgtgcctcagcctcccaagtagctgggattacaggtgcatgccaccacacctggctaatttttgtatttttagcagagacaggatttcaccatgttggccagagtggtctcaaactccacacctcaggtgatctgcccacctcggcctcccagagtctcaaacttctgacctcaggtggtccgcccacctcggcctcccaaattgctgggattacaggcgtgagccactgcgtccagccaaaaccttgttactttgagcagtcagcaaagaaatagtactttatccttccccctttctcattgatcttcccagaatttttttactctgaagtaagcaattttaacactcacttcttgcctggtaagactaatgtcatagaagaaagaatcatcaggggttggatcgctctctccatctgctggcccagtggattcgatgtcttataaatctttttggaagtagttgggacatacatttatatgttaagtatttataggggtgatgataaggattaattttaaaaaggtaaaacattccttctgtaatgttttgcagacttctgagaaaagaactgtttgagatataaagaactgctttttgcgcgagtggcataaatgagtgaagtgagaattaccgtgtgtgaaaagataactgttgggtggtgggcttaatgcatgggtgatgaaataatctgtacagcaaacctcctgtaacagaccttcatatgtacccccaaacctaaaataaaagttaataaaaatcaataaatcaataaataaaagctggaagttgatctgaaaaaaaaaattaccccatggtaaaggtaccgcagaagttatccggaggaaaatgtttctaattgtttcctaggaagttgatgactagaaagaaatttggtggttttgtgtttgttttttaactgtaaatatttcagtgaaggaggtcaaatcttgaatgtcacaagccttatatgagt

SEQ ID NO: 102 - DNA, 1035 bp, Homo sapiens
atgtgtcctttaacgagagggatacattctgagaaatggatcgttaggcagattggtcattgtgtgaacatcatagagtatacttacacaacctagatcatacagcctactacacacctaggctatgtgatatatagcctgtttctcttaggctacaaacctgtactgcatgttagtgtactgaacactctaggcaattagatgcttatgccaattatggtgagtatttgtgtatctaaacatgtctaaacatagaaaagatacagtaaaaatatggcattataaccttgtgggaccactagggtatatttggtccatcacagagtgaaatgttgttatgtggcgcatgtgttacaaatgtgttccaaaattagttatgcatatctatctgtctgtaaaacatgtcaattcctcttggtcctgttagtttctagacattaattgtgtgtcctgggttgaagtagggatgtgtctctcacattcctgatgttcccatactttttttcttttattttaggacagcgtctctctttgtcgcccaggcaggagtgcagtggcatgatctcggatcactgcaacaacctcctcccacggtcaagtgattcttgtgcctcagcctcctgagtggctgggattacagacgtgtgccaccacgcccaacaaatttttgtatttttagtagaaacagggtttcgccctgttggtcaggctggtcttgaactcctggcctcaagtgatccacctgccttggtgtacgaaagtgctgggattacaggcatgagctaccatacccggccatattaccatcctttatcatcttctgtatgtaggttttttgccaagtttatgttttctcattttcttcatttcagtactccttactttttcctgtcgtaattaatccgtatgtgtcttttatgtatatcaaatccgtttgtgagttaaacaccagatttgttatgtggcctgtcaatggttgattttaactttgtttaatgtcctcaaatttaacccttgtgcttatgtttggttttt

SEQ ID NO: 103 - DNA, 1064 bp, Homo sapiens
tcctacagtgaccatttcaccattgaaacctgcaaagagacagatatgctgaactacctcatcgagtgtttcgaccgagttggaatagaggaaaaaaaagcaccaaaggtaatatgaaatggattaacttaaaaaaaaaaaagcctagttatttgtttgattatccccacccctggagcattcattgatttattcaatcagtaaagcaattattgagcatttgccatgtgccaggcacaatactaggaacttaggatgtgtcgatgaacaaaacagagatccctgccctcgtggaactcacattctaatagagacagagccaaggtttgaacctagatggcctggcttcagagtcctctcttgaccacactgtagctcggtaccgccagtgactcatatggccctgataattctactgctttgttataataaccaacattatagagcctctgtagattgccaaggactgtgccaggtcgacattagcttgtatcctcagttgctctgttagtgcagtggaacccggtataacataggcattcttttttcaacgtatgactaagcaaatgactctcagagagattaagtacttgtccagaatcacgtaaataataagttgcaaggctgggcttaaactcagtaagctacccttttcccatcacttctcttgactggcttcattgttttctcattttattcctatttcattttctgattttaattttacgttagaaacgaacctcgttgcccactggttagtttcatatttgtaaagggccttctttgggctttgttgtacttagccttagtggaagcgaaatgagtgggcatgtctccaaggttttttgttttttttgttttttgagatggagtctcgttctctcacccaggctggagtgcagtggcgctatctcagctcactgcaacctccacctcctaggttcaagcaattctcctgcctcagcctcctgagtagctgggattacaggcacctgccaccacacccagctaattttttttttttcttttgagacggagtttcactcttgttgcccaggctggag

SEQ ID NO: 104 - DNA, 1037 bp, Homo sapiens
aatacttctcagggcctgccattaccctggaaaacactcgtgtggttagccaatcattgcagcattacttagagctcggaagggtaagtgttcagaaaacaaatccagaggaagtatcaaagatgagctccagatacagagcttttattttgtagactggactatgcccagtagacaaacggctaacaaaagccaattcgatcttacataaaaaagataaactataagtaagtagcctgtgtcttgaataacaggttgtaacaacagcagtatgctgcctttgtatgtagcatcactgggaactggtcctaagcttagtggcccggctcctcctccagctggcccttaggcatttacactgtgagggtgagcaaggattgttagtttgcacacaccctcactgacttgcttatcccaaatgcagattaatatgtcttcaattctcaaacttaaaggcagagaagggccgggtgtgatggctcatgcctgtaatcccaacactttgggaggccgagtggggtggatcacctgaggtcaggagtttgagaacagcctggccaacatgacgaaaccccgtctctactaaaaatacaaaaattagccaggcatggcagcgcgtgcctgtaatcccagctacctagctactcgggaggctgaggcacaaggatcacttgaacccaggaggtggaggttgcagtgagccaagatcacgccactgcacatcagcctgggcgacagagcaagactccatctcaaaaaaaagaaacaggcaaagaagttacaggcttgggtaactaaggtaattttgatcatgggaaagaagtaacaaagcctattttattaaaactgtaactgccggctgggcgtgttggctaatgcctgtaatcccaacactttgggaggctgagatgggctgatcacgaggtcaggaagtcatcctggccaacatggtgaaacctcgtcactgctaaaaatacaaaaattggccaaggcaggtggatcacgaggtcagcagtttgagaccagcctgaccaaca

SEQ ID NO: 105 - DNA, 1007 bp, Homo sapiens
cagagtgagactctgtctcaaaaaaaaaaaaaaaacagatacaaattgaaaaaaaaaatcaagttatcataatatatctataaaaaagccaaaaccaaagtgataaaatagaatgtaagtttttgaagaagtaggtgatatttaatcaatttatttaacctatctgaagtgaattctggtgattcatagcaaaaaatataatactgttgttctcaataattctacttttcaggttatattcccaaagttggaggaaaaaggaataattttgtttacataaatcctcccagtagtaacattatttataatagaaaaaaattagaaaaaagaaatatgcagggaaacggctctggaatcagtagtttattaacataatttaataccatttcgagatttaaatatttctgtattgtgttgaaaaatggagattttatacaatacatcagtaaggaacatcaccaaagattgttgatgggctgggaatggtggctcacatccataatcccagcacttttggaagctgaggtgggaggagagcttgagcccaggagttcaagaccagcctgggcaaaataaggaaaccccatgtctacaaagaaaaaaattagcccagcatggtggcacatgcctgtgttcccagccacccaggagactgaggcaggaggattgcctgagcccaggaaattgaggctgcagtgatctgtgatcttaccactgcactgcactgcagcctaggtgacactaggtgacagagtaagaccctcttaaaaaaaaaaaaaaaaaaagattgtgatggacatctgtatgcacatttaacgaggtaggacagaatacggtggtccttgaatggagctaacaggaattctcttcttcttgtagtattgtttaagtttataattgcaaaagtatccttaaacttctggcggggcatggtggctcacgcctgtaatcccagcactttgggaggccaaggagggtagattgcctgaggtcaggagttcgagacc

SEQ ID NO: 106 - DNA, 1044 bp, Homo sapiens
aacttgatttcagacttacataagtaattctttaaaggagcagggagttttgaaactaagtctttgatggatgtctattataatggatactgtttatagtagtagagaagtgacagaataactttctgtagtccacttaactgtagctttgaatgactggataacattttcactaaattttgaagatggttgcaaggtggtttttttttttgttttgttttgttttttttttttttttttttagacggagtcttactctgtcaacaggctggagtgcagtggtgcgatcttggctcactgcaacctctgcctcccgggtttaagcaattatcctgcctcagcttcccgagtagctaggactacaggcacgtgccaccacaccagctaatttttgtatttctagtagaaacgggatttcaccacgttggccaggatggtcttgatgtcttgacctcatgatccgcccgcctcggcctcccaaagtgctgggattacaggcgtgagccactgtgcccggcctgaagtttttaccatgagacagtaaaatcagaaaaaatatttaggtttaggttgttttgagaaagtaattaaatataaacttctaaaaaggatagatgttattagcacacaacaatgcccggctaatttttgtgtttttttgcagaaatagggtttcacatgttgcctaggctggtcttgaactcctgagctcaagccatctgcctgccttggcctctgaaagtgccagaattacagcaggtgtgagtcagagtgtacagccctgaccgtggtttttgtttgtttgtttgagatggagtctcgctctgttgcccaggctggagtgcagtagtgcgatatcccagctcactgcaacctccgcctcccgggtttaagcggttctcctgcctcagcctcccgagtagctgggtttacaggtgcgtgtcaccacgcctggctaattttttgtatttttagtagagatggggtttcaccatgttagccaggatggtctcgatttcctgaccttgtgatccgcccgcctca

SEQ ID NO: 107 - DNA, 1020 bp, Homo sapiens
ttttactttatttttacccacaaattgtctcttgccctttggtgaattttgttcatatatttaacaaccttcctttgccaggaccttttttttccccagtgcccaatcttggttgggatagaagtagccctgacttttttttcctgtttattactcatattatatgtcttataggctttttcattcacgcatacatttctaaaccaaatgccgcacagcgtaactgatacaaataatgatttcatgtccactattgaaaatttggggggtgggtgcagtgactcaatgcctgtaatcccagtactttgggaggctgaggcaggcagagtgcttgagtccaggagtttgagaccagcctgggcaacatggcgaaaccctgtctctacaaaaaatacaaaaaagctagctgggtgtggtggtgtgcacctgtagtcgtagctactagggaggctgaggtgggagtatcacttgagccctggaggtcaaggctgcggtgagccgtgatcacgccactgcgctctagcctgggcaatggagtgagacactgtttcaggaaaaaagaaagaaagaaagaaaatttgggatggaggaagggcaaaatggagatttggaaaggaagagtttagaaagtaatgcatttaggctggacacagtggctcacgcctataatcctagcactttgggaggccaagttgggtgggtcacctcaggtcaggatttagagaccagcctgggcaacatggtgaagtctcatctgtactaaaaatacaaaaattagccaggtgtggtggtgggcacctgtaatcccagctaatggggaggctgaggcaggagaataacttgaatctgggagacggaggttgcagtgaactgagatggagccgttgcactccatcctgggcgacaagagcaaaactttgtctcaaaaaaaaaaaaaaaaaaaatacagaaagtaatgcatttaggccaggtgtgatgactcatacctgtaatctcagcactttgggagcctgagatgcg

SEQ ID NO: 108 - DNA, 1032 bp, Homo sapiens
aatcaagtaagtataggaagaaatattaataaaaggttatttatttctccttttactctttacagcccgaagatccctgttttgcatctcaaaaccgtgtgtacaatgacattggcaaggaaatgctcttacacgcctttgagggatataatgtctgtatttttgcctatgggcagactggtgctggaaaatcttatacaatgatgggtaaacaagaagaaagccaggctggcatcattccacaggtgaaaaacaaaacaaaacaaaaatcttctcttcattattagtgttagtcttaaattgctttaacagttatttttatttggcgaacatttatgcggggattgttttatgtcaggcacaaagatgaacaacccattattttccctcagaggagctcacaattgaatgggaaggattgacatgtacacatgtctgtcattaaaggtgggaaagtcagtgttttgtaatgattttgccatatatccaatgccatattattttgtcatttgaaaagtgttaccagcttgttaaagctctgttctaagtcctggagatggggggatattgttgatctgattttttttcaaattccatgcatagattacctctgaagaatgtgattatttttggtttttttgatagccttattcggagatactttcattttattttcctaatttaatactatgactttaaacttcaaacactctgagattctccctctttttttttttttttagaacagttagtattattgggtttgatcctttattgtttgggaatgaagaagcgttctgacatagatatttatttatttttattttcattattcgtttcacttaggatttaatggtgaaagacataagtatttaaaaagaacttcattatttacttatttatttgagacagggtctcactctgttgcccatgctggagtgcagtggtgtgatcttggctcactgaggccttgtcctcccaggctcaagtgatcctcctgccttagcctccagagtagctgggactaaagcc

SEQ ID NO: 109 - DNA, 1022 bp, Homo sapiens
ttggatacttttgtctaaactttcctgaagctttatttttttacagtgttattgaggtattattgaagtatacagtaaatggcacatatttaaagcgtaaaatttggtcagttttgacgtatttgtatacctgtgaaactagcgccacaatccagataatgataatttttattctcaaaagttgcctcatatctctttgtagtctttctctatcccttcttctgtggcaattcccgggcaattccggacctgcccttttgtcactatatattaatttacattttctagaattttatataaatggaatcatagagtatgtactgttttttgtctggagtctttcacttagcatagtgattttgagattcatctatgttgttgtgtttatcaatagttccttttcattgttgatgagtattgcgttatacagatacaccacagtttattaattcaactgttgatggacttttaaactgttgccagtttttgattattacaaacgaagctgatgtgaacatttgtgtacaagtctttgtgtggacatttgtttttgttctgttggtaaatacttaggagtaggatgattgagtcttattgtagctccttaagaaatgtcaaggctgggcacggtggctcacgcctgtactcccagcaccatgggaggctgaggcgggtggatcacaaggtcaggagtttgagaccagcctggtcaacatggtgaaaccccgtctctactaaaaatacaaaaaaaattagctgggcgtggtggtgggcgcctgtaagctcagctactcgggaggctgaggtgggagaatcgtttgaacccaggaggtggaggttgcagtgagccaagattgcaccattgcattccagcctgggtgacagagcgagactctgtctcaaaaaaaaaaaaaaaaggaaagaaaataaatgtcaaattgttttccaaagtgattgtaccattttacattcccaccagaaatatgtgattgttccagttgcttaaagcttcacttttagta

SEQ ID NO: 110 - DNA, 1095 bp, Homo sapiens
gtttaaggctgcagtgagctgtgattgtactgctgcactccagcctgagtgacagagcaagactctatctcaaaaaaacatgctttagaaacaaaaataaggccgggcacggtagctcacacctgtaattccagcactttgggaggccaaggtgggcggatcatctgaggtcaggagttcaagacccgcttggccaacagtgaaaccccatctctactaaaaatacaaaaaaattaagccgggcttagtggctcatgcctgtaatcccagcactttgggaggctgaggcaggcagatcacttaaggtcaggagttcaagaccagcctggccaacatggtgaaaccccatctcaactaaaaataagaaaattagccaagcatggtggcacacgcctgtaatcccagctgcttggagggtgaggcacaagaatcacttgaacttgggaggcggaggttgcacagcctggagattgcgccattgcattccagtctgggcggcagagtgagactctgtctcaaaaaataaataaataaaaatagaaaaattagccggccatggtgacgtgcatctatagtcccagccactcgggaagctgaggcaggagaatcccttgaacccaggaggcggaggttacagtgagctaagattgcgccaatgccctccagcctgggcaacagagtgagactccatctcaaaaaaaaaacaaaaacaaaaataatgtgcttgtttcttccttcagaacatgtaagtggaaagtgagtgaagttctgcaacacctagcaaagggagaaggagtgagaaatctttccattaaatgttgtaggctgcagggtaacttttactgttggtaaaattgactttgaaattttactaaagaccttagtgaagaggagtggtaagactccattcacacattttctcacaataggcgtcagtgaccatgttgctttgcagggctcttttcagagccagagtgagaaatagggagctccttgggaatgagaagtaaaactcccacttactgagtccttaatataaaatgttctttttctttggggatcttaagtcttaactatttgcttattaaagcctta

SEQ ID NO: 111 - DNA, 1035 bp, Homo sapiens
gcctcccaggttcaagcaactctcctgcctcagccttctgagaagctgggattacaggcatgtaccaccacatctggctaatttttgtatttttagtagagacggggtttcgccatgttggccaggctggtctcaaacttctgactacaggtgatctgcctgcctcggcctcccaaagtgctgggattacaagcatgagccaccatgccaggtcttcctgtcaaataaggttttaaacatgcagctgtagccacagctctcgtgtttattagtctggcatcacagtcagtactgtgagtgccgttgcttaggcttagcctataaatatccacaaatatccattacagaagcaggcaagggcaaatgctgtgctaagcagcccaagggccacatttggaacccacttaggaagcatgctatgttcagtacagtaaaaccttggtgattcaatggcttcaacaaatgttctgtgtagtaagtgtttttcatggaaatatttctgacttgtcctggtgatttctgtgtttccttaactgaatcatcatcaagaagagattaaattgtttagctatatgaacataatttattaaccagtgctatacaaataactagagatgcagacagatatgacgtgagaccaaagagtgaatgacacctgagcctggcattcctcggagcttaaagaagagttcctggtgtccctctgttttttggaattttttttttttcaaagaaagggaggaggattaaagatttatctcctcaacccctcatttctgaaccatgaatccacatttcaagttcatcttacattaggcccctagagtggggtatgggaagccctggacaccagcatgcctgcctgccagcagaatgagttgatgctcctgagactgaatgctgttttgcacttggcttccctatttatactaagtttgctactcaggcttgaacagaatatccttcactttttcttaacttagggtgaactgtttcatagaacatttacttgaaagcctattgatcctgttttat

SEQ ID NO: 112 - DNA, 1809 bp, Homo sapiens
ccttgtaagtataactcttttctgaaaaagtacctcctacatggctgccttactgatgcccaggttccttctttaatctgttttgctctttgcctacctttgctggttgttgttgttcttcatctttctcttttttttaaattttattttaaatcataccctcctatttgttccaccaaactcatatactactttgcttttgcagctgctgctttgaatctttactcttgcttttttcacgtgttcccttgccttgcctttggtatgttttttgttttgaggtgacatccagtcatgtaatattctggaagtccaagagatccagaaagtcaaacactagacaacttaaggtttattactcacaagtcctttctgtgtagatatttacgttttggggtcacaggcttcgttagtaacctgttatcatatgaatcatacattgaagtgtttgatgaactataacacttttccttgttaatcactactagcatcattactatatttcattatcatcatctgactttcttacttcatctccatgaccagcattttcacctgttttggcatgtgctcgtcccccttttttgtactccttttccttccattctttgcctaattgctacttgtccttcatttctctgtctgggcctcactcagccttgattcacccatgttacagagacctgtgaatactccagttctagctcttagtacactgttctcttatctcctactgtattcgttctcagtcctcagacatgctgctctagcaacacattattcctagaaaactccaggtactttcccactctcagcatacccacatggcagcttctgctcttctttgatctctgctcacatatcactgagtctgtgaggcctgtcctgacaacctcactttagattgctccctcacctacccttccccatgtgttctttcctcttgttgctttatttttgtctggagcacttgccactatctgacatactgtgtacttattgattaaaatggattatatcatggcggggcacggtggctcacacctgtaatcccagcactttgggaggctgaagcgggccgatcacctgaggtcaggagttcaagaccagcctgaccaatatggtgaaacctcatatctactaaaaatacaaaaacttgccggacatagtggtgtgcacctgcagtgccagctactcaggaggctgggacaggagaatcgcttgaacctgggaggtggaagttgcagtgagccgagatcgcaccactgtacgctagcctggatgacagaatgagactctgtctcaaacagacaaacaaacaaacaaacaaaataaataataggattatatcagtctccttactacaatgtaaatcttatgaaggcagagattttgttctctgacatatccataggtgccttgaagaaggcttgatatgtaatggggttgtatataagtattgaatgaataaatcatcacttacttctctctctctctctctggtatacagtaacctccttgagagcaggaaacatgttttcgttctttttaaattaaattaaatttaatttaattaatttatttttttaattttactttacgttccaggatgcatgtgcagaatgtgtaggcttgttacataggaatacatgtgccatggtggtttgctgcccctatcaacccgttatctgggttttaaaccctgtatgcattaggttcttatatttatataagtgtaaacactcagcaagtgattggtaaattgtcacttcagtgtgtgtcttcagatgcgatttaatagtaaacctt

SEQ ID NO: 113 - DNA, 1038 bp, Homo sapiens
ttttaagattcagttgtatctttcttttaaggtaagggggcattagggagaaagttcaagcactggcttctttccttagtataaaatacagcatgtaaactacagccttctagtcatgctctgtgctttggagaagaaggggcttagtgctaagtgggccagaaacgtgaaggacttgagcacaagcaaccttttccagaatacctcagttctcaggcatgggcatggattaaaccagttagtttgttatcttgtaaattatagtaaagccctaaaaagaatggattgtaagaataaatcaagggtttggggcaagataatagcagtgttaccaacagaggctctttaggaggcctttttagcattaagtttttaatgaaaacggaaagaactagctacaatgtgattagtggcttgaaaggtttgtgacacaagaagatgtcttttatcttaataatgtagtacattctaataacatgcctctgatggtctgtgagagatcaaatgaggacaggtgtaattaagctctattattaacaataatgccttgtatttgtatagtgctttataatttacagagagcgttaacatccatcaatttatttgaccctcaaaacaaccctctttgtttacttatgcatatgtataagtaaaatatgtaatattacctccagttgaggaaaccaaaacttggctgggcgcggtgggtcacgcctgtaatcccagcactttgggaagcctaggcaggtggatcctgggacctcacttagaataactaagcacggtgctcgcttcggcagcacatatactaaaattggaacgatacagagaagattagcatggcccctgcgcaaggatgacacgcaaattcgtgaagcgttccatatttaaaaaaaaaaaaaaagaaacaaaaaccacaaaaacaaaacaaaacaagacaaacaaaaaaaaagaataactaagcacggcagaataaggatgcctggtgctatccataaccaagagttggtgatcattctgtgccctaaaataaagatg

SEQ ID NO: 114 - DNA, 1039 bp, Homo sapiens
tgacccatgaaacccgtctctactaaaaatacaaaaattaggctgggtgtggtggctcacgtctgtaatccagcagtttgggaggccaaggcggccgggtcacctgaggtcaggagtttgagaccagcctgcccaacacggtgaaaccccgtctctactaaaaatacaaaaaattagccgggcatggtggcgggtgcctgtaatcccagctacttgggaggctgaggcaggagaatcacttgaacccggaaggcagaggttgcagtgagacaagattgcacaactgcactccagcctgggtgacaagagcgaaactccgtctcaaaaaaaaaaaaaaaaaatgaatatttgtttggtgctatatgaaactgctttgtgttaagactaggtcaccaaactgaggcattgtctctggctctcagtttgtgcatccatctttcagtgatgcagaactctctatgcacatgatcctaatactggtgtctttgttcatctccagccttcatgctgaggtaatttaaattacaagttcaacagtagagcatgcattgaattaaccaaaaagtatgtccaggtttaaaagtattaaatttaaatttaatggtacattagaatcacatattgttgaatcctttataaataagggaattatgtcagtgttaaatggatgagtaccagttatctaaaaattaaaggatagcgagtctcctgacctagtagagacataggttctaaaatttatctcaccaggtgcagtggctcacacctgtaatctcagcaactctggaggctgaggccagaagtttgagaccagagtgggcaacatagtgagaccctgtctctttgaaaatttaaaaaacaattagctgggtgttgtggtgcatgcctgtagtcccagctccttggaaggctaaggcaggaggataatttgagcccaagagtttgaggctgcagtgagccatgattgcaccactgcactccagcctggggacagagcaagaccccaagtctaccaaaaaatataaaataaaataaaaca

SEQ ID NO: 115 - DNA, 3031 bp, Homo sapiens
gttgtgtataatcatctctaaaatgcttttgtaaaaacacaaatgaaagagatcttactcttaggacagaggcaaggggctgtatcagttaatataaagggtaggagtaaatgttatcctaatgttctcctatatgtaattctgagaaccaccatcatggtcatcattgggaaacacttattaagttcctactatgtgtaggatactgtgttaagtgtggtatgtagttgttagtagtgacagtgctttgaggaatttgacttttcatagacagacttatgatgtgattacaagttgcattatgagggagaggtagttacagtaattgtttctactgaattaattgctttctgaatcttaaaaaaaactatagtctgaaattatctgtgtttcttatctcctgtcaattgccattgcacttctacattatttattgaatacttaatatcaaggggctggatgcaaccaaaagatgttactgtcctttgactactcaagtctagagaggattgagacatagatgtgtggaaaggatgagtaaatgcaaatgactgtatgattaaatgccagcatgggtgagaaagacatgggatcagaatttatcaaaacaaagaccaccaggggctaagccttgcagatgaagtagcacttagttttttcttttgcgtttctattttttaggtatatcccagctgtggttgaccacacagcaggcttgccttgccaggggacatttttgcttcatcaggtactaatgagggaccaaaacaggcatcggagggaacactgaaaagaatttagaataagagacggaattctttcttattctctgttttcatctctatttcagagggtgggcggggcattgtcctgttgtcatttttttttttttctgtgtctgtctgtagatatttcttcctcagaccttggcttatatttatccttgcttttatatgtatttagaatagctattttgaaaaatattttgtttcattcaattactctaatttgtgtagctcctatgtcacttttaatacttttcatttcgtgatgtttggaagctctgtgctttcacaccagaagttcttaataggaatagaggatgaaggtttcaatggactaaaaatctggttatgaaacataggtccgcttttggtaaatcaaaagtaggttcagtcagtgttcaaaagtacttaagacccaagtgggcataggggctagggataccatacatttgggacatacaatcagggcatggttgaatacttattatacaaggggctgggatgcagccacataatctcctgtgacagattatggttattcttaaaaccatagagaaaaagaattttttaaaaaagaaaagaaaaccatatcagaacctgactgttccttagtccctgacacatctccctttgttttgaataacaatgtggatagcattttccgtctttccacacctctccttcctgctcatcccccatgccatgccatacaggccagaaaacagtagacgagaggagataatagattgcttcagctaaattgcaaccctgcttcattacctagggcatccagcgaaggatcacagtgaccattatccatgagaaggggagcgagctccattggaaagatgttcgtgaactggtggtaggtgagtacgtttcatcagccaaggatagaaccaggacttacagagattttttttttttttgagatagggtcttgctctgtcacccaggctggagtacagtgatgagatcatagctccctgtagcctcaaactcctgggctcaagcaatcctcctgcctcaggttcccgagtagctgggaccacaagtgtgaggcactgtgccctgttagagatgttattcttccctgtttgcggtacatggaatgtgtagaagaccatattcggaaacacagactatggagatgcagaggccttgagtttgaaactctgtattcctgtttcttcgctctgtcattagtgatatgttatccaactaactaactcagttaccagggaatggttctgtggtagagtctgtgagagggcataaaagaaatctctgctggctgggtgtggtggctcatgcctgtaatcccagcacttttggaggctgagatgggtggattacttgagcccaggggtttgtgcctggccaaggtagcaaaatcccatctctacaaaaaaatatgaaaattagctgggcatggtggcacgcacctgtagtcttggctactcgggaggctgaggtgggaggatcgcttgaacttgggaggtggaggttgcagtgagctgagatggcaccactgcattcaagcctggacaacagagtgggactccgtctcaaaaaaaaaaagaaaagaaaaatctctgctaattgtgagcttgcattttagttagggagacagcatatatatgtgcagaatgctttgatgaataaataccaaaatgaggacaaaggaaaatctgtgctaagagagttaacagtgaaaacaagccaggaggactgaatagattcaagaaaaattagagggttttttttttttttccagacacaagcattttgagtaagagagtcaggaatatgtctaacatgcaaatgacaagaaaccccatggccagagtggagaaagtaaattaaggagtattggctagatagtgtaaactttagaatgacagtccgaggcaagagtttggaacttttgttgccatggacctctttggcagtaacgaagccttagaattatgttttcaaatgtgagaaataaagtatttaggattacaaaggaaaccgataatattgaaatacagttgttaaaacattaagctcttctttactgatgcatgaaataacaagatttagcagttattctaattaccataatttccaagtagtgatcaatgaaaaagatatcttgtgtccaggcacggtggctcacgcctgtaatcccagcactttaggaggctgagatgggcggatcacaaggtcaagagattgagaccatcctggccaacatggtg

SEQ ID NO: 116 - DNA, 1030 bp, Homo sapiens
gtaaatttccctagggtacttagtaaaatatacagggaaagatgggctttggttgaaatactggttattctaattttgcctccattagagtaactttaagaagtcctttaattcacgcccaacaacaggtcaggtgctacaagaaatgaatttggctttgttagaagcagcttatcttgtgagttagaatgagttcatcaaaaaaggctgaagtcaagaataacaacaacaacaaaaaacaccttaaatatttctgttctcatttaaactatataaatctacattaatttatcaaacttttgctggaaagccatggccttttctttaattataagatcatttactggagttctgattgtctttcttgcaaaaccacacccataattcatcatctatgactttcagtttggtggagcaagaattagaaacctgtgaagaaaatctaagttcaaaatcctttaaattttttatcatttattaacattaatcatttaaacattttatcattttcccctttcttttacatttgtctcacccaaacttaacagttatttttaaacaactcaccattttctaaccttttgaaaacattcaacttagttttcacaggaacaaaaattatttatgttttcatatttcattgatttgcctaatgtttaatgaagttagataataataataagtacaactggcataaacagatttgggaccagatactactgacatttgataagcactcaactcttcggagcgaagtgtctgggcaaatgagacatctttgtagtttagaatgctcaaggagaactagccatcaatctgtatattttagggatatggaaaacataggttaatatggtaagtggcaaaatggagtttggttaagagaactttcgttctgtttgtctaaggtttaatgtttaaagttgaacttacctgcaatttgggtatattatgtgtgtatcttagagggctttgctaatacattgatagtggggtataattgacaagggaccattcattattccttttc

SEQ ID NO: 117 - DNA, 1050 bp, Homo sapiens
gttcctattccagataatgtgttcagagggctttaatataggcagagagattgtgtgacccagtggccatcaatgatcaatttcctttcataacttcagaaggatgacaccagttgaacgcagagttaactttctgaagccagcttgtctcctcagctgagctctctgcaactcaagtttgcagctggggtttagggagggccattgtgttcctcccagtgaaacagtactcagtatgccttgattgtaactgattctcttgttacccttttctttctaatctctctattttaaaggaccccagaagccaattcccgggcctctagtccctgcccagaatttgaacagtttcagattgtcccagctgtggaaacaccatatttggcccgagcaggaaaaaacgaatttctcaatcttgttccagatattgaagaaattagaccaaggtgagtactatattgagcaggaatgccagctataaaaaacaaatccacaggaagaagtgactggccagctcttccctgtgaggtctgtactgtagtctgatgcaatctgtactgtagtctgatgcaagttgagtctggggtgagagggccagcctgggtttctccagttgggtctcataatgcatctgcaccctggcgcagcatgttgccatggcacggtttcgcttttgccgtattactttggcagataagattctaggccaaataggtcatttgcctgtttcatcgaatctaaggacttggcctaagtgtggcgtattttgatggtcctcagcacgattattttctttttgtgagaaactaacttttgtcatattgtcgtttttagctcagtggtctctaagaaaggataccttcatttcaaggagcctctttacagtaactgggctaaacattttgttgtcgtccgtcggccttatgtcttcatctataacagtgacaaagaccctgtggagcgtggaatcattaacctgtccacagcacaggtggagtacagtgaggaccagcaggccatggtgaaggtccgtcctgccctgccttggtt

SEQ ID NO: 118 - DNA, 1028 bp, Homo sapiens
attttcatattgaaaatcgtcagattttcttcagcctcaaaaagcgtgtttatgtaaaattaaatgagcgctggcagcgagctgcactttttttctaaacaggaaaagggttaacagcttgaagaaatgagaaatgtaactttgtttcactagggtatacatcggcttccagcttacttccctgttagagttaagattcattgcatttggccgggcgcggtggctcacacctgtaatcccagcgttttgggaggccgaggcaggcggatcacgaggtcaggagatccagaccatcctggctaacacggtgaaaccctgtctctactaaaaatacaaaaattagccggttgtagtggtgcgtgcctgtaatcccagctactggcgaggctgaggcaggagaatcgcttgaacctgggaggtggaggttgctgtgagctgagatcgtgccactccactccagcctggtgacaaagcgggactccgtctcaaaaaaaaaaaaaaaaagactcattgcttttttccccccttgattatttcagtgtattcctaggaaagataaaggatgcatttgatcgaaacccggaacttcagaacctcctactggacgacttctttaagtcagctgttgaaaactgccaggtatgtagcctagggctggtgccatggttactctacctccctggggccatcagttgtgatgtttggttttttgttttttttttttggttttttgtttttttgagacagagtctcgctctgtcacccaggctggagtacagtggcatgatcttggctcactgcaacctccgcctcctgggttcaagcgattctcctgccccagccttcctaagtagctgggactacaggtgtgccaacatacctggctaattttttttttttttttgtatttttagtagagatggggtttcaccatgttggctagactggtcttgaactcctgacctcgtgatccgcccacctcagccttccaaagtgctgggatgacaggcgtgagccaccgcgcctgg

SEQ ID NO: 119 - DNA, 1030 bp, Homo sapiens
ttaacctggctggcccctcgggggcgtgcgccatggactgtcctgaccaacctactctctcgtttcctaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtctgatttatttcctttcccacacctgtctctacttgctctaagccaggcccagggattttgaacaagctaa

SEQ ID NO: 120 - DNA, 1041 bp, Homo sapiens
ctttggtgaggactgtcaggaacctcagttcttctcactggggattacttaccctacacaatgcatttaacagcacatagttcatagtagataacccctgagtatactgtattccattgatttatacagttacaaatcctgctctctcaaatacaaatctctctcaattggccagtcatcttagatctaaaggtgtttttcaacctgaagtcccccccgcttttttccaagttgctgacagtgactccagtgactccggtgtaaccattgttatgagactgcaaagacaagaatttactcctcttccttgcacctcagttttatctctaagtgacacatagtgaaaattatgaaatttccccaaaattgtggaattggtggtggcagggttgttttattttgctttgggtggagaaggggacagaaggtagggtcagagggatggggggcggggagaaactggtctgttttctttggagtttgttgtctttattttgattaaactagctattggtaattcgaggtgcactcattaagaactcagtgcaagaggaagggaaaggaacgctgattccatatttatcacaggctcaccagcaagcagcttcgacggcggcatcagcagcttagtgccagaattctccctggcttgctgcactcccacaacatgtgcaataaagttcctgtctccgttttacatctttgacattgaggcggaagatttggcctgaatttatgtaatttagttgggcacaaatataacccatgaatagtcacattcatcttctaattagaaaatcaaatgataatacaggacaggctgcaggcaccccatcatcgaatccaacaaaagcgtgttgtgtgtgttgggcctctgcagaggaaagtcagttgaattgcttcatgaaattaatgaaaagtgcccaacaataggtgggtgaaaggcacaaaccgagtgccctgtcagttatttagtgtgtgaagatgttagcattatgggtaaagagttttgcaaaatcttctcccatcgatgtatgaatc

SEQ ID NO: 121 - DNA, 1010 bp, Homo sapiens
aataaatgtttttgttttccttccaaccacttgattctgcagatgacacatcaactgcggagtcagccacacatcaagataattggactgtgtgtggggtttaagccctcatagaaccagtctatatatagaagcagttcttgccaggcaggcatcatatctggggctttaagcaggctgcaatccaggaggttagagtaacgtaaaaacagcaatagaatcagtccagaaagttagaggcttggaaattgtcgtcaataggcttgtgttgatttgacaccctatccagccacaaaatgtaggaggcagtctgcttccaaagatgtttggcaggctgaggatgaggtgggtaatagtgatgcttgcttgtgaggggggtgaggtgggggagggggatagagttgtctgttaacttactctaacatatctgttgcaaagcaagcttctaggaaagacaaacatcatctatttttctgtataaccctgcatagtggggcctgggtgctgttggctcacacttactgtgtccttctcaagtgtctaagtaaagggctttttcctgcctcatccaagaaatggtcctggttggggtaggcaaatgaaacaaataaaacacaccaccatactttctcattccaaaaggtgaaactagatcttatccttctactgttcctggaagtagaaaccccggtagcaaaaccgcctccttgctggaaatgaacttgaagaaacctggcggtcccaaccttggtagtgggctagaggtaaagggcttctctgtagaatatttcaagggggagtaaattcttacacagatttcaatttaactctcttttattacttttcttttttttatcatttacgtctatttcatgaggtagtttgcatgtccttgaatggaatctcgttaccatgaaagcttttttagcattgatttcataacagtcttaatttaatagctccgtcattactgagaagctctgggagtggggccctggctttccaggtca

SEQ ID NO: 122 - DNA, 1017 bp, Homo sapiens
agactccgtctcaaaaaaaaaatctgctttttagattcatttactctaagtttgttcatgcctgttatctatatatttatatctatgtttgtatcaattgttggttcccagtttagcacatagaggcagtatgattcactggaaaaatcatctatccatttactaattattaaatatccatttccttcatgtgccaacatttgtgctaaacataaaaatacaaaaataagatttaatatttgtagtttagtggggttccatgatatataaacagatgtggtgtgggtgataaaatattataggtgctataataggtatctgagtggaggcctggggggagagcgatcagttttgtggtaggggaggagaactagtggcgaagaggttaaaaaggtgcctccattcatggaggaggtcccctttatccgagccctgcaagaggattagttgtttttaaggtctgaagcggattggtgacttttgtccatgcagaggatgtgatggggcatagccactaaggcgagagatcgaggagacagcttggaaaggtgggcaaaggtgggatcagggaagacctggcatgtgttacctcaagagtgtggattttgttatgtggacagtggggaaaccacggaaaagttgtatgtggaataataagtttcatgctagcgttttagaaagctctctcaaaggtagggcgggcatttaggagaggggaatgatggatgaaccagggcagttattacggggatggagaggatggattagagagtgaggaagcagaatctcctgggaattggtggctgaatggatgcaagagtgaagaagagggaagagtctgggctcactgtccaaatttttggcttagggagctggtgtggaggatagcagatgaaagagtagaccaggagtgagagacgctgtgaagagagaaggcccagagggaggtgcgggggaccctgtcacgtggttagtggttggccagaggcggatgccccacagtcaggcagtggcgct

SEQ ID NO: 123 - DNA, 1054 bp, Homo sapiens
taaaataaaatacacccattttaattgtacaatttgagttttgataagtgtacatttccatataaccatcactacatgacagaacatttccaataccctgaaaggttcccttgggtcccatttccagtcaatccaccctccttgatcctggcttgagggcaaccactgatctgctttctattactacctattagatttctttcctagagttttttttctttttttaatataaatagaatcatacagtattgtactctcttgtttctattttttttctttccgctcagcgtagtgttgccgagattcacccaaattgctgtgcgcatccgaagccttttcctttttaccattgggtgggtggtattccattgtagggatgcaccacagtttgtttatccattcaccagttgatggactttgggttgtttccagctttgagctattacgaataaaacttttgtgaacattcgtatacaagtctttgtatgtttttatttctcttgggtgagcgcctagaagtagaattgttggtttatatgttaagtgtatgtttaactttataagaagctgctaaactgttttctggagtggttgcatcattttaccttcccaccagcaatgtttgagagttctagttgctacatatccccaacagttggtcttctcagtctttttaattttagcagttttagtgtgtatatgctggtatctcatggtggtttgggtttatatttctttgatgactgattaggttgaacctctctttgtgtgtttattgtccacttgcatatctttcttgtgaagagtgtgtttcagtattttgcccattattaacagtcttcttactgagttgaatgaggtttttaatgtattctggattcaagttgttggtcagatacatgtattatgagtatttcctcccagttggtggcttgcctttttattttcctaacattaccttttgaagagcacacaattttaattttgatgacatatatttatctttttttccttttatgattcatggttttgcatcctaaagaagactttgtct

SEQ ID NO: 124 - DNA, 1074 bp, Homo sapiens
cttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaatttctgcctgtggctccctgtctgctcatggcaccctgggcccgggggttcgtctcagcgcagcctccagctggtgaagtgtgggtgagggcccatgggcagcttccgccgctgctgagccagaagcagaggccttgttcaggtccagtggctgccggagggcgacactttgctgaccgcaggaggatcagggacctcgtgtgactgtatatagacctcatgtggagtgaggagctcttccttaaatggacgaatgcttcccggggaggggagtgtggcgtcctctctggctccctgtctcccctggctcttttcctcccagtctccctttccccttcacagagcatttggctaaaaccagaagagcagagccatgggctccttgaggggcgctc

SEQ ID NO: 125 - DNA, 1008 bp, Homo sapiens
ttttattacaaaagttgtgtatttgttgttgaatgtttaggaaagataaaagttaaatcttcatcaggatatacaagttgctgatatttaaagtcaaagtgaagtagaattatttttgttttgataaaccttttgagagggagagattgtaatccggaaatgctacaaaaaacaaacttggaaatcactgaatttgcaccagaaaagcacctcagacactaaacttaagcctttattctgtcctctagagcaaacatcacttcttgccaagttttcagtgtcttattcttcttagagtcttctttttgcttctcatttctagatgtaggaggtagtgtttttaaagaagtgctaagtgaagatttctaaaaggtttctgctcgttttatttagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtaaacttcgattgcatcaaacagtttttctttaccagtgaatgagtatctagcatttatttattggtataaatagagatggggtatcactatgttccctaggttctggcgtcaaactcctgggcccatactgtcctcctgcctcgaccccaatgtgctgagccaccatgcccagccacaatcttgttacctttcttttttttttttttttttggagaccaagtctcactttgctgcccaggctggagtgcagtggcacgatcttggctcactgcaacctccacctcccgggtttaagtgatttctcctgtctcggcctcctgtatctgggattacaggtgcccgccatcatgcctggctaattttgtatttttagtagagacagggtttcacccgttggccaggctgttcttgaactcctgacctcaagtgatccacctgccttggcctc

SEQ ID NO: 126 - DNA, 1046 bp, Homo sapiens
gtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgct

SEQ ID NO: 127 - DNA, 1044 bp, Homo sapiens
tttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacataaacatttatcaatgaagtcatcctttagacttgtaatcgccacattgtttcattattcagtttcctctgtaaagggatcttgagttgttttaattttttttttctgcatctgaatctgcatgatttccaaaccctgtaccatctgaattttgcattttagcacttgcactattactcagcagcagtaacatggtaacacttaaaatggtactcggggacctccaaagactaaactgacaagccttcaaggagcccaggggtaagttaacttgtcaacggcatggtttaatcccttctttacacttgtgtaaatttcagttactggtcatagaaggctttcaatgttgagtggccttttattaacatgtttatggtactgcatagatacgggtatttattttaccctaagaagattttgaagtttaaaagtacttaaactatttggcaaa

SEQ ID NO: 128 - DNA, 1042 bp, Homo sapiens
agccctttgggaggctgaagcgagaggatcgcttgaggccaggagttaaacaccagcctgggcaacatagacccctgtctgtataaaatataaaataaaaaatattagctgggcatggtggtgcttgcctgtggtcccagctactttggaggctgaggcgggagaattgcttgagcccaggggtcaaggctgcagtgagtcctgatcacaccactgcactccagcctgggcgacagagtgagaccatgcctcagaaaggtagtatttgagttgagttacattgaaggaggtaagaggtgagggagttggccaagcagatatctgagagaggagcatttcaggaaaagcaacagcaagtgccataggccttcaggcaggaatgtgtccaaagagcttacagagcagcaagaagtccagtgtgtgaatgaaggagagagtaaagagaggtaaagtaagagaagtacgtttggggagggtaaggaggcacacacacggattatatagaccttgtaggccactggtcttggctctggaatggaggagccactgcaggactttgagcaagggagtgatgtaatataatgttttaaaagaattgctctgggtaaggtattgagaatggatcaaggggagtggggcaagggtagaggcaggaagaccaagtaggaagctcttgaataatccaggcaagcgatgtttggtggcttgtatctagcgggtggtagtggaagaggtaagtagccagattctaaatatgctttgaaggtagacagggtttgctgatggattggatgtgaggtaaagagaaacagaggaattaagcataactcaaaggtttttttttttcttggacacattccacattttatttacattttcagactaactttgggctgggtgctgtgcctcatgcctgtaatctcagcacttcgggaggccaaggcaagtggatcacttgagatcaggagttccagaccagcctggccaacatggtgaaaccttgtctgtactaaaaatacaaaaattagccaggcgtggtggc

SEQ ID NO: 129 - DNA, 1024 bp, Homo sapiens
ggcgggcacctgtaatcccagctccttgggaggctgaggcaggagaatcccttgaacccgggaggcagagattgtagtgagccggggtcacgccactgccctccagcctgggtgacagactacatctcaaataaactaaaaaaaaaaaaagagagagagaggttgcagtcctgattctgacctttggcaggggaaatagctggctctggctgccccagcccctcctccgttcagctccgggcttggagctggaagccagttgatgccctcccctctccctgcttccccgagccgctggcaggcactggtacttcccctgtgccaggctctgtgtcgagggctttacacgtattatctcatttaatcctctcacccacccagactacatagtctctcctcaatgactaccttccattcattcgccctgttctccgcttcctagccctgatgacaaatcatgatatgcttttgcttgtttacttgttgtctgtcttcccacttagactgtaaattccttttgttctctgcagcatcccgagcacttgtagaaggcctggctcactacattttttctttttaaataaatgagggacttaatcaagtgactaggctcagagtcattttctcaggatcacccagcttgtgtctgtagagctggaatccacacccatgttgctgagggaacctgctcccctgtgatgacaggagctgctgggaggagtttgagtttcaggcccagcacagaagccaagaataactgaaaccccagtgcctttacattcacctctgcacaatgaatcgagcttcccagtggtgctgggagcagagccggattctcccctaaactggaggctggccatcggacacccttcctggcctgaactctctttccttccctgcagggaaccccagccatggctgcatgctctggctgggagtaacagtgagcctcaggctggggaggcagagggacagcagagcacacacccctagatggatgtagaggatatgggaataaagacca

SEQ ID NO: 130 - DNA, 1063 bp, Homo sapiens
atagtttacaatccaatgtgtggtgggcaggttggggaggtggagggagcactagcacaaagatggttacagtgcagtggaagaagtgccagaactggggggtccaggtccctgaagcccagaggcaggggcccaactcagcttaacggttggggaagatgccctaggggagctggcagcttccccaaccccgagggcaccagccaggtaacagcggggaagggaaaagtgtttcaagtgaaggaaatagcataaacagcaagaacaaaggcctagaggagagagagagcaaaatgggggtgcagcctggaatgggaggccacggggaaggaggtgggggcttggagggtaagctgggaccagcctcacaggacctgcggggccacactgtgtcctcctgactcatctactccctgacccctcacaccaccccggggaatcccatgatgggaagaggtcagatcttcctgccttctgtccaggaagagggactgaggaacaggactgtttcccatgcatgagatcctgagtccacaaccccagccgagctccccttcaaaggtggtgggcaggggagcaggggactcggagacacacagggagggaaggagtatttttttttctttctttttgagacagagtctcactctgtcacccaggctggagcacaggggcacgatcttgcaacctctgcctcccgggttcaagcgattctcatgcctcatcctcccaagtagctgggattacagcatgcacccccacaactggctcatttttgtactattagtggagacaagctttcgccatgttggtcagtctggtctcgaactcctgacctcaagtgatccacccaccttgggctcccaaaatgttaggatgacaggcgtgagccactgcgcttggccgggaaggattctttatctttgactaggagtgcttgatgaaacaccggggctggggaaggggtgggaggatgagaagtggaccagtccttgcagtgtcaggactccctccctggggggccatctcctccctccctaacaggctgggtgcttggctccag

SEQ ID NO: 131 - DNA, 1071 bp, Homo sapiens
ggaatcaaagaagatccgggcttcttccccctctgcccttatttttgaccttgggcagtgccttccacctctattgtgagaggccagagaaaaaaatcagagctcaccttttattaaagtacctgatgtgtcccaagctccttggaccgccccagtgacccctggaggtaaggcatccatttacagagaaggaaacaggctgggagaggcaccatgctctcccgagataaatggcagagcagggatgaggcctgcagcatagcttttcaacagctacaggagggtgtccagaagccacaagccatggctgtggggaacatcaacgagctgcccgagaacatcctgctggagctgttcacgcacgtgcccgcccgccagctgctgctgaactgccgcctggtctgcagcctctggcgggacctcatcgacctcgtgaccctctggaaacgcaagtgcctgcgagagggcttcatcactgaggactgggaccagcccgtggccgactggaagatcttctacttcttacggagcctgcacaggaacctcctgcacaacccgtgcgctgaaggtggggtacaggccgggtctggcatgcctccagtacacagtcatgacaccaggaacatgtattgagcacttagtatgagccgggtactttggatggtttaacacctttacttctctcacagtaacccaaagaggtagctactgttagtgcacacatttttcagatgggcaaactgaggccaagagtggtgtttcttattcttactatactcttttttttttttttttttttttgagacggagtttcactctgtcacccaggctggagtacagtgacacaatcttggctcactgtaacctccacctcccaagttcagcctcccaagtagctgggattacaggcatgtgccaccacacctggctaattttttttttttttttagatggagtctcgctctgttgcccaagctggagtgcaatggtgcgatctcggctcactgcaacctccacctcctgggttcaagcgattctcctgcctcagcctcccgagtagctgggattacc

SEQ ID NO: 132 - DNA, 1050 bp, Homo sapiens
ttaaggggttataggaaaagaaacaacaacaaaaaaactatacaatagagatagtatgtgggccacaagtcctaaaacattttggcactttgccaaaaatgcttctcagcccctattcttactccagtttacagaggagacgaccaagggtcagagaggaaaagcaactggtccaaggtcagacaaccgagtactggtagagctgggactagacccaggtctgtctggcccacatcagagcgttctccatcacagaagaggtctggtcatttccatcaccatgtgtctcagggcccccagggaagtcacctccctgtgcctgcaacacaggaagcacctaatacgcggtgggcactgtgatctgcagcgtcccacagcacagggcttgagggcagccgccaagatgcaggcagaggagtggggaggaaggggcatttgggagaaggcggccactgaggggcttcccttcagtgtgaactctgcttttccatcagaggggttcgagttctggagcctggatgtgaatggaggcgatgagtggaaggtggaggatctctctcgagaccagaggaaggaattccccaatgaccaggtcaagaaatacttcgttacttcatattagtaagatccggggacttggggtaggggaaagcccaaatcaatttaccctggggtctctcccaccctggaaggggcagtcctagcccctcactgccctagtggtgagcccagcccctcccacccctctgcctgcccccagcacctgcctcaagtcccaggtggtggacctcaaggccgaagggtattgggaggagctgatggataccacacggccggacatcgaggtcaaggactggtgagtgcctggggcgagggtctggggtggggcatgccaatcaggcgccccacccccgccctgcccccaatctccgaggccctgatgggccctccctctccctgcaggttcgcagccaggccagattgcgggtccaagtaccagctgtgcgttcagctcctgtcgtccgcgcacgcgcctctggggaccttcca

SEQ ID NO: 133 - DNA, 1085 bp, Homo sapiens
cacttgaacacgggaggcagaggttgcagtgagccgagatcgcaccactgcactccagcctgggcgacagagcaagactctgtctcaaaaaaacaaacaaaaactctggctggatagattgattctgacatttgtgtctgggctctgttgtttgtaagctttatgaattgggccaatttacttaatctctcagagcctcagttctaccccatacagttacacggatgacatgagttaggggcagtgcagtgtagatgcatggcaggctggtgcttgtcagtagcaggagttgctgctgtcgttgatgatgcaggatccctgccccacataggtatttaacagttagtaaacggatacttacagtgaccgtccagatagatgcttgtctctggcagttgaggcacccccgtgggacaaatgggtactgcctccgtttcgcagaaaggagcctgaggccttggcgcctggaccagcacccaggtttcctgttccagcatagcatcctgggaccctctgctgccttggtccattgacccctgtctgggaaagagctgggcggcctcccctgggctgagcactgtagtgagagtccaggggctcaggtccgtccttcctgcccagctgggaaaggtcctggccctgccacccgtttagctcaggttccttccctgcttccagctcctctttcaggccatacctgagaatcctgtgtctctttggctaccaggaagctcccccagggccaaaagacagtggttttgtcctgacagttactggcccctctttccctgggctgccaggaagtgcagggcccgtttggctcagtttctccctggagtcttcctgcacattaaggcctctctgggtgtcctcctgttacacagatgaagaaactgaggcaggggaggcttaggcttctggacgtttcttttcccaggggcttaagaggagcaactggtgctaactttgttcatatttatcaaaccaaagtgacgtcacgcagaggagactgtgtgtgtgctaaggatctgcagtatttccaggttacgttgttttcttccctaacagagatggcagaggtgtgg

SEQ ID NO: 134 - DNA, 1044 bp, Homo sapiens
atgctctttgaccttctgtcccagggagtgagtgggtaagagaacttccttctaggaaagagactgtttagcaagcccttttctcaccttaaccccaaaacaaggtctggtgtttttacacgtttataaatctgtggcaccttaacctggatagagtatgtatttgccattaaactgtttgcttttacagcttacagagagacttagagtgaaaggcactggcaggcagtatgtgcccctaacaggtgtgtgcttataaactgttaaggaggccttgcttctcttctaggagagcttgcttttcagatattttcttgctcaagcagcttctctctgacatgttcttgattaagttccacctttcatgtatgggattcttagagtatgtgtttttagtaaagccaacactgctggggtgaaacaacatgcgtgactttttatcattaaattcttaaacgtaataaagaaggtagagaaaagcctataactccattcattaaaagatgactgttaacaccttactaagtatctttctacatccttacccatgcttttatatacatgatacatgctttttttaagtaacaaaaatgagattccactaaatcatctattttaacctgtcccactcaccccctttattatactttttgtatcattaggtaattttccacaaccttttcttttttttgacagagtctcactcttccataaattcttcatgctgtagaatttagtgtcagcgttaggatttgtagcacttttttgtttaacttttattatgaaggatttcaactatatgcaaaaacagaataatctgttgaaaccccttgtcctcatcacacagcttccacagtgatttagctcaagcccagtcttcttttgtctgtgctttcgttatccacttctcctttctcatattattattttttattgtatgtgtgtgtgtgtttgtgtgtgtgtgtgtgtgtgtgtgtgtgtgtgtgtgtgtgtgttttaaagtaaagacagtctccctatgttgcccaggctgttctcgaactc

SEQ ID NO: 135 - DNA, 1054 bp, Homo sapiens
gctggaggggcttacagggaaagccctggcctggtgaataacattgtcatttgtcattataacatttataacattataatgcaataacacttgtcattataatcaagagtgccttttcttttttcccttttttttttttaaatgaataatcctggcacagtttttcacacttcccctgcttttgctttgtgaaatgaaagcgagacacatgacaatggtgctcttgaagcgctcaaaggtttgggcaggactttatcttttatgatatgattatggatcataatctctaatctacctagtaaactagatgtctccctaatgggtagataatgcattgggtagagtaaataatggaagttaaagttacttttttttttcttttaatttaaatagagacagggtctcgctttgtcaccctggctggagcacagtggcgtaatcacagttcactgcagcctcgaccttctgggcttgggtgatcctcctacctcagcctcccgagtggttaggactctaggcaggcatgagatcgctctttagggaaaaagcgaagtcgtgggtacggaactgtgaacatcgtgcccttcatttagcacagcgtgccagtgaacagggtggcacaccatagctattgatctcatgcagggagtttatggtgctatcctgggctcctccccgtacgtcgttaatgttatctagaagatagagccagcagctgtgagtgaagggatatgcccgtatgaacagagttggtggaggcagcaacttcacaggtgaatcaaagacaaggcaagattggaaacatggccaaagatgaggatagcaaaaagtctggaaccaaaactgccgacttcacattgttaaatatgaggaagagaagctggaaaaatcagcatcagtcaaaaagatccatgtcaaatctgattccggtcagtacagtgttgggatagggtatctgtcctcagtaacagcctgttgaccacctttatcttgaactggccacaagcctcctacttaatttgacatgatatgcctagaaaatgtacacatgtgt

SEQ ID NO: 136 - DNA, 1012 bp, Homo sapiens
cccaaagtgttgggattacaggcatgagccattgcacccagtcatctcaggcagtttttaaaaaatttttatatatagagaaaaagtgcactcagcagccagcatgatccaaaggagaagcagctgcaccctctcaagtgatgacggggacacccctcggctgatgaacaagtttccttaacccagtttccgcagcggtggaggagtgcagccagaaaggctgcctcgctctgtctctccttgaactcctgggttttaacctcacctttgtcttcctggcaagcctccttgttctcattgaggtgaggtggtttggattcacctgctcgcttaggaggttttagagtcccgcactccttttccccacctccttccagaatgtcaggaaactgagaatgcagattcctgcagaaagtggcctcttgttcactaaaggtaaaggtttcacctctggtgagattaaagaagaaaggcctcccaggtgatgctcattcacagggaacttgtacagattctggggggaggaaaaaagggggaaagggctgaaaacaaaactgttgggtgccatgcgcactacctgggtgacaggatcattcatgtcccaaacctcagcatcatgcaatataccctcgtaacatacctgtacatgcaatccctgaacctaaaataaaagtggaaattatttttctttaaaaagtgcaagtctggccactttgggaggccaaggcgggcagatcacctaagatcgggagtttgagaccattctgaccagtgtagagaaaccctgtctctagtaaaaatacaaaattagccggtaaaaatacaaaattagccgggcgtggtggcgcatgcctgtaatcccagctactcgggcgactgaggcaggggaattgctggaacccagaaggcggaggttgcaatgagtggagattgtgccattgcactccagcctgggcaacaagagtgaaactctacctcaaaaaaaaaaaagaaaaaaaagtgcaagtcctcc

SEQ ID NO: 137 - DNA, 1034 bp, Homo sapiens
ccttcaatgattcgttgttattattacccccatcctcagatggggaaactgaggcttagagaggttgaggtactagctcgagacctcaaagctcccattcttgggggctactccagatccctggctgctgttggagaagtctcagttccctgtgaactgtcactcttagtcatttccctctccagtcctgagaagagggagttattgtggttgggagtctctgaggtgaaggagggaagattctttcgtccagagctcgtcttttggtctctctcctgctactgccttgagcaccagatctggcagaagtgagccaaggggtggaaggccaggcgtggagtgggcatcagtgtgcacctttgtggggcagacagaggacaggctctgggcccttctcttcctggcgctgctgagcagagcagactcggtcttctgcaacagcttccgcgtccccttccctcagctcagccatttgcctttattctttcagacttgttgactctgcacaaaatgggatttcagaaggtcctagaaacacgagggcaggaaaaataagctcctcccaagggtggggggtaatctccttttttcccaagtttttttattttcattttttgagacggagtctcactctgttgcccaggctggagtgcgatggtgccatctctgctcactacagcctccgcctcctgggttcaagcgattctcctggctcagcctcctgagtagctgggattacaggcatatgtcaccacgcctggctaaattttgtatttttagtagagacagggttttgccacgttggccaggttggtctccaactcctgaccttaggtaatcagccgtccgcctcggcctcccaaagtggtgggattacaggcgtgagccatgagctaccacgcccagcctccttttttcccaagttgctgttctggactttccttcctgcagcacacttacccaggtgtgctcaagcagaggggcctcccctgatgccgtggattcccatagtttcagtcctaggctgcccctga

SEQ ID NO: 138 - DNA, 1066 bp, Homo sapiens
cagttcatgactaggtttaggaattgggcactgagaaaattctcaatatttcagagagtccttcccttatttgggactcttaacacggtatcctcgctagttggttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtattagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggc

SEQ ID NO: 139 - DNA, 1101 bp, Homo sapiens
tttttttttaagttcaaaaaaattctttacttattaggctaattgtgcaattaaaaaaaaaaaaaaattgcaaaaaccgcaattacttttgcaccgatctaatagctcgcccactgtaagtaaagcaggtaaagtcagcctttttcttctgggaccagactctgctctgccccgcggtggtggcctcaggcgcagcgctaaaacgcatgaaccatttaaggtatttcctgaaactggagcgtgattggtgagactttatttgcatacccacaatgcattgcgcactaaataatgttcgtctttaaaattatttcccctttttccttcaacatatctttctcggaaccgagattgctgtcccagaattgtctgaagaaaaaggctgaagtcaatagctcttttgggccgaaggaaagttaccattacccgtttaggagtagccgttacctgagaactgtagtgtcgacgactgatgttatactctggtttctcttcaaatcgtataaatctttcgccttttactaaagatttccgtggagagaaacgagtgtgagtctgaaaccaattttttgaggccttgcgtttcttagcagggcttattttaagtgttttaaaaacagatgcgattccgttaaatcgcgtgtggagctatgtaaagtgtattatagaacaaatgcgagttacggtttttcagcttttcgctttgttaaggtatgtgatatcaattgtattgcatttctgagcagttataatattaagatgttggggtggcttactgcttttgaccaagaagtagggtttgttggttgattacaccagtggtttttaaccccagccactgagtgatggagggttaccgactcacaagcgagcattaacgcctgaggtccgcctgctgtcagggcagcaaggcatcagattctcctaggagcgggaaccctattgtgaactgcgtatacgaggtatctaggtgcgtgctccttttaagaatctaatggctgatgacgaggggcacagtttcaacctggaactgtccacaccccctacccaccttcccccgcccttggaaaaactgccttccatgaactgggtcccttgtgc

SEQ ID NO: 140 - DNA, 1030 bp, Homo sapiens
caaagcaatatcttccatcacagggaactgggagaataaaaggcaacatccaaacaggcagatatccctagagccgaggtcagatgtcccacagcccttcctcccgtttgtagaaacttctagcagatctccagctcctgcctttccctgtgggccttgatttggccgtggtgagagaaggacagctgcagagatcagaggctcagctggccgttcaggtcatgctgttccctactagagaacagaagggtcccaggagtcagtcaggctgcactggatggtgtgggggtggggccgggtctggggagacctaagtgggcagctggccccggggaggctaaggttggctcccacgtgcagggcatcccaagctcctgccagaccctgttcctggcttcagttcaagcctggggtggggatgaaggatgggggaggggagagggcggaagggcttcattcattcccgcctccccagggagcagactgggtgtgtcatgactgtgccttgactcaggccacacagtgaccacccacgccttgggctgggactgcttggggaggagggggcatccggtggcacagtcaaaccaggggtgcccagaggtcccattcttccaggagctcatcacatacgcacaccccaaccaagccctcaccgtcagtctctccacatcattctttttctttttctttttttgagatggagtctcgctcacctagtctggagtgaaatggcatgatctcagctcactgcaacctctgccccctgggttcaagcagttctcctgcctcagtctcccgagtagctgggattacaggcgcccaccatcatgcccagctaatttttgtatttttagtagagatggggtttcgccatgttggccaggctggtctcgagctcctgacctcatgtgatccacccgccttggcctcccaaagtgctaggattacaggtgtgagccaccgcacacatcattcttctcttaaaagtttttctaaattttatttttttgtacagacagggtctcac

SEQ ID NO: 141 - DNA, 1072 bp, Homo sapiens
gcaggcaggtaggagtagagggattgagaaacctgagatggagtttggtccctgagctgctgttgccaccgtgtggctttgagttgccttgaccgtaagctactaggttttcagttcctggtttgctattggaatggcttagcttggttccctagacttcccccaggtggagctggggaggaaagggccaaggtgggatgaggggcattaggaagggctgtcgggtccaagttcatcagacagcaggagcaggtggcctgctgagggtgctaggccctgtgttctctccgtgagaatcccaacacctgttcctgtcctggaaagttcaggtaccatttttttttttcttttcatgtgtgtgtgtgtgtatatatatatatatataaaaagaaatatatatagattttatttatatatatatatatatattttttttaaataatagagacggggtctggctgtgttgcccaggctggttgtgaaccaggcacaatttcattttatttattttaattaattaattaattaattaatttagagaccgagtctcactctgtcgcccaggctggagtacagtggcgcaatcttggctcattgcaacctctgcctcccaggttcaagagattctcatgcctcagcttgccgagtagctgggattatagacgtgtgccaccacgcccagctaatctttgtattctttatttatttaattgtgtgtgtgtaaattttttttttttttttaaggcagtgtctcgttctgtcacctaggctggagtgcagtggcatgatctcagctcactgcaaccttcctttcccaagttcaagcagttttcttgcctcagcctctccagtagctgggactacaggcgtgtgccaccatccctggctaatttttgtatttttagtagacactgggtttcaccatgttggccaggctggtctcaaactcctggcctcaggtaagctacccacctcggcctcccaaattgctgggattacaggcgtgagccaccgtgtctggcctaaggcacctttttattttatttattttttttattttaatgatcccaga

SEQ ID NO: 142 - DNA, 1927 bp, Homo sapiens
ctatcctgttctgtttaaccctcattttacagaaggggaaactgaagctcaggttggtcacagttagtaaagagtggaggtgatgtctgcccagggctgcctgactccaaggacagagctcttgatcacttactctttgggtttttttttttttgagacagtctcattctgttgcccaggctggagtacagtggcgcgatctcggctcactgcctcctgggttcaagtgattctgtctcagcttcccgaatagctgggattacaggcgtgcgctgctacacccagctggtttttgtatttttagtagagatggggtctcaccatgttggccatgctggtcttgaactcctgacctcaggtggtccacccgccttggcctgccaaagtgctgggattacaggcgtgagccaccactcctggccactactcttcatttagtgtcttccttagcagcgcttgtggctgtcactccagaaggcatccccaggcaggcagtgctgagggccacttggccatgacaggagatcatgacgggagaacagacgggcaggggggcggtggggaaaggccactgatgctttctgtctcccagggcgggggctgtcggttcctgcgctacaactgttccatccgagccccaaggaagggctggaccctcatgcaccctggacgactcacgcattaccatgaggggctccccaccaccaggggcacccgctacatcgcagtctccttcgtcgatccctaattggccaggcctgaccctcttggacctttcttctttgccgacaaccactgcccagcagcctctgggacctcggggtcccagggaacccagtccagcctcctggctgttgacttcccattgctcttggagccaccaatcaaagagattcaaagagattcctgcaggccagaggcggaacacacctttatggctggggctctccgtggtgttctggacccagcccctggagacaccattcacttttactgctttgtagtgactcgtgctctccaacctgtcttcctgaaaaaccaaggcccccttcccccacctcttccatggggtgagacttgagcagaacaggggcttccccaagttgcccagaaagactgtctgggtgagaagccatggccagagcttctcccaggcacaggtgttgcaccagggacttctgcttcaagttttggggtaaagacacctggatcagactccaagggctgccctgagtctgggacttctgcctccatggctggtcatgagagcaaaccgtagtcccctggagacagcgactccagagaacctcttgggagacagaagaggcatctgtgcacagctcgatcttctacttgcctgtggggaggggagtgacaggtccacacaccacactgggtcaccctgtcctggatgcctctgaagagagggacagaccgtcagaaactggagagtttctattaaaggtcatttaaaccactgaagggaagatgctcagggcgagtgggtgtgtgtgtgtcttggtgtgagtgtctgcagggagagaggttttaagagccctctttttttttttttttctttttttgagacagagtctcactctgtcttccaggctggagtgcaatgacgctatccccgctttctgcaacccccgcctcctgggttcaagtaattctcctgcctcagccttccgagcagctggggctacaggcacccatcaccacgcctggctaatttttgtttttttattaaagaaagggtttcaccaggttggtctggctggtcttgaactcctgacctcagatgatccacccacctcggcctcccaaagtgctgggattacaggcatgagccaccgtgcccggccaagagccctctttttagagcctttaagaaaggtcatgctagcctctcgacccctgagtagct

SEQ ID NO: 143 - DNA, 1061 bp, Homo sapiens
ggggcgtggtggtgcatgcctgtggtctcatgtactcaggaggctgaggtgggaggattgcttggacccaagaggttgaggctgcagtgagctgtgattgcgccactgcactccagcccaggtaacagcgagatcttgtctcaaaataaaaaataaataagtaaataaaatgttaacattgcttatcacaaaatgatggggttatgggtttttttccccttcagtttccaaattttctgtagcacacctgtgctatactaaaatagaccaatagtttttgtgtgtgtgtgtgtgtgtgtgtgtttttctttgttgagacttggtctggctctgtcacccaggctggagtacagtggtgcgatctcggctcactgcaacctccgcctcccaggttcaagcaattctctgcctcagcctcccaagtagctgggattataggcggccaccaccacacccggctatatttttttgtatttttagtagagacggggtttcatcatgttggccaggctggtcttgaactcctgaccttgtgatccacttgcctcagcctcccagagtgctgggattacaggcataacccaccatgcctggctgtttttttttttttttttaaatagagacggggtcctacattgcctaggcttgtctcgaactccaaagttcaagtgatctgcctgccttggcctctcaaagtgctgggattataggtatgagccactgaacctggcccctaaccaatagtgtttttatgtggtcttgctctgtctcccaggctagagtgcagtggactgatcataggtcactgcagccgaaactcctgggctcaagtgaccctcccacctcagactcccaagtagctaggactgcagatgcatgccactgtgtcatgctaattttgttttattttttgagacaaaatctcgccctgtcacccaggctggagtacaatggcatgatcttggttcattgcagcctccatctcccaggttcaagtgattctcctgtctcagcctcccaagtagctgggattacaggtgtgtgccattgggtctggctaa

SEQ ID NO: 144 - DNA, 1059 bp, Homo sapiens
tgaatacaagtaaaaatttagtttcttaattgcactagcacattagccacgtgtgctcccagtgctcagtagccacatgtggttagtggccactgtactggatatcgcagatgcggaccatttcaccatgctgggcagcactgctttataccatcccttatcatgaatcttatcctccctggtttgataataagttgataagatcccttaaaaaacaattagggttgttttacattaggaaatattataaaatagtcacccatgactttggagttctttcttaacaaagggaaaaatagttaaataacatcatcataactgtgatcagtctgcttgctggtgcttttttattcttccacgttttttcttacagtcttttctcccttaccatttaggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcaggtacactgcccccaagaaactacctgccactgttgtctctctgtgggccaatgtccaggcgattctcattatttgctgtggggatagtctagaaagtcagtgcgaaaactgtattagctaatgtggaaccattgctcttaggggaaatactgggttaggttcatgtgaacctctggtcataacattcatcaactgatcagtacctaaccttaatttttaaaatgcgtgtctgtatttaaagacatttaatatagatatacagacagtccttgacttaggatagtttgactttggatttttcaactttacaagtggcacaagagttatacacattcagtagaagtcatacttcggattttgaattttgatcttttcctgggctagagataggtagtatgatattctctgaagatgctgggcagcaacagtgagccacagctcccagtcagccatgcggtcatgaggtaagcagctaatagtctac

SEQ ID NO: 145 - DNA, 1068 bp, Homo sapiens
atattattatactgttagtaacagtatccaaataatacacatgttttgcattgacacagagcagaggttgcagagtggtggcccacagatggaatgttgtctgcagagtgtcttttggttgatctacacagtgcttttgaaaagtttagattcatgctctatcagtcaacataggttaggttatgctgtagtaacagacaaccccaaagtatcagtgacttaaaacagtgaagatctttttctccctcatactctgtgaccattgtgggtctgggctgctctgcttgttgtagtcgcttagggtgacagagcagctagtgttttgatgtgccagcgggaaaaatgagctctgaatggtgttgaatggcaactaaatgctctggcagactttgtggaactaaaatatggtcccacacagggtgatggagtcagaaagtcctgtcttgctgtgtgtctgagtagttacggggtgggagatgcagaaccacttgatgtgcagcattgatgccttgctggccaacattttcaaagttaggggctaggcgcagtggctcaggcctgtagtcccagcactttaggaagccaaggaaggaggattgcttgaggccaggaattccagactggcctgggcaacatagtgagagaccctgtctctacaaaaaattaaaaaactagctgcgcatggtggtgcatgcctgtagtcccagctactcaaggcgttaaggtgagagaatcacttgaaccaggagattgaggctgcagtgagccatgatcacaccactgcactccagcctaggtgacagctgaaacctggtccctcccgccccaaaaagttgcaggattttatataaaaggtttgtatttagcttcttttgaaaaactggaagctttggcaatactaggtccatgttctcacttggaagcatctggaagcggagtagcaattgctcccttgaaatggggcatatgcttacctagtccttcgcttatttctgtcacttccttagtcagtgtaaatgtatgaattcgtgattactggtgtggaactttaaaaagtgcatttcacac

SEQ ID NO: 146 - DNA, 1045 bp, Homo sapiens
tcttttacactttctggattttacaaagacaaatgttaatctcagaagacttccttctgtttttctgtatttgggcagtacccaagccattgtttggatattaatctaggaggaaaataacacagaaggtaaatcatttaatgttttgcaaagtcctacctcattatttctaattttaattgtgttggatgttctttatttaattccctgccagtagagtagaagacaagcctttttcagtttcgttgtaaggaactcaggggctttatgaatcaaggataatttccagcagatactttcttaccaaattacaggaagtttggaaaattggataggttattatcacagtctcaggtgaatgtttttaataatgtttctagaggcttaggactgatttttcttagtgacacactttgtgatatcacatctgagtggattatctgtttttgtagaactttttagaatttttttttttaacagtgtataggatgtttactccctttaaagttgaatggctttagggttttatgactgatttcactgaagaactatagtagtaataagacacttttaaggtagacattctgatcgatattattgtattttatatgttttttcagaaacataactattttgtctttatcgctctttcacagttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacagtatgttttgattgtctagcatatagtaaatgctgataaatacttcttgactgttgtcaagtctctttttccccagtggtatcttccccagcagtcagtatatatggtctgtcttcttttgtcctgagatggtcaatctttggggtggaggaccattgcctgaaagtgttaacccttatttctgtggcagagccagtggtgcttcctgctatcatgccaggggattcgtttgctgtgc

SEQ ID NO: 147 - DNA, 1029 bp, Homo sapiens
ctattttgacaaatagtgagaactctgaaagttaatagtttgtatcttctttaggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacaggtacatacaggggctgctcaagtaggtctttggcgttagtcatgggaattcagatttatttgcttagctaactaaatggagccaatgcaaatagattacttcaacagtctgagctgctgaaacattcctgcttccatcataaatgcttaatcatgctcaaaactgtctttttaggcaagaaactgagcccactaaatagattcagttttcactcttttcccgcttgatggttttattcattcaccatttgcatctctttcagatagactgggtggtattgatgtaaacttttctctccttcctaaagggttgccactgatcttcagacaggacaatgccaagacagatgctgcaggccagtttgaggagcatgagctggcccgtagcctgagtcctctcttattctgctatgctgacaaagagcagccaaacctgtgagtacagttatttatgggaaggggaaataagctcccagggaagggaagaaattagtaaaggctataatatatccgtgtaagtagaaatatactgtagataacaatcctgacttggcaggggaatagaaccatgacctaatgggatttttggggatctaatttctatgttatttgatactgaaaataaaccatttggttggtttataatgaaagctagttttattttacatgcattgaagtagttttcctattcataactctgccaacgaagagaaagccacgagttctccttctctgctctgcagtttttcttcccctgtaaacttggagcacaggcacaggagct

SEQ ID NO: 148 - DNA, 1042 bp, Homo sapiens
cctcaccttttcatttggaaacaatttaaactataggaaagttacaaaagtagtaaatgaatatccctatatcttgtacctagatttaaccagttttcagcatcttgctacatgttgcttctctcttcacatacatgaacacacattttcctttctgaactatttgaaagtaaattaaagtcatcatgatacttaagccataaaaacctcacttatcacccaaaaatagggacatttttctaattaaatataatactattgtcacatactgatgaaatttaaccttgatatgttttctaataaatagttttcatagactgaatgaatgactagaatgtccttcatagcaactcccttcccattgatctaggatccagtcaaggatcatttattttagttgccacgtgtattctcttgtcttctttaatctagagtagtcccgctttgcccattttgtctttagtgacattgacatttttgaagactccaagcaagtttcttgtagaatgtcctattttctgcatttgggcagtgatttcctgtctgtagatttgggtcaaatattttcgatagctatactttctatgtgatgctgtgtgtttcccaccatgtcacatcaggatgcctgtgatgtctgttggtctcattattgttggtgataagttgttcttcacctggttaaggtggtatccagcaggcctcttttttgtgaagtttcctttgttctttgtaaataagaataatcccattgagggaataatttaagacaaagtgaatattctgtttcccaaaaacctttcattcaatggtttaatggttcttgaatcacttattacattggtggttgcgatgaaatttatttatttatttatttatttatttatttatttttggaaacagagtctcgctcagtcgcccaggctggagtgcagtggcacaatctcggctccctggagtgcagtggcgcgatctcggagcttctcgggaagctccgcctcccaggttcacaccattctcctgcttcagcctcctgagtagctgg

SEQ ID NO: 149 - DNA, 1079 bp, Homo sapiens
ggatggtctcgatctcctgaccacgtgatccacccatctcagcctcccgaagtgctgggattacaggcgtgagccaccacacccggctgcaatgcagatttttaaaaaattaattattttatttttatttttaattgagatgaggtctcaccacgttgcccaggctggtctcgaactcctgggctaaagtgatcctcccaccttggcctcccaaagtgctgggattataggtgtgagccaccatgcccagccagaaatgctgatttttaattctctaatttcctctacatttattcactgatatttttccgttaaggtaaactttccattcccttcagcgatttttctgtatatatacacacacacatacatacatacacgtacattacatccatccatcctcttctttacagcagaatatcagcgtataaatgttgaggaaatgggagaattagaaaatcaccattttgtaatcatattaccaatttctacttttttcagatgatggaggaacacacagtgggctgtaagttcagtggtattgactgaggcccaaacagtgttgtgattgtcagaaatatgagaagtaagtggatggcatcttgtctcctacattttatgtagcctcttttgtttccttgtcctgcagggataccttgggaaaatgcttcttcctacgagtggaaattactctccgaggagctacgtataggatctcatttagtgacacagatcagttacctcctcctttccgaattgacaacttttctaaggtatcaagtggagctgagagccagtttgactgtttcatgtgtgggagggtggagtgtgtactgcccttgacacaatggtacaatacattttcaacttgggtttaaaggaaactatatggataggttctttatatctggacaagcctagaaatccttaccattaagaggtgttttctgctggttattttgattgctaggcagccttgtccaggcagaagtaatcttttagctcccagatttatttattttggctagagtggttggttgacactgtgccttctgtagacatcccgttcaaacagagga

SEQ ID NO: 150 - DNA, 1050 bp, Homo sapiens
catggtgaaacctcatttctataaaaaatacaaaaattagctggacctggtggcaagcacctgtggtcccaactacttacttagcaggctgaggtgggaggtcctgagcctgggagtttgaggctacagcgagtcacgatcacaccactgcactccagcctgggtgatagagtgagatgtgcacctgcgcgcgcacacacacacacacacacacacacacacacacacacacaataaccctgaaatattgggaaagggctatgatgggtctgaccttgagacagacgtgctgctacctaagttaccacactgtttaccaaaagcagatagttacaaatgataaactttctttcttggaggagtctccacgcacaagctagctgttccagcagcaaactctggaaaagtgggagccaaccaggggttgcttcccatatttctggtcctttatcaccagtgctgatgggaccaagcctgcctgtagccctcggatccacaagcccagccatgctgctccttaaattagctgccatccatctgagcacacaccataaagttcatccaccacagtgcatctgaggctggaatcctgactaatgaggcccagattgcctgggaaccaaacaatagaatggcaaaccatctattaaacatcttttggagtttttagttaatcataacaatatagagagagataacccagaaataatttggcattatagttataaagccacatgattaatgaaagcataccatgtcattgaggccttcttaatagcacagatgaatgttccttctggtgttcacactttaaatcagaatttctttatctctagcatctgatgatcacagctcagagattcacagtgcaaattgaggagaaactgctcctcaagctgctaagtttctttggctacgatcaagcagaatcaggtaatgttgaatgttctatgtctgtgtttgggaattggtccaaagatggtatttttgagtctgtttgtaaaaataggtagccccttggtgtctgataggctccctttccacatctca

SEQ ID NO: 151 - DNA, 1050 bp, Homo sapiens
ctttattttttatccatttgtgtgtctgtctcccatactatactgagttccatgagtacaagggactaagtcatactcgtcttggtatctttaaccctaagcacttagcctgtgatctaggaagccctcaagggtttgttgcactgaaccagtctgttctgtgtcaaggtcaacttaccggaaggggctgcaggtagtacagctccttaaagcaccttctattactagtccttcagcagaatcttacccagtgagtaaacccatgcaaaacttttgcatctctcctgaaagcagaacaagacctgcccccatgaaaagaaagaaatagggaatccctttataattagatttagtgggcagtggtgagatgtagtagagatgaaactttaatagacacatagtctttgggtgatgccaaaattaatctaactttgtgggttaaaatgaattttaaaatttttctaaatgttcatatgtttttctctgtatgttgttagaattgtcatcgggttctttctaaaggctgtgtgaaagaaaagagcaagccaggtgcggtggcttacacctgtaatcccagcactttgggaggctgaggcgggcggataacctgaggtcgggagttcgagattagcctgactaacttggagaaaccccatctctactaaaaatacaaaattagatgggcatggtggtgcatgcctgtaattccagctacttggaaggctgaggcaggagagtcgcttgaacctggggaggcggaggttgctgtgagcctagattgtgccattgcactccggcctgggcaacaagagcaaaactccgtctcaaaaaaaaaaaaaaagaaaagagcgaaaacatctttagtactggttcttgccctaggacagaagtggctgtttgctgtacctctcagtggacactgaaaatgtggatgtgtccagttgcctgctgtccagcaaccctggaagaacttgtgatggctttgtcttcgttatgagaacactttgatctgaacccctttccttttctgaatcctttcccttttttttt

SEQ ID NO: 152 - DNA, 1043 bp, Homo sapiens
ctaaaaagccaattgggagctcttggtttgaggctgagggggccttactgtggaatgatcaagtggggacctgctgactctgggctcctgttgagaggagcaaaactgaatggggatgagagaggggacctgaagctctaactgcttcccatgcagccttttaaccaatcttcctgttttcacctcactccaggcctatctgtttctcctttatgctccaggccttcagagctacttgctgcctccatctttctgaaatgcagtggaggccaccatcctaattagctttctgctttgtggcttccactccctcaaggcttacatttcagcgccacgtgtccatctgcttttcagcttctaaaatattgttgacaccttctctttatccttttggatttgtgccatttgtatccctttgctttccctttagaggggtctctggactagatctgtcatgtttaatcagaagtcctataatttagacttttcactaatttgtgtttcctttcttggtgttctttcccctttacccccaactagtggctctgaattagtgtggttttatgaaacccatatccattcagccatggttctatgtattatctcatttaggcatcacagcagcttttgcacagcatctgctcaggcagtctgtggctcttctttccccgaaagattgagaatacatctggtgagaagccgttgccagtcccagcccctgctttgagtctggtattggtctttaatctctcattctgtgtgttgtaaagaaacaggttgtggaaggctcttgtcagatcccaggaacatgaaagaaatagcacaccctacggtagtgacatggccctgtcaccacccctcattgaaccataaaagctattcagaggggccagcagctggggagcgactgtacttagatcctgggtgctgatgggtgttttgtagtttccaagggaagttgctgaaagttttcttatcttgacactccaagggcaagaggtctttcttcaaagagaagcgcttgtttcagaaaaagatgtgga

SEQ ID NO: 153 - DNA, 1107 bp, Homo sapiens
acaaaatgaacagttgaactcaggccaccaaacctggttgagttgctgggtggagggactctcctgggctctgagcctttgtgtgtgggaaccgcactggaaaaggtgtgcagaggccacgaacttgctctgaacccacttgtgaagagcaggtgaccccaaactattgttagtgtctgctgtaaatgatatgcctctgggttcgagcagagttcagccaaaagccccacatgacatggaaatctgtcctggagccaggtttgtcgggtaaaagttatgtagcaaatgtctccaaacattggcatctgttgtctgccgagactaggacaaccgagaatgatggagtgcttaaggaaattaggatggggcatgcgaccctgtaacagctgataaactgtttcaggccaccgtggctcatccagctcttttgataaacagctttaaaagcattacgtggtttggaaagcattcttcaaaaatggttatattttccagacgcatgacagtccactgttcagtattatttaagggttttaaattgtagaatcagattccttttcagtggggctcttggaactgtcgagggctgatctgtctgactcccaccaggacaatctcacaacaatattattatgtaggtcggggtcccctaggtctgttaaaaaaaaaaaagttcagggctaagcgtttaagaggaaaaactatttctttcatttctagctaagtctgatgggccctttcaaacactgctttcatcatgcaccttttatttcacgatttctgcataatgaaaatacaagatcgataactgtggattatcgtaatgccttgagcctttgaaaatgaacattttctagattataaatgttccctttgtaattcatttcaaacttcatcctcccatttgtcctaattcccgaaatttaactgttgccttttgagcctcctaggaaattctgggtatcctttaggcaagggaggtagctcttgggggaatagcattcaggccacaggcaattcatttgcgacttgggctcttcttagaacatatgataagtacaacgcactgtagtgacagattttttaaaaaccctattaaagcccaat

SEQ ID NO: 154 - DNA, 1029 bp, Homo sapiens
agtggcttcgggctccttgcctgtctggttgatgaggctgggggtgctgaagagcaagggttggagaaggagcatctccccagtggacgagctgaggtcccctgaagagggcctggcactcagagcgacactgggcccagacatggagtcagggccataggtggacctggggtgggtaacgcctaggggtagaggagcctgttccaggagctctgagtcaggcttctgattttgaaatgactccagagggagtagaatcaggtatataaatgagttaatatcgaaaaaaaaaaaaaagagcaggaggaaaattaagtagagtggctgaaacagttacttggcagatttctccctgagagaagctggtcatgagtctgttttccatgtggccttctagagagacatctctctccaatctgctgatgagaggatgtgtggggaaaggaggggtcatcccccacaggtttggggtaactgggcacctgttctcaacagaagagctaccattaactgcggatctcttctgtgtggggcacgtagattagctcacaccatcacagtggccctgcagagtagacccatggggttctacacatcaggatggggaagctctgggcaaagtgagaggcggagacgactggcatcagggtggctggctcccctggcgaggctgcagtgtggcttgggaggacgttgtgacctgccccagaggaggcctgaggctgctgttgatgctaccatggctgctgttgttgagaatgccccgtggttcatggtttatggatgacattagtgatggtgcattctactaaggcggcactggctcctggcagattcacccactcttagcacctgtcatcttggaaaagggtgtaagctggtgctgcagccttcccttctctcagaagaaactttctgacactgagccccaagcccagagtatcctctttctctccttaaaggggagttaaaacttttttctttcttcttcttctttttttttttaatagagatggggtctcactatgt

SEQ ID NO: 155 - DNA, 1032 bp, Homo sapiens
tctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggatttttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccattttttgcaatgatgtctggatgttattttaaacagtgtgtctgtgtgttcccaaatccagctggccccaccagctcagattccattttttttgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaat

SEQ ID NO: 156 - DNA, 1040 bp, Homo sapiens
ctgtgttttaatatatggttacctgtgtgtgtcatggagctaaagcatgaagatcgtgttaagtaattacacactgcatcttgaaagatactgatgagttaagcatgtggcagctgcttcccttctcctatgacacagaggcattaggaactgtctggcagatttatcctactgtaagaaactatcagtaggtatggtgggtctgtgttaactgaatacacactgttagtctctgatattaatgcagccttggattagcttttcttttccctaaattttactcagaatacaaattgaacagaacatgtttcttcctttctgccaaatttttctttggagatattaattgttgaaaagaagaagaaagtcatgttttaggattggtaatgaggttatggagcacattcagggacatgagtgtgaggaagcgtggagtgttgctgcatttctttgttgagcaaaggccatatctccctcattttcatgggtcacattctttaagaagacagatccggacgggcgcagtggctcacgcctgtaatcccagcgctttgggaggccaaggcgggcggatcatgaggtcaggagattgagaccatcctggctaacatggtgaaaccccgtctctactaaaaaatacaaaaaataagccaggcatggtggcgggcacctgtagtcccagctactcgggaggctgaggcaggagaagggcgtgaacctgggagggagggtttgcagtgagccaagatcacaccactgcactccagcctgggtaacagagcaagactctgtctcaaaaaaaaaaaaaaaaaaaaaaaaaaagacagatcctcacattatacatggagatattctaaggcagaatttccagcctgttaagatggatggttgttgctttttgcaatagatagcaaaattgctataaggcaagtttctctttattcacttacttccattaaaaatgtcataggttggagaatagtctatggaaaaaatgatctccatggagttgaacacttttgatgagcacacatttcaaa

SEQ ID NO: 157 - DNA, 1051 bp, Homo sapiens
cgacccggccccgctgctgaatcacggccgccgcgcgctcgggctgtttcttaacttgtgacttagctcctgggcggcagaaagtgcgcggacggcgttccggggccggacgttcccccgctggcaccccaagccgcgctccgcagccgcgcgcacggcgggcgcccgagctttctcgcggctagcttgacagccccggctccgcagactcgggcccgccgcgcaggacgcgggccgcgtcggtcgcggagtcggggtgtgggagtgggggaggcagagacagtgagagacagagacaggaggcggcggggagggcagggagactgcgggtgcggtgggcttccgaaaggatgcccagggggatgtggaagttagagagcgtgttgttttgtcgttttgactcaattctcatagttttacgacttctgatgatttcgaacaaaaggtaaagtgtagtcacacttaaaaagggaggggataatttctgggtaggaaaatagtttggttggctgtatcatatttccagtgggcatactgacacgttggggcttttttttttaatgaagaattttaatgtgaattggggaatagttcatagatcccagtttgaaaatatgccaaggcacagtatggttagtttcttattgatacaaatacaggtttgtgttttttgtttttttgtttttttgttttttttttgctctccttaggtcttaagtagatttctttttagtcatctgaacgaacgagtccatcctttatccagaacattgcaaagtgagttgtggaagtcatactgtaaataaaatcatatcgtaaactcgatttgggaaaatgttaaaatcggcattaaggaatgtaggcaagaagtctgttctgatttttcaagtatgtattctttgtatgtcaccacaaaatggaaatagaattaattcccccgtgaaacagttagtaggcctattactgaatatgcattgtctatttattgaatgtgatgtagtcactgcttcagagcattaaatgcttttgatcctgaatcagacgatcagag

SEQ ID NO: 158 - DNA, 1050 bp, Homo sapiens
ccaaaatgtttatttgcagaggtggatagcttttttttttttttttttttttaactttcatttaagaggaatgcacatgaactatttgaagcagtaccttcctaagaggttttgtttgctgataaagctttcctattctagctgcttgactcataccagaggagaagcattaaagaagaccagaaggtgaaaagagtcaccctaacctatccatgtgtgctcttgaattttcctaaggaggggcacgcgttgatttcctcattgtctttatcccacaatagattcttagaatatgtatgtctatataaaatttttaaaactgcttgagtttgtagccaaatgtaatgtggctttttctacttggaacttttactgagagtactttatttgattgttaagacttagtaagtcgtagccaggcgcggtggctcacacctgtaatcccagcactttgagaggcagaggtgggtggatcgcctgaggtcaggagtttgagaacagcctggacaacatggtaaaaccccgtctctactaaaaatacaaaaattagctgggcgtggtggtggctggagcctgtaatactagctactcgggaggctgaggcacaagaatcgcttgaacttgggaggcggaggttgcagtgagccgagatcgcaccactgcactccagcctgggcagcagagtgagactttgtctcaaaaaaaaaaaaaaaaaaagtaagtagttaacacccgccccaaccacccaaacatactgtaggcaaggcagaactacagtttgtaatctatgctttcaattttcaaaggtctttagcatttttctttctgttctaacctgttctctgaaaaataggagaaggtaactttgtttaaaaggttaaaacttggtgcgtatattaagaaaatatcctaagggattctgggtaagagactagaaaattctcagtgttctggagcatttattgtagctgcttgctattcctgcttctgtggccatgatcctgaaatttaaaaatattttgatgaaagttttaataatctagtcaacgt

SEQ ID NO: 159 - DNA, 1060 bp, Homo sapiens
cgcgcgctcctcaggcttcccggctttacctggctcccttggtggatggaactttacatcctcccctgcgattatgtggatgatgtgtcggtccgtgagtgctcatagaggcacagctgcaggcaggaggtggctggggcacagttgagatcctccacagcagtgggatctgtttgatcagcagcagtggagctgagtctgaaaacctgtgctggaataaaagtgcctcatttcatggtgggccgagtgattaggtagcttagtatctctgtaaatgctcttgtttttataaacctctgctaaaatgtggcatattcaaatgccgttgcttagtctttgcatttttaagagaagcaaaataaaggctgaggtaaagaatgatgatcacagccaactgccaagacatcgacccttaggttaatactggcaggcattcaacatgattgtttaaattagatatttgatttaaataatgatgggtataagaaccaagtgcggtgaacaggaaaaagaatatggggtatgtggctgtttggaaagaggaaacagatgatttttttgtttgaagtgatgatgtgtagcatggaattgaaagatgtctaccaaaaggttaacagggtaatttgaatgctaagcatttttggctatttaatggtatctcttgtatttttaatccctttaaagtctttataactgtgtgtccattgtgggtttgatgttactggggattgtggtttttttcctgaacggttttcctgagttttatgggtaggcagtagacaagagagaaacacttgagcagtactttttgccatctaggccaagtacaaagtagaggctttttccaaatagcacttgtaaaactgcgtattttacaaaattttaaagtgttatattttgtctcaaccaataaaaacattttcaattatctcattgtttttacttttgttggcgtcttctttatgaaaaatcatgtattcatttttttgtgtgtaatgtaaccaagtgctcatctgagaaaatacaatcagatagaaatatcatacccttatcaatactc

SEQ ID NO: 160 - DNA, 1299 bp, Homo sapiens
ataagaaaattcactaagatgatggcatgtgcctgtagttctagctacttgacaggctgaggtgggaggatcactggtgcccaggagttagaggctacattgagctgtgatccccccactgtactccagcctgggtgacagggcgagactgtctctaaaaaaataaaaataatgataataaaatgaaacatatgattgcatttaaaaatagcatgaagttcaaaaccatcaaaaaatagtgatagcaaggacatgaggaggcacctggggtgctcgctgttttctattattcatctgtggaatggtcacatgggtatatatatttagtgaaaattttatcttgctatatactcaactatttgtacactttaatacatgtacgttttatacttcaaattaagcatttacttacaatgtcagagactttgatttttgtataacagaacaaaaagtatacagaatgaagtgtgtttctgttttttgttggaatttaaattcttattttgtctcttcgtgtttgtccccttaaaattttctcctttatagtccctctggtgataatattctaggcctgccacgacgtaagaatccaaccaagaggcatggattgaaagttaatcagaaagacagcttgccctctgctcattgcagttgggccaccatattgagactattgatacagaagggaaggaggtgtgtcttaatttgccatgggcaaatttttgcagattgcagcttacttgagttgtttatagtgagccaagtaggcaaatttcagaagacaggtttgtgactcttttaagaaatatttgtagaggaaaataaccagaatattttggatgcctttcataaccatttttaagcactgtttgtgatgataacattcataaaagatataattttctgtgaaacaagaatagtcaagttcatttcccagagtcttaagactaagttctgcctcctcattgcaggtgtgccgagagttttttttgaacaacaaaaattactaaggaacctcactacctttggcggtagaattagaaaacagattcagcagtcacctactccccttcagtaattcgagacaattatttttctcctgacacaacatcaggtcccatgaaaaatgacacttgctggcctggcgcggtggctcacgcctgtaatcccagcactttgggaggccgaggcgggtggatcacaaggtcaggagatcgagactatcctggctaacatggtgaaaccccgtctctactaaaaatacaaaaaaattagccaggcgtggtggtgggcgcctgt

SEQ ID NO: 161 - DNA, 1046 bp, Homo sapiens
ccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcaggtaagctcaggagctggtgggagggaaagaccgggaaggcgacagtatccttgcctacgggtgttttttggtttcttgttgcttttttttttttttttccccacttaaaggaaatagctgttgtataagttaaaggcatgaagggtcattgctttggctgcttttagagatgaataaatagttctaatttcagacttaggactcacaaagcagtgccacttctttaatgtggccagatgtaaattgaatttaaaactatagaaaagctctcaaaagtactctaagaaaagatgcaatcctctcaaacttcctttatgtcttgggtaatagctcagtgtcatgtgtcttattttccgatcatagaacatttcttaggttaagacgggtcactaagttcattagtaaaccatgttacaatcttgtttaatatttctgtgacttcagcatagatctagtacctgacactttctttcagaattgccaatgcttaaattttaataattgattgcatcggtcaaaacaaaacatagtcctttaaaaaggtcttatgcactgtcccccacctcctgaactcagccgtaggacggtaaacaagtcaggatctggatgggaagcagagcaggagagacatgcttggaactccaggcaggacccttgcagctctttcaggcctgtgtgatacccagggcatgtcagcctcatttgtcagtgcctttgtttccccagtaatgatagaaggat

SEQ ID NO: 162 - DNA, 1050 bp, Homo sapiens
agccaatcctgagccgtgtccacttggtggaaagaggaggtggtgggccttgagggtgaaggaaccacgggcctaatgtgtagtttctctctggcttatgttgattccaaggcccaagcccccttgggccttgcccttctggtggcttgacctttcctgaagggtttgcctcacaagcagaaccttgaatacacagtattatgggataagaaaaataaaggtccagattggtgggaatgatgacgtgaccgttaagattttagacagaacatctaatgtcaaaatagaagttgaatacggtttgaggtttgagtgggtggcatgtagggaaaaaagtgcgaaactgctccttggtgccatggatctctgtgctgcagtcccaggcccctaggcccgatccttgctgccacctacacagggtcatgtcacttcctccctcccccccttctgcccttgtgccgcttcctctgagtggtggtggaaatgatctgagaagctttagggtggattcagtctggctttccaatgcctgctgtttgctgggtactctgctgagcatctacaagtcttggcaatgacagcctgaggttggtgtcatttaccgatggagaaacagatttggggaaagtgattttgttccaagggcacacaactctaaggtggcaagttgggatttgaactccaagctacactgtgcagtccatcgtttttataggtagggttttttttttttaagggattttatttcttctaaatatagaaaacaggacgcagtaccttctccataaaagcttttccaagcattagtgaacaagtggaacagtcatttgtgggtaaggaaatcttcctggtgcagcgagcctttattagtcaggagttgctcctggacccatttgcttttagtttccctctcactgtggaataaacttctacccccatcacagaccaattagttcaggtcaatcaagctggcttttatagagccatgtggttcatcaacggcaacgtgactgtttaacagaagccaagctcattatagtaatacccttt

SEQ ID NO: 163 - DNA, 1107 bp, Homo sapiens
ggagatgtggaggaagaggggagacggtgagcagcagccatgtgggtaatcaagggaacggcaccagggaacagagaagggctgccaggaggcatatgcgctgggagcccaccggagttttggggtcatgaatttaaaatgcggtcaggcagcatgtttgtgtgtttttctccatcaaaaaggttgatgaacacacacacatccctctatttctaattaagaaatgcttaaatgtacccatactgactccctgctttgagtgaccagctgctgggccggctctcactgaaggagggttggggggggtctcctctcataagagcctctctggattgaactccattgagctcctgctctgttccaggcaccatgcaggcagagttgggaatgcttccccagctatacgaagttggcgttaggcccgtttcataaaggaaactgtactgagggggcaggtgacccgctcaggctgctggtggtggagttaggactgtcagactctaaacctcatgctctctgcctctccaggagcaccaggtcaaaccagatgggtcaaaagcctccacgtacctagtgttccagtagtgccccctggggctggagaggaggccgtggtggggagggcactgcaggcaggggcatcgacgtgagcgaggactgaagtgacatcctatggagggggcaaggggagggttcaggccagggcccttctgtgcaggaggccactctcctggaactaagtagggataggctttgacaaagccatcccttgcagaattccccttgtgcgttcacagcgtatgtttgcttggctcagcactgtaacccacagtaactggcagagtgagcggtcagtggctatcagataactaagggaaatatgtttggggtagatgacaacctgtctcctcttcttaggaatttacactgcctgtcagcacatgaaaggctcagaaattgtgcagagacacgcccgtttggtttcacaagcctgtgcactggaggtaaatggctcgggcttccatcccagttctgccgcctgccagctgtgtgttcttgggcaagttgcctaacttctctgtgccttagttcctcatctgtaaaatg

SEQ ID NO: 164 - DNA, 1049 bp, Homo sapiens
attacaatagcaaattcgtggaaccaacccatgtgcccatcaatgatagactgaataaagaaaatgtggtacatatatgccatggaatactatgcagccataaaaaggaatgagattatgtcctttgcagggacatggatgaagctggaagccatcatccttgcaaactaacacaggaacagaaaaccaaacaccgcatgttcttactcataagtgggagttgaacaatgagaacacatggacacagggtggggaacatcacacaccagggcctgttagggggtcgggggcaagaggagggaacttagagggtgggtcaataggtgcagcaaaccaccatggcacatgtatacctatgtaacaaacctacacgttctgcatatgtatcctggaacttaaagtaaaattaaaaaaaaaaaaaaagaaaattacaagttgaacctaaaatgtatgtggaaatgcaagatgctaggacttgtcaaggcaatctagccagcacttacacttttatatagaaagaagtgaaaatagatgaaggacttagactactagataccaattcctatttaaaaacatagtaataagagtataatactgacacacggatggacaaagacagaccataaaaagagaaagtccagaaatatacccacaaatatacagtcatttgatttgtaagaccacacactgcagtgtggtggtgaaattatttttatttcaataaatgctgccaagttaactggctatttatatgaaaaaagatgacaggtgcatggtagacctaattgtgaaagcaaaagcaagcaaaaacaaaacagaaacaaaaccagaaaccaaaaaccctcctagaagaaaatgtaggagagcagatttatgattttgaggcagtcaacattgttttaaatgagatccagaaagctctaaccataacgaaaaaaggaactggtaaataggactacattaaaattgagagcttctgttcttcaacagatactattaagggagttaaaaggcagttcatggaatggaaaaagacatttgcaatatat

SEQ ID NO: 165 - DNA, 1025 bp, Homo sapiens
gcttggggaagttgttgctttggccttgttgaattttcaaggaaaatgaaaagatatgttttaggacattcaccatttcctcctatgaatgagaggcagaagcttcctgcttttattcagttctgttgctggctagattcttgccacaggatttgaaaataatggagttgggttgtcatggcaacacatcccacgttgtaattttgatattttgaccaattctttgacgctacttttatctcatgaattgcttaaagtttcttgagactctgcttcaagggcaggaggattgacagcattcgattcagatgaagaaacaggtattcagtttgctttccttcctggacattgtatgaagtggaattctggagtttgtgtgcttgagagaaaaacccaaagaaacttgcttttcttgttaacaaaaccatcttcatacccttaacagctgcctgaattgctgggacaaactgttttttgcccaaacaaaataattccccaaattggtaacttgaatgttacgtctggatggctggctggctgttaaaagatcatccataccctctcttctcttccttccccaaacttggtacttctgctggggtctccccaccaacctcagaaaacaacttcccatcccctggctacccaattcttcttggactcctcccttctgatctgtttaatgggtcagggaacccaattatttctcataacaataagcaacacttgctgtttgctttgtgttagacactgttctaagtgcattacatgcattaacaaacttaactttgacatcaaccaacactgtgaggtcggtagcattccttgttatcttcaagatacagacaggaaaactgaggcatcagaaggtagaattacttgctccaggtcacatgaacagggatggcagagttagagttccaatccagattggctggccccagagcctgtgcccttaaccactgtaccctgcagcctatctcagagccttctccttacctgtagaatccaccaacctctgtctg

SEQ ID NO: 166 - DNA, 1962 bp, Homo sapiens
gggatgatatgtgattttgagttttgaagtagacacgtaaaaatatgtcatttttaaaaaaagactctttattgggcatttcgggggctaattcacttattttccatctgtgctttaacactgcttcttctctcaattccaaagacaaatgattgtactcattttcatacactaagttcatcaagagtgggaggccgatagaatgtagatataacttatctgaacatcctttcgttcagtctgcattttgtgatattaataggcatctcttaggtttttgtgttgcaggatgtaagcctttcaagggtagtaaccacatccttgaacttggttggtataatagccctctcagttccatacccacagggcccttaatagtattagatgatgatgaaacactctgacatcagcttgcaagtcgaatgaagtcaggcaaaaagtgttccacagaacctggaggctgcttgagagtgactgcttaaaatgcataatcgattcaagtcacatctgtttggaagcaataaatcctgcttaggagaacgtcaaaggcaaaagcattgccggactatgaaattccacctctgaggattataaaacaatgtgcacagagcaaacacatctcccaagtataatggggaagccagagatgattggcaggcctgacaatccatcctggaaaatggaatcgcgaagggagcacctcacatgggtagcccagaaagcccgcaattaggtgttcgtcccctaaacgttttgagcatggaggtgtctgaagaggcctagcacctctatttgcattccatttcctttttagtttgcaggcccccaaattcaatggagtctgccattcagatcgcatttgaaacccgatcttgtggctttgattcctgagagccctgtctaaacccaaaatgccgactcagcctcctaagtgattagattcgtaacaccgaagaagcgattctttctggtagagattaattcttttactcatactgtgtgactccgcatgctaagaggggttgattacagcaaattaaatctctccttggcagttctctccctttaccccccaaagacctaatatcattatttattaaggggagaaaaatgcttggaaaaataataagattgctttgttggcaggaaggtccccctcttgaaggccgagtgctaaagggtagagaactttctgtgcacctaggggcttccttctgcaggccatggaacaaagggtggctgagggagagtctgtgctctgctgacctaaggaggctgccctgggtctggacaggaagtgggtagcctctttgcctaaaacttggcctgtactgggactaaaaggaagagcttgctttaagggaggctgaatcgttggtatacccttcccagaggtccatctctagggatgaaagtaaacccttcaaaataaaaataaaccacacaactgtcatctctaaacaaatctcgaacaaagtccatcgttaggcggaaaagacctgaaatttgctttactcttcaaactctccgtttttccttctgcccttgtctcctcttcccttttctttttgcttttctttgtcttctccctctgccctttttctccccacccgacccagcatctctcctcctcccctcctattttctccttctctcaaatctattcccctcctccctccctcgccttctcttcttttggttggcaaaataaatgttagctgagatgtggaattacattctgcatttttcacttccttctcttccttccctttcctgttctttccttgtctgtctttctttctgttatttgtgttcggggaactggaaagcacatttgccaaaagcctatattcccccttgccaagcaagagcggaagcagcagcaggagggaaacctggcatttaggaggcagatcgggagccctgccaggatcagacactgcataggatttgggtggcttc

SEQ ID NO: 167 - DNA, 1048 bp, Homo sapiens
ggtgcaagcctagctttggggccattagatctgaatttatgcctaaacatttttagaaacttccagaagtcactatgagaccccattgggctgtagaatattatcagtgggctgttatagtctccataccaaaaattaaaatataatttgtgaaatacagaggaaattttggcatttggggattcagcacagatctcccaagagggatgaatgtaaggctatttatttcaaaatctaaggatgacgttctttcactaccagagttggtctttgaatctacaaaggtcatgatgtcccagtattttgaatctgcaaatattatgatgaataggtatctcaggataattttaaaacttagtatttatcatgctcaaagccttttgtaactatcattattattatagtcatcatcatcaacatcttcatcatcattattttaaatagataggtttaaataaataattattaagctatagtaggagactataaaaatataaagagaactctaaaggtactctagggctgagggagcttacccaaggagaggcagacatggaaggtgcatccctcttcaaaagttgggttcagacttttttggagccagtgtggttgcagctgttggatggtggaagagctctctggattgcccagggaagaggtggtccacagtcacaggacaaagcaagaaacaccttttggggcactgaacacctgttatcttgctgaaacaaagatggcagcctgaaatggttgttagcatcaagttcttttgaaaatgcttattttcctaaactttgcaaaaatccagctatagtaggctttttcctggcacaggctgtgatcccagtgccaatgcctaaggaacttatgtgctgtctattttgggtctgtgtaaagccaagctgtacaaaccctgtcatcagcaagccacttaagagagaccccactttgtgccattttatactggctcacccataatgtacatttcctgcccatgctccttttggtgtgacagaactccataatctatcattataattttctcttt

SEQ ID NO: 168 - DNA, 1047 bp, Homo sapiens
cacagacacaaagaaagacaaggacacacacacccaaagagactcgggacaaaaaaccacacatgcagaaagtgggagactcagagatacgcaccaaagagtcacacagaggcatatacacacacagacatgcagagagacccaggaaaagacacacacttatagacacacaaacccatgtgcaccaaagagccacacagagacataaaaacacataggcatgcagagagacctagggaaagacacacaaacccatgcacacacacacatgcgcagatacaccaatacctagttaattcccaaacatttttgagatctcagctcactttctcagggattccttcctgacatcagatttcttggctatgcaattgcagagaaccccatttctttccttcatgttgcttattttggtttgcagttatacactccttagctagatcacggggtactgtctgcctcttctggagttcaacagatactccatgcataggaactacattggcatcacccagcgcactgtggattgcccagtttggaattctgacctcactactttctgtctgtgtgacctggggcaagttcacctctctgtgcctcagttttccataaaatcatagtacctacctcatagggttgccataaggattaaatgactttgtatagggacagcactgaaagtagtgccaagcttagaggacataccatgtgagtgtaagctatcattattgaatgaatgaatgtctagcataaagaagacacaataaatggtagctgctactactgttattactaccatcactgcatgtgggtcaacttttcaggcaaatgctgcagtggtgggttagggccttttcttgctgttacagacgtgacaatgtaattatttcagctcctccgtagaaaggccccagtgggtaagagattaggcttctgcatcagcctgtctgggcctaaaccccacgtctacactttctagccttgtggcaagtgacttaatctctgccagcctcagtacatttctcatgggcctgttactgcccacac

SEQ ID NO: 169 - DNA, 1014 bp, Homo sapiens
gactagcacagggcaagatggagaagcagctgccctgtctcagtaaagtaggtgctccactgaggtcacagtcctcaccattcccaaggtctctccaaatgaggctgaaagatccattgccatttatcatcttgcactgagcccactttgtttgttaatttaccctctaggcccctatagacatttgagtttgagacccctgaatgaaagaaacagccctacagtgaaaatgagcaaggtacgttcagggttaaagaggagataggccttagattataatgtagctgatcaggggatgtgaggtagggacagcctggcctggcaggctaaagagcatggatctggtagagtaggcagagaggagccattatgctttgttaaatagtgacaagaggcccggtgcggtggctcacgcctgtaatcccagcactttgggaggcggaggagggcggatcacgagttcaggagatcgagactatcctggccaacatggcgaaaacccgtccctactgaaaatacaaaaaattagccaggtatggtggcaggcacctgtagtcccagctactcgggaggcgtgaacctgggaggcgtgaacctgggaggcggagcttgcagtgagctgagatcgcgccactgcactccagcctgggcaacagagcaagactccatctcaaaaaaaaaaaaaaaaaaagtgacaagaacaagccttggaagaacccccagtctccaggatgaggtttctgtcaccctctggatctatctgacccctgagtccactttggagtcaaacagaggtaggcatcaagctgtggccactgattacccatgaccttgggaaagctgtttaaattctctgagttttataaacaatgatgaaaagattgcctaagaatatgaccatgaggattacacagaatgagatgcagtgagtgctcggcacagagcctggttcctcattatggctgtcaccatcactaataaccttgtaaacagcctaggacagtagttaccatg

SEQ ID NO: 170 - DNA, 1065 bp, Homo sapiens
tttctactgattttaatgagaataccttctgtattcaccattaaatatgatggtagttgctggttttagctcgatattatttgtcatgctgattaagtggacttgcattcctagctttcaaagaggttttctttcctttttaataaggagtgggtgttgcatgttatctaatacattgtcagtgtgtggctatttataagttctgtgtgattataccatttatctatataaatgtcccctttgttctatttaataatgcttttcccccttctgaattccactttgaatttgaattctactttgtctgaaatagatcctgccacccctgcttttaaaaagaaaaaaatctttttgcttgtattatttaacttttttgcctatccctccctttttaatcttttcataccattgcttttcagtgtctcgagcagtaagacatttaacaattatcagccccatgcttactttgtgccagacactggattaaacaaaaatggaaaaagaggatagaatgtgctggaaggggtacattcaaacccagtctgaactggccactgctgtgagcaggtttggggacagcagtagatcctagaagggcctgaccagctggggaaactggccaggctgtccagaggtgacaagaggattgtcacccagacttgcccaagaagagtgaatctgagtcttggagagaacaggagtttgggttcttctgggcccagatggcctcagggctccctggaatttggggaccccacagttggtcgccaccatgaattgaggagccttgcttctctccacactgtcttttccctgcctcctcgtggcttctgcttcactcattcactcattctgtcagtgaatgattcttcagcacctgccctgcataggatgccattgtaggtgctgggaaatcaacgggaagaagatggaaaacgagacttcccttatgaagcttctgttctacagaggtgggcagacatggccagaaaaagcacaaggccatttccaatggtggaagggccaggactgctgccctttctgatagcttctctttacacttag

SEQ ID NO: 171 - DNA, 1044 bp, Homo sapiens
aagactccatctcaaaaaaaaaagttctggaggtgaatggtggtgatggttgctccacaatgtgaatgtacttcatgtcactaaactgtgcacttaaaaatggctaagatagcaaatcttatgtatattttacaacaacaaaaaaattacataaaaagtgacctagagggtgaggaggacaggccagaaagatgataccacttgggcagataatgatgtctttttgtgcatctgtgccacacagtgggttattctctttgcttaagaggacatgttttttcttctttacttggaaaactcttagtcttcaaggcccagctgatataacccatttctgttaaaccagacttcactctcccatggtgacttaatcacatccttcctatatttctatagcagtatatatgtcatacgatgctattactatacatcacatgccatgatcatcgtttatacctttgtctctcccactggcctgtgaattccagagcagaaccatgagaacagtatcatatggtggttcagacatcagactgcagagccccaaatcgcagttctgctgcgcactcacctgtaacctcgagcaaattgctttctgtgcctcagtcctttcaactgccaaagtggggatcatcattatatttatctgggtggctgttgtgaggattgaatgaggaagcccacataaagcatggtatggattgctgacacatcataagtgcccgataaattttagctctcattgttatcacttactgtcaaacacggtgccagggacagtgctttagaatgcatgaacaaaataagaaaagaaataaaactgtgtgtatgtatatataaattgtcagctataagaaaaacaaatggagccaagattaaataggaaaagatacggtggctaccgattggacttgacagtggtctcagctttgcaaaggaggctgtctgtattggttccaaatgccattcaggaaagattaggctgagccctagtgagaacactaggaaggttgaccagccatcccattgtggtgcatccgcata

SEQ ID NO: 172 - DNA, 1050 bp, Homo sapiens
gtgatgtaaatgggaatgatgggcagaggcacactgttgacatcatggtattcaaaggaatacaataatatttgtgttcactttactgagagccttctagatgccgggcactgagctgagttctttgcttacattaacttatttcagtgccacagcaattctgggggccgggagggggcaggtaggattatcatccccattccacagatgaggaaaactgaggctcggaaaggtcacatgacttgccaagggcacacagtggagaagggtggggacaaaggtggcttgactaaagatcctatccttttgatcaccaccctcctcagataatctcttctcaaggctggccctctgtagagtcgtctggttccagctaccaaagattctggtttaattactcctggatgaagtgggagtgtgtgtgtgggggcgggtgttatttttaaagttcctttggtgattgtatggggagtgagggttaagaaccactgtcctgcataaatatatgtgtgtgtgctcttgtggggacctaaaaaaagaaaaaaaatatgtatagatgtacatatatatgtgtgtgtgcatattttatcattttatcagtttctgagggctactgtgacaaagtgctacaaactgggaggcttcaaacaacacagatttattctctcacagtccaggaggccagaaatccaaaatcaaggtgccagcagggttggctcattctgggaggtctgggggagagactatcccacacctctctccccgtctctggcagctgccagcattccttggcgtccttggctcacactctcatcactctagtccctgtctctgtctttacctggcgctctcccctatgtgtcttcgtctccgtgtgtcctctcctcttctcacagggacaccagtcattagaccagggcccaccctcatccaggatggcctcgtctcaacgaatcacctctgcaaagaccctgtttccaaatacgtccacattctgaggttccctgtagacatgaatttgggggggacaccattcaacccacaacgtgt

SEQ ID NO: 173 - DNA, 1886 bp, Homo sapiens
atgcaggattggcatgaggctcggctccacaagccctcaagcacacgatgacttccgtctccccaccagaccatgcctgcggtgtggcctgcatctctgtgcctcaaggtggtgctccagctgtcaccaccccacccccaaaaacaaaatggaagagactagaagaagcagccagggaaagtctaccaaccaaaatttcaggaggatttctggaacacaacaccctgttcagtctattgaccagaaaacttggtcacataccacccttcgttacgagaaaggcgaggtgtggccatgagccacttgaaagttccattacacttggacacgacaccaaaagcacaactcatgaccaacaacatttattaaattggacttcatcaaaattaaaaacttcttctctgcaagaaacactggtaagagaatgaagcaacaagctacaaactggggagaaatatttgcaagtcacgtacgtgacataggatatgtatccagaatatataaagaattctcaaactcagacatcaagaagacaagtccattttaaaaattggcaaaagacatgaactcaagaggatactttgcagaagaggatatatggatgacaaagaagctcgaaaagatgcccaacatcattagctatgagggaaatgcaaattaaaaccacagtgaggccaggcatggtggcttaagcctgtaatcccagcactttgggaggccaaggcgggcagatgacaagctcgggagatcgagaccatcctggctaacacggtgaaaccccgtctctactaaaaatacaaaaaaattagccaggcgtggtggcgcgtgcctgtagtcccacctacttggcaggctgaggcaggagaattgcttgaacccgggaggcggaggttgcagtgagctgagatcacgccactgcactccagcctgggtgacagagtgagactccatctcaaaaaataaataaataaataaataaccatagtgagataccaacacccatcaagttaacacggcatgtgctcactcatgtgtggaagctttaaaaagctgatctcatagaagtaaaaagtggaacagaggatactggaggctggaggggttggggaaagggatagatagggagagatgtgttaaaggatacaggtaaataggagaaataagttctagtgttctatgccactgtaggataactatagtttacaataatatatgatacagtttcaaatagctagaaggaagatattgaatgttcccaagacaaagaaacgataaatatttgagatgattgatatgctaattattctgatctgatacattatatgtataaaaataccactgtatcccctgaaaaagaacgattattgtcagtttaaaaacaaaaatataagggtttaaaaaaaatggcctaaatgaaaaagacagacaatactaagtgctgatgaggatacagagctactggatcttttataggaacataaattggtgcagccactctggaagagatttggcactgtcttataaagtgaaacatctatccaccatgtgactcagcagctgcattcccgggtacataaacccctgtgttcacacaacaacctgtatgttgtgaatgtttttagcagctctgtgcataataaccccaaactggaaacaacccaaacattcttcagcaaatgaacagatgaaccatgactccacaataaaaaggaatggattttttttaacttttattttaggttcagaggtacatgtgaaggtttggtatataggtaaacttgtgtcacaacgagggggagttgccttacaggttatttcatcacctcggtattaagcccacccaatagttatcctttctgctcctctccctcctcccaccctccacc

SEQ ID NO: 174 - DNA, 1039 bp, Homo sapiens
gttgtctttcaggatttttatagttgtggattttacatgtaagtctttaatctgtcttcagttaatttgtgtatatggtgtaaggaaggggtccaatttcaatcttctgcatatagtcatatgccagttaccccagcaccatttattgaatcgggagtcttttccccattacttttgttagttttgttgaagattgggtggtcttgggtgtgcagccttatttctgggctctctattctgttccattggtctgtgtacctgtttttgtaccagtaccatgctgttttggttactgtagccttgtagtatagtttgaagtcaggtaacatgatgcctccagctttgttctttttgcttgaagttgccttggctatttgggttcttttttggttccatatgaattctaaaatagttttttctagttctatgaagaatgttggtggtagtttgataggaacagcattgaatctgtaaattgctttgggcagtatggacattttaatgatattaactcttcctatccataaacaggggatagttttccattagttgtgtcttctctgatttctttgagcagtgttttgtaattctcattctagagatctgtcacctccctggccttcctgatttggctcttgccttggctattgttggtgtatatgaatgctagtaatttttgtacattgattttgtatcctgaaactttgctgaagttgtttatcaactgaaggaacttttgggccaagactatggtgttttctagatacagaatcatgtcgtctgccaacaggggtagtttgacttcctctcttcctatttggatgccctttatttctttctcttgcccgattgctttggctaggacttccaatactacgttgagtaggagtggtgagagagggcatccttgtcttgtgccagttttcaaggggaatgcttccagcttttgccctctcagtatgatgttggctgtggatttgtcatagatggctcttattattttgaggtatgttcaaaaggagtggattattgatacatg

SEQ ID NO: 175 - DNA, 1088 bp, Homo sapiens
ctccactgcgtgctgctttagggcactcccagcaggatgcagtttactgtaattcacacaggaatgtttaagagactggcaagagcttccactttcacctgctttcacgttatttatgttttaaaagaggctgccagggctgggagcaatgaatggctcacgcctgtaatctcagcacttcaagaggccgaggtgggaggatcacatgaggccacagttcgagaccagcctggccaacatggtgaaaccccatctctactgaaaatacaaaaattacctgggcatggcggtgcacatctgtgatcccagctacttgggaggctgaagcacaagaattgcttgaaccccgttgtagtgagccaagatcctgccactgcactccagcctgtgtgacagatcaagactcttgtcttaaaataaaataaaataaaaataataaataaataaataaaagagactgccaggaaaggacagaatctagccaaaggaatgtattacaaatggtggaattagagatagttctataggtcactcaggcgaggagatggccttttaaccttaatgaaatctaggacactctggggttttatgggggagtcacatggggggaagtattgggaagataagggaataaaaatcatcacttacctagcctctctgctcacctttaagtccaaagagttccttttcctttgctatctccgtaggcagcactttatgttgtgttttttataatcagaggaaaccgatggcaccataaacttctagaaagtcaactaccaccttggttctgtgtgggaaagtaaaattttatgttttccataaatacaagatgaagacagcatttaaagcctatccctgaattggatagatcattttaaagtgagtttgttgcatttagaaaccatgatccctattggccctacaacaaggcaattttcatatcaggcaggtcctggcatctggggagactggctgtttcctttgttgccagggaaatcatttcaaaatggaaaaaaccctgaatgccagcccccagcaatcttcaaaacaatacacattctttaaaaaaaaaaaaagaaagccaa

SEQ ID NO: 176 - DNA, 1051 bp, Homo sapiens
tctgggggaggatacttccttgcctctttcggcttctggtggctccagacactccttggcttgtagcaacgtcactccagtccctttctccctttcacggggccttctccgtgcctctgagtcctctcctcttctttttttagtttttgagacagagtctcactctgtcgccaagctggagtgcagtggcatggtcttgactcactgcaacctcagcctcctgggttcaagtgactcctgcctcagcctcccgagtagctgggactacaggcgtgcgccaccacacccagctaatttttgtagttttagtagagatggggtttcactgtgttggccaggatgctctcgatctcttgacgtcgtgatccgcccacttcggcctcccaacctgtcctcttcttataagagaaccaaccgttgaatttaaggcccaccctaaatccaggaagacgtcatctcaagattcttaactaatcccatctgcgaagatgcttttccaaataagttttccattctgagattccagatggatgtgaattttttgtggacaccattgaacacactctggctgtttactccatctgccagctgggatactcacaggacagatgaggaaagtgaagcatacggagccctggctgtccatggaaatagaacagagtccatcagcatcctcagagcacatggttttcagctctccttgaaggcgcggacctccagaagggttcacgtcaccttgatgaggggactcgaaggtgaatttgcactgggttccctttcagccaagcatcagtttgctccaacctcttgagcacacagaagttgagaaaaattgttattttagcaagaacactagaggactgtgctgttctctgaaccacgttcatctgattatgcatttgagggtatgaattaatccacgacacaggaacactgaataagttgtgctttgccagtcgggctgcctgtgttttatctgaacaaaacatctgactttaaccccaggcagatttctcttcaggttgtaattattctggaacaaacagagaat

SEQ ID NO: 177 - DNA, 1031 bp, Homo sapiens
ccatcacctggaagaggaggatcctaagctgagagagggaaattcttaaatcagctcatgctggactcgtcttacgttgttttaccctgaatctggaaagcatagcagagtcatggggtgggactgcctgaaacggcggtctaaccactgctggtatagaaacttagatcttgcccatcaccttacccttgaccttccctcttcttccataaaccgtctgtgggatgagtgtgtgttgtgcgtgattcagcttacaccagacttgtcacctgtcattcaacagggtctgtaactgttgctttagtttcagaggcacccgtttttcttgggtgtttggaggcgagtctggaagtatgtttcagggaagggaccagatatgtatttcaaggttcagcatgttaagttgtgcttgctctccaggcgctcagctcagcccccattaaaaaggctgaactggagaattgtaacaacatacagaggggtcctgagagcctgccccacactgcgaccatgatggtctgttactggagaaggtttaaaatgtagcatgcagtctaagcatgattttaactcgaggcagtggtgtggttttagcaccaagctagaaggagatgggttattaatccttttgacattccctttgaatagcatcatatttcaatcctgttaagctgtggggccgttgtttatcggactccctccaaaagcaggacctctgctgtgctgaagctgcaaaacactgcccagctctgtgcctttcggtcgacagtcggcttcagccttctcagctgacccctccacctcatcagctctgagatcaactcaggcagctcccagctgcctcagctcacccatctgtcactggccaaggaagggtcaatgggcctggtgccctttagttggaatgtcgagaaaaggaagaaggaaaactgcatctagaaaatacttttttaagttggagggtaaggtagtcaggcatgctgaagaatccaggattctaaatgtgactatctccatgccttcagctgtct

SEQ ID NO: 178 - DNA, 1892 bp, Homo sapiens
caaaatgaggtgacacttggcaccaaagaatggcacagcctggcagcgaagctgtttcctccattcgcagcagagctgttggaagccggcagcgcacacatcatcctcagaagggactcctccaaaacctcagcgctccgaaaacaggctgcgtgtgtagcttgatgttcgggggctggcagatgagccagtaatggatgtttcctatcctgagagcacatttttctccgaggaccatatcacctcttagggcctaatacaggttgatatttttcctttaccctgaaagtctctgcagcaaatgtgcagtcagaaccatttttctgattgaactaaaagtatcgcagcttcattttcttttccctttgggttaagtcggtatttaaaaggcctctccgaagagtgaaactatctctaatttagaaagctccaaatctccatcacagagacgcaggccgcggtggttgacaaggttccgggctcttgtttctaaacattgaagccatctctacacttaaaatggacgctggagtgtttctaaggatgggggtgaaagcggtgcaactgaaggtctttaatcaactgtggtcagcaaataaaaggaagtgacatttcccttgaaatattgaaaggcttggatttcttcatcagaagtgttttaagagcaaactctcaggttcattcaagtggggcactgccttccaaatgccaatatccactacttaagtgcagagaaaaatgtgtatatatgtgcatgtgtatgtatgtacacgtgtgtgtgtgtgtcagtgtgtgtgcattggaagggcttctcagcttcccacccaggagtctctgtttgcaaaataagtgtgtaggtcatgattatttcacatttaaattaatggaagtggatttctctagacatttatcgttcaggcaatgcagcgttctctccaaaatccctgctgcctaagtagaaatttttcaagtcatcttcagctctttcctctccctcacttgagggcatgcagtcagttgagcagattttcttcccctttccaatcttttttcacatctgtctgtttcattccgttcccactgccgcccagaaatcaggccctcataatccttcccttggaccattgcagtaacctccctgtcggcagccttgtgctctaatccatcctggattcagctgctagatgaattctctggcggcaactctctgagcaggtagctcttgtcatcaaagcccactgctcagccctcaggcggagcacctgaaaggctggcatttcaccatgtgcctgagccgtcctttcctgtgttccctgctgtccctagttaacctacatcctcccctctagggccctgctctgcaaactgtgctctgtgaatcctctgcaatcccagacatggctctagccaccacagttactgacccacttggttttgttaaatccatttaccagtcaaagtttctatgtcagtgtttgtcaaagaagagggtgccactgccgggggaatgttccctggcagttcccttggagcatcttatgctttctggcctctgagacttgactcacagcagtcccgccctctggaatgccttctcctccagccctgcccttcaaggcccagctgggaggctcccttgcccatggagggagaggtaacatccttggacacctggccagatgtgagcgctctctcccctaggcatctctgatttatctgtgtcgtccttggatgtgcatgcttgcagcctacagcattattgtctcataacctcccactcccccctactcactggatgtggactctgtaggcacagggattcgtgtgttcatctcatgtgtccattcaacaaccatgtaccctggcatgagctttcccataccaggtgctgg

SEQ ID NO: 179 - DNA, 1107 bp, Homo sapiens
gtgcccatctccctggtttatgttgccaccacatttgtcctcccgcttgatgtgaattcaaaccgtggtaggcggtgtgccctcgggactccactcagcattttgtatggccccttaatcacctgcttttcagagagtacagaccagatttcccccaacctggcatgtggacgtccttgcggggacttttccattttggagggtttccgcatatcacaatatcctttttgtaataaaaggaagagaattgctgacaattttcacaaatttaggctcttgcgagaataattttctctgaattatgtgtgattctcctttttatgtgtccctaacatttagtttgcttttggtgcagccgctaagctgactgttaaatatttgtctctcctgccacttggtcttcaagctgtaggtgtttagcacacgcgggcagtgccaaggacctcacatggcgaatgtcactggccttctggatccccacaaaccagaagcagtgaaggaggagacagaactggggtttaatttaactcctaaactactgaatccgcaccctttcctttctgcttttatcttagggctacgtggagggctggatccttaggggacatcatgaaagcaagaaccaccccactccgccccagttgcgcctgttaggatgggttggttggttgacatgacataaaaagagaaggtagggggtttgaggtcaacatttttcaacttcacagtctgagttgagggctgggattgtctgagtctctaagggtgcaggcttggtttccaagaacagcgggaacctggtgtggctcccatcataatctacccacagtcgccataggaccaacccacactcaactttgcacatgtactctctgcttgctggtctttccacagactcagcttctgcaaggcagggatgatgcccagcatacaaggtagtaggcaatgaataaatcttggtcaaattaataaaataataaccaattttgattatgattattcagttataggttcatgaccatagtcaacacatttacgctgagtgcatagcatgtgtcaggcacctatgtttgatgttggggacatggcaggaaatagagcaggcaa

SEQ ID NO: 180 - DNA, 1031 bp, Homo sapiens
gccctcactctctcccttgtgctaccatggaggtcctgtgtgctgaccaagcacttgtcccaagttgctggagcgggtcgtttatttgctctgcatccgaggcctgaatatgattggtgcttcacttttaaatgcgtgcatgaataaatggacttgtctttctcccctgtgacataatccagaagaggaactctatcttgaccatctttgcctccccagcacccagcaccatgcctgaagcacacagttgctcaatgtcgggcatgaggatgctagaggagggggcagctggtggcacaggtggctatggttgcctcagctcaggcaaatcccatgggcatgtggagacccagagacctacagtttttttcttgggtttgttggcttttagagttctaacagttccagcctcttctcttgggcctcctggaagggaatgtctgtcagaatctcccatcaggtcctgaaatttgagagcacaactatttacatattgaaaaggtcaggatagcgtgtgacagttttactttgattgaactagtatctttttatttttctcttacatgaggctgagctacttgctgaactgaaaaggagagggagggagaaggggcacttccccccggggtttcaagacctgctgagcttcatagccaagaggttctcactccccactcaagtgtcagctttccagaatggccccttgaagacaaaaactctttcaaggcatattaaacaatagcaaactctgataaaattccattctggtggcatgttttatgagaaactgatgaggggccctgaaatgcatctcaaccttgatgtttgagccagaatccaaatattccctttctgttaaccaattcaatgttgcttctctcttgtggttgtttttttttgggttgttttttgttttgtttaggattttccttgtgggaagccacattcaccttcttgatactatgaaatggctatacagaaaaatagaaccatccccaagcaaagattcctccccctttggaattgtccca

SEQ ID NO: 181 - DNA, 1065 bp, Homo sapiens
tggttccttatgtgtgggcatcattaacctggccatttgcacacattattaataacactagcagcattaataatggctacagagatgctttatgtgttttccatgcactggctgagtatcttactcagtattatcttatttagtcttgactgcaactctgtaaggtaggaactattggccccattttacagagaagggaatcaaggtccagtgaggttaggtggcctgtccagaatcacatggctaatccctgatggtggtagttttttttgttttgtttttgtttttttgttttttaattatttaagtgtaacaggccaggtgtgatggctcacgcctgtaatcccagcaatttgggaggctgaggtaggacagtcacttgaggctaggagttcaaaaccagcctgggcaacatagcaagatcctggtactctacacaaaataaaaataaaaaattagccaggtatggtggcatgtgcctgtagtcccagctactcgggaggctgaggcaggaagatcacttgagcccaggagttcgaggctgcagtgagctgtgattatgacactgtattccagcctgggtaacccagtctctttaaaaataaaaacaattctttaaaaaagtgtaacatgcatccagcaaagtccatagttcataagtaaataactagaaggattttcacagggaccaaactcaagcaagcagcactgacatcaagcaaaagaggaatatcaccagcacccggaggcacctgtgacccctccaagtcactacctgtccccaaggtcatcactgccctggctccttgcagcagtgatcctgcagctgacccagaaccgcctgagcctggagctacccatgggcagtggtaacttactacagatagaccttgaagttcaagtggcaggagatgatatagatgaaaggaagtcttgctaggaccattgaatcgccttatgacctaaccaaaaggtctggccaaaaatccagacagatcctgatctggacagtgccctgcaggccagcacccagcaccatcccagtgccctggacctgggagtata

SEQ ID NO: 182 - DNA, 1025 bp, Homo sapiens
gtgtgtgtgtggcatgttaaggcggtggaggccactgatggctttcagcaggataggaatggacccccgacttcggtggcatggaggaggcaaggatggaggcagagaccagttaggaggcaactgcagtggcctgggcaggaaatgatggcagagcaaatcagcaccaggcgatggcatctccgggggtagcctggctttgctagaccaaggaaagagaggattgagagaggagccccaaggacccactgcattttcccaggctcctttaagatgtttttccacatgcacggcacgtccttgtgcttcgtggctgacttctgcagcgcctactccatgcagcttagaagttaggggctgagaatctggaggcagaccagctgggttcaaaccccaactctactagctattagctatatggccccaaaccaattcattcacctctctccctgtatctgtttacctagctataaaatgggaatgggcataacaagagtacctggttatagggttattgtgaggattaagtgagtgtgtctgtgcctagaatggtgggtggcacacagtatgtgctccataaatgtttgctttcattcttcctgctcagagctttccttacgctctgtgacttgagacagatcagaacagggcctagtttgtatttggaagccagtctttcattcttcctgctcagagctttccttacgctctgtgacttgagacagatcagaacagggcctagtttgtatttggaagccagtgagacctgagatataaatcacacttgtgtgccttccgggtggctcctcctctggcaaacaagaccaccctccccaggccgtgccctcgcctgttaggggccccatgaaaccacacagcccgcagcctccacctgaggaaattaaaaaccagattggttatttcagggtaatcaaaagtaacaccacaggtcctgaccttttgttcacgagcagttacataagcagcgtttgctaaaatctcaccttgagcctcagctctcctct

SEQ ID NO: 183 - DNA, 1047 bp, Homo sapiens
gaaaaaaaacaaaggaagagcaatatatcatgacctgtgaaagttacatgaaattcacgtttcagtgtccataaagacttattggaacccaagcgtgctcattcctttagggcttgtcgaaggccgcttttgtgctacagtggcagagttgaatagtcaaggtggactatatggcttgcacagctgaaaagatatttattcatctaaaattttattttaaaaattgataatgaataatttacttaatcataaataaaagataaaattaatattctatttactcatctttatagaagaagcttgccaacccctggtctagactgtgtagccagtgagatgcctcagtcgagtgcccatccttggagtgggttgaggcagagggagtgaaccactcaccgagttggaccatggcgtgacagtggcagtgggtttctagcagacagcaggtatccatgctggacagaaagaacaatgagtgtccatgcccccccactgtcttgggctgggatctcctagaaacagaccctgaaacaaatgtgtgagtacttgacctttatgcaggagggcatccctgggagcactggtgtgtgtgtgggcagcagaatgggagtgagacagggaaggaaaggggaggggaaggaaagaagtcaatatagggtacattgttgagcagtcaccacaagggttcaatcctgctgggtgtctcagtgtggagcacacccctcagatatcccgccaaggggcagggaaagtagggtatccgtcctctaccccccccaggccctcatcataagcatatgggttctgtcttttctgggtgattgtgaggcagcccctttttccatctcctgtgcagtgaggatttcatgaagtcttgttgatgtacaggtgcccgggggaaagcatgagtggtgaccaggagcctgaagatgagagctctcttgttcctcgtcccggaacccttgctaatagaccctggagccaggtgttgccgctccaaggctctgatgacatccatgcttcaccagcaggtggtggccgcctcgt

SEQ ID NO: 184 - DNA, 1040 bp, Homo sapiens
atgaaacaagatcagaccagcagctaaaccagaaagttttgagttttctctaccctactgcccttcaccctttctggtctctggttcttaaagaccaaatcgagtttctgagaacttccatgatggctaggcattgaggacagcctgccgtggaaatggttctgaaaccatcggctgttacaaggggctttcctctaggagggcgatgggaactctggctcaaagctgcaagctgaacttgttgctgaaataaacatttcagccaggctgtgcggtggctcttcctcgaatctcagcacttgatcccaagtcaaatgtggtgctcagtttaaggagctgaaagaggtgccctgttggatgggagagtctgtgaattggcactttcagagatgtggggaagggaaaagatagagggggatgctggcttggtgggatggaggcccgaacaccttgaattgctcagggagaatgtcctgagatcggcaggtgatggccctgtgatggtgacagctctgacctccagggtgcgtgacccagggactagagcaggaggtgcagacagtggatgtttgcacaatccgcacctgcttctgcctcgattgcgttttactctgagatgttccacaactcactttccctgttggcaccaagggaataactccttctgaaggacggatcattccagagccccctcagagtgaaccaggtgctcactggaggttcttaaactgggaacaggaatccggttctttgatctttcattgtccattcattcggtcacatttcttgagcatctgctccgggccaggcactgttgtagctgccagggatatggcagcaaaggagatgactgcagccctggtttccatggagcttatagtctgtgggaggagatttccagtaggcaaataggcacaggatatgtccagagatggtgtaagtgctatgcagaaaaataaagccggggaggggttagaatgatgggagcaggtgctgcttagtttttaggtagggtggacagaggagcacgttctagaatg

SEQ ID NO: 185 - DNA, 1037 bp, Homo sapiens
tgcagggtgtcttgagtctggcagcagtacccacaggagaaagggaataactcagtggttacaagcaacagcaaacttcctatgtttaactgcatgttctctctgtggctcagtttcttttgtaaaatggggacatcccctagggtttttaaggggattgagaattcatgcacatgaagatttcagtcaatctcaacacatgtgaaaggctcagaaagcataactgttatcacctgggcaaaggcgacaagcacattcaagatcagagcaaagatgcatttctttcctgccacgtgctatgcccacacaagtacagaaccgaggaggtgccctagtccactggcaaagactcccatcccctctgccctgggcagtgggctctgccggcctcctcatctctgattcttcctttcagaactcccctcctctgctgggtacctgctttgttgaatacgttaataacattcatcctgtcactgcttagccttggggtcctgggagtccctgtctcttaatatgactttgcccatgagagtcattgtgtctctgtctttttttttaatttttattttatttatttattcattcattcatttattttagacatagcctcgctctgtcacccaggctgggatgcaatggcacaatctcggttcactgcaacctccacctcccaggttcaagcaattttcctgcctcagcctcccaagtagctgggattacaggtggccgctaccacacctgactaattttttgtatttttggtagaaatggggttttaccatgttgaccaggctgacctcgaactcctgacctcaggtgatctacccgcctcagcttcccaaagtgctgggattaaggcatgagccaccatacccatctgtgtctctgtcttaaagctttaaccctccaagggcaatatgattccttatttttaggataagcatcattccagtgtactaagatcacatttggacctgatttgggcccaactcaataatagcaagagtggtggccaagggagcactcacaacctc

SEQ ID NO: 186 - DNA, 1046 bp, Homo sapiens
ggcctgagagactggccttggctccattttcagataagagatcagaggttgcttgtccacaggtcaaatagctgggaagtgggggagccaagactgagccccagctggctgaccccaaacctgcatgcccgcctcagaactgcactgcgtgcctcccaagaacacggcacagagcatggtgtcgggtgttgggtgtgagcagaacagagtccctgccctcatggaatggacaggctgactccatggccacacccttctccaggggctgtgtggggagtgtccccagtggagggccagaaccaccatgcgctgagtggctgactcactcataccctgctgaggggcatgcccccctctgctggcatccaccaagccaagcctggttgccacctgggccctgctggttcaggaagcccttgtgtcacccacagaccttgctcctctccttttggaaggtggtagtgtgggagttgaggctggaggtgctggaaccagaccatctgtgtccaaaccctggctctgctcttcaccctgtgtgaccttggccaagccatttaactcctctgtgattcaacttccccatctataaactgtggatgataaaataggatctgcttcatggagctactgtgagaattaaactagttaagtaggtaaaatacagcaaagcttagaacatatagtatgtgctcaataagtgttaagaaagatgtaattgttattataataaataataatcataatattattgttacttagacctttggcttggggaggctggatttacaaacctacgattcaccaagagtcttagcagtctgagaggtcgccttctgttaaaaggtggctgctgtagctctagccattgagtccacttcccagaagtggagaaagtggagaaaggtggagaaagaggtaaagccttatttttgtaagagtcattcctcctaaaggacttttttctgcacctcactgcccagaagtgtgtcacatggacaaccctagctgcaagggaagctgaaaatagcatttttagaaagtgggac

SEQ ID NO: 187 - DNA, 1056 bp, Homo sapiens
ttttccaagtggccaaccaggcctgtagatgagagtctatcccataggcattcctgcttcaaggagttctaggctgcagagactgtcttaagtccagcggggtcggtggggctggaagactaaagctcccagcaggtgcagccatgccctggctgcctttgcagatgtcaccaggcctgcagacagtggggtagtaggtggcctgagaggctgttgaatagaacgatgtgtcatctgtgctggggcggccatgcccacttgctttcttagacacacatccttgtcaccacagcactgtgtgggtttgaaaagctacttgatgtttcctgtgtcccttcccacatccgcactccattcttagtctcattccctccatcaaagacgtgttcatcttctatgcagttcatcacctggggttgaatgtgtatgttcctctttagtaaattcatacgcttgaagctactgctgtttctttagcctggtggctctcggggctgctgcagggggcccaccctgagccagcccctcggtcccacagccctgacgtagaagactctttgctggtaaatctcggaactcactggaagcttccacaaagtttaactctacagacagaatgtcttccttacatactaccggctgcttttaaatattgttaacagatcccccttaaaggcttcttagactccacattttgatccagttgataataattgatggtcaggtggaagaattgcccaggctctgttgttgttctgttatagttgccactggacctgctttcagcaccctcaccctggctgcttcagagggcagctggattcctaaaaagaacccatgccctaatgcacaagtactttttattttattttatattatttttcgtggggggacagagtcttactctgtcgcccaggctggagtgcagtggcatgatcttggctcactgcaacctctacctcctgggttcaagcgattctcctgcctcagcctcctgagtagctgggattacaggcgcccgccaccacgcccagctgatttttgcatttttagtag

SEQ ID NO: 188 - DNA, 1013 bp, Homo sapiens
aggaaaaatgagggaggcaggagggggaggtggggtggctggaggaggctggtggctcctagactgcgtgtcttcagtgtgagcccctgcaagagcatgtgacgccctgacaaggcggcgtaaccaggcaaccgtcattactcatccccatggccactgggtcttccagtggagcaccgtgctcctgggggtcagggctccccagagggacagggcagcctcctctgcagaacagcggggcctgagagatgccaggaaaacgtgcttgctccaagaagggaggggagagtagttaggagctggaggcccagccttgccgggaaagtggtgtgccacagcatagctgggagctggggcctagctcccaaccctgaatgcttagtggggtttctcgctttttgctgtctctgttcctaaaacggatttttaaatttcaagtgcgtgcttgacccagtagcacagttctgtgcattaaagaccttagcccatgaagcatagaccagtcttgtgtgttttgtaaatccatgttttttaggtattaacagaactcccactagcttatatggagtttttatgcaaattggaaaaaggtacccactctgtgtagacagataaggaaaaggtgctcttctatcattgaacacagtcctatgcaaccccatagcctggtgatcaggcagtggtatctgcatgcaaccccatctctggggggttatagccctgtggcaggtttgctgcggaagcagagagatgcctcctcctccaggttgccggagccctgcgctaagctgcacaatatgacaaacacaatactggctgcatttcagcttccacctaactcacctatcaggcacttttgggcagtacacaagctgtgcgactgtccatggcagccctgggtataagtcacggccatccttgctggttgtggttggcataaggagcaataccctctggatttcatcttaaaagaatttaaggaagagaaaggggatgcagtgccttttcaacat

SEQ ID NO: 189 - DNA, 1056 bp, Homo sapiens
ttttgtgattacagagtagagcaaatgtggctgggcatagtgactcacacctgtaatccaagcactttgggaggccgaggcaggcagatcacttgaagtcaggagtttgagaccagcttggcaaaactccatctctactaaaaatacaaaatgagccaggcatggtggtgtgcacctgtagtcccagctagtcgggaggctgagcatctacatgggaggctgaggaatgagaatcacttgaacccaggaggcagaggttgcagtgagctgagatcatgccactccactccagcctgggaaacaggcaagactctgtctcaaaaaaaagaaaaaagaaaaacagagtagagcaaataagtaaatatatactgttaggtaccagggttctctctgtgggaaaagggccttctcatatggaatgggggaaggcggtggattggagttggggccatcattatgctcttttgatggtataaatatgcaattgacaagtcataaccatagaaagaagagcaagaagccatgtccccctgtagcaatgcatgtatctagtgcccacatctctctatttcttgatgccagtctccatcagaaggagccaggtctccttggacaagtggaggatgccaggcatgaggcagtggaaagtaaaatgcaactagagccctttgtccttccagaaagcaagaatgcattcaaagacagatgggtccaaaagacccaggcactggctgaaagggactcctgctggcaaagatgggacaattgaacatccaataaaataataaaagaaatgggtgattcaagggggaaaggagggcctgtaatcccagcactttgggaggccaaggcgggcagatcacgaggtcaggagttcaagaccagcctggccaatatgatgaaacctcgtctctactacaaatacaaaaattagccaggcgtggtggtgctcacctgtagtcccagctactcaggaggctgaagcagaagaatcgcttgaacccaggaggcagaggttgcagtgagccaagatcatgccactgcactccagcctgg

SEQ ID NO: 190 - DNA, 1058 bp, Homo sapiens
agccgcttatgagatacaggatttgcaaatattttctcccattctatgagttgtcctttactttcttgatgatatcctttgaaacacaaacggttttaattttgatgaattccgatctatctgtattttcttttgttgctctacacttttggtatatgtcttagtgcatgtttttaacgtaatacttctccccacggaagaaatgaggcaggaggggctgttgggctggactgagtggttccagtggactcagggtggcccagggttccttttgagagggaactgaggccctgtccgattcctgagccatgggcccctggagcccaccaggcctcagttcttcgtcattgaacactcagccagcttagggctgggaaagcagtttcgacaacgacttgctccctggtcagattgacacagctgagaggggagaatcggggctctcgacataggtgagcctggcttggaatcctgggaaggccaccaagtggcaagggcacatggaagggacatttcgtctttctgagccctgttttctcacctgttacaaaggtgacggcggtgatgccacttctcagcactcaggcatctggagaggacagctggggtcttgggaactaactctctcctttatccccagccatgaaagctgatcggaagcgcttaaagggcgagaagacagacctggtgagccagatgcagcagctgtatgccacactggagagccgcgaggagcagctccgagacttcatccgcaactatgagcagcaccgcaaggtcagccgccgccctgccctcccctcccctcccgacacaccagctcccacctcccctgctggctggccaccttcacaggctctgcctcttgaatccccaaacacagatagggaggcccttgatgtgtccagccaggcctaggcaccgagataaaaccggcacaacccccggagagggatctccatgtctcctgggcaaacaggacagcgtggactcaggagtccggggggttcagatcctggctccttgtgtgtgtgccctcgcaggtctcgcttgacctc

SEQ ID NO: 191 - DNA, 1030 bp, Homo sapiens
tcgttggtcatgccgttcagtggtttttagcatgctgacaacattgtgcagccaccactgctgtctaattccagaacagttgcatctccccaagaagcaccccgtcttcatgcgcagtcactccagtgaggtctgtattcttacggtttcggagctggagatcaggcgatcctgtactccatggggtgacggctttgccgggaggcttttgacgggagtccagccatggcctgaaggaggcagctcccttaccagccttccctcagtccacaggcctttcccaccagcctccctagtcacatgtggggctgggagacagggctgcctgctcctgagaccatgggcatcccccacacactggtcctgtccctgggagcccggctcacacggacctcgctgctgacgagcgcggcttctccagcacgggaaatgctcttcagtttacggtgctctctgtaaacaagggcaccatagacgtttggggccacataacagtggtggggctgccctgtgctctgtagggtgtgtggcagcttccctggcctccacccaccagatgccagcagcaccccctccaccccagccccccagtgtcacagcagtagactccagacatggccagatgtcccctggagtgcagaatcaccccagactggaagcacccctccatcaagtaggacattttgcaagaatcagacgttcctatctgtctgggcctgggctgtttgagtctagcagagtcccagtttgggtcctgttattttctgtctgtgtgacccttgacaagggacttaacctttctgagcctcagtttcctcctgtataaaatcagaactataggccaggtgtggtggcacacacctgtaatcccagcactttggggaggccgaggcaggtggatcacctgaggtcaggagttcaagactaggttggccaacatggtgaaacccgtctctactaaaaatacaaaaattagccaggcatgatggcaggcgcctgtaatcccagctactctggaggctgaggcagg

SEQ ID NO: 192 - DNA, 1013 bp, Homo sapiens
ggtgcactgtggcctccggatcagcggaacctcaggccctcctggttaacaggaactgccattggccccagccaaaaggcaggtgagggcagggccctgtgctgccatctccccttcctgcctcatgggtctcactgcccaggctcagggagcgcataagtaatcctaactgagcactatggctgctctgagacagtgggccagaccggatccttgaccctggtgtgaattactcctcacatcatccctgcttgtgaaatagagactctttaataacaatcgctaatatttgttgggtatttttaccctggaccaagcactttcccagcaaccatgtgagggaggaactgtcattatccccgttagacagctggaggaacgaaggcacggagaggtgtggagcctaccttgggatcccacagctcagagtggcagagccagaaccaaatccagacagagcccaagctccaaagaactgtgccagggcctggccacctcatcacacaactccagagggtgctgcttacataaacatggtccctcttgttttcaccatcttatattgtgggaccttgaagttcagaatggtggagtaatttgctcaaggttacacagcaagttaagtgggagaaatggagtttgaaactagttctgtctgacttttgtcaaatggatgcatttgtgtcaagttaacaattcccaggagcttgacgttccaagttctgagtgcttggaagaggctggaggctcagagaggagaagagaagagtcagaacccaaggggagttcccagcattaaattgcatttagtggaagagattagtcagagaaatgtgtcaattgccacaggagaggatctaatgcatgtgtgtgtgtacgtgtgtgtatgtgtgtgtgtgtggtgttagtctcttctcatgctgctgataaagacatacccgagactgggtaatttttaaagaaagggaggcttaatggactcacagttccacatggctggggaggcctcacaa

SEQ ID NO: 193 - DNA, 1034 bp, Homo sapiens
aggcttttgtacacctgtaggctattaagggttccctccacacccacgtaaggcagggctggcaacacaatggaaatgtcctacctgcccatcctagggacctgtcgtctgaggctccctaggaaaaagggaaggagttcagacccctcctggggcagcccaaagctcaggaccaagtatgcagttaccctggagctcctgcctggaaggagcactgtgccaggaggaatctgacagcccccaattggagctgtagctctgcatccaattagctccacggtagtggactgtctgctgcctctcttgatatctgtgaatagggctaacgagtcctgcctgcccctgcgcaaactaagagattcattgtgtcggttgtgggggaagctagaggctacgtggtctcccaagtttgtttctgtcccaaaattctctattttgtgctttttctataaaagtacatttctttatgaaaagcaccaagtctaaccaagctctagctctaactcagaggacagactgggacaggaacttagacgccctggagtggctaatttgttggtcagaagatgctgggggttgagaggccagactgggcaggagaggaccccaggaactctagggaaactccaggccccatcaataagccatctgggggtatctgcttcaggagatggggggtgggctccccactgcagaggcagggtggcccctgagagatggcatccttccacggaaggccccacaccgcacgggccgcctctgctctcctgtgtcacctgtctctgctgtttcatcttcctcttctcctctggctacagggcgacagtcccggcccagttcagaagaacctgcacaaccctattgtacaggtaggtgtgccctccctggccacttgaaccctccctccaccccaccttgactacaacttcaccctctgttcccctgagcccacatccatgccgcacacccaaggtggagaggatttatgccacttccgctgagcccacgtccatactgcacacccaaggcggaga

SEQ ID NO: 194 - DNA, 1057 bp, Homo sapiens
acagtacaaatgaccacagctgctcactgtactgaatgcctgtggcacaccagacaccgtccttggggtctttttctttcttttttttttttttttttttttgagacggagtctcactctgtcgcccaggctgcagtgcagtggcgcgatcctggctcaccacaacctcctcctgggttcaagtgattctcctgccttagcctctcaagtagctgggatgacaggtgcctatcaccacatccggctaattttgtatttttagtagagacagggtttcaccatgtttgccaggctggtctcgaactcccgaccccaggtgatccacccgcctgggcttcccaaagtgctgggattacaggtgtgagccaccgtgcctggcctgttctcagggtctttatcctctctttagcaacatcctcgtggcaatcttggaagggtcttactgttgtccctgagaggttctgtgactggtccctgtttgctcagtgaatgaggggctgaccttggcattccagccctggaggtggcttctcagccatcccagcccgtccctgaccccactggcttaaagctcagagaggccttccccaccccggatcccatccactgcagtctgcaccccagctaagcttggctttcttcttctcccccaccctcttccacgtggctcctgactcctcagtcactagaggatcttgaagaccaaaaacggaaaaagaagaaagagaagatgggattcggctccatctcccgcgtcttcgccagagggaagcagcggaagtccctcgaccccggcctctttgatggtaccgcccctgattattacatagaggaggacgcggactggtgatacgcgctcccctgcgcctgctgcccgcaggcgtgtctgtgcgtgtgggcgtgtgtgcaagcgagcgtgggtgcgcgtgtggccgtgcgtggggtgcgtgtgcacgtgtgcgctggcacacatgggtgctgggtgtggccgagcgcctctaacaagtgaaaacacgagtgtgaacctctctcccctgcgtcgccacctctgtaattg

SEQ ID NO: 195 - DNA, 1030 bp, Homo sapiens
ctgtcaaaagaacccatcttccaccttgactcttacattcttctgttttcttttccagacatcttgtgataggttatccctttacttgtttgtctctttcaggaaaagagaagctttgtgagaacaggcctttggcttgttcacttctgtgtttgtagtgcccaacaacccagtggttgctcagtcaatgtttattgaaatgaatgaatgaagtcaacagagatttgttgaggcttcctgtgaacagtcctatgcccagtgttagaggagtcccagaaaaatataaaaagccccagaggcggcagtgagaacacaggtgttcagccctgcgtgttaaactttagttagagagagaaagcgggaatgaaaccagcaccctcaagacgactctaaatggccggtagcaattggctgatacaaacaacctgcatgaacagaacttgagagccactccccgctggccatggcaggaggcttctggaagaaaggggaatagaaccggatgtggaaggagaggccttcaggatggggtaggggaggagagaaaggcaagacacagagagtggagggctgcagaggctggaagatagacccaggaccgtttccctccttggacatgttcaggacattactctggtcttcccctgagagagaacatgtttttctccaccctgcatcattggtgcctggtacagggccctgcacaaagtgcatggtcaaggaattaaagaattcaggttggatgaggtagttcacagcctccctggggagctggggctttatcctgtgggctgtgagggacactgaagttctgatagacacagtggctggagggttagcatggctgggcctgaaagctagggaagacttagaggagtcagttatcaccatcagccaggcctgagaagtgagaaggagatggatgaggcaggaagaatcactgaaaaggactctgacaaaaagaagcaacgtatttgggagccaactgaacatggatatgggcgggagttgcagatgtctgaaaggagcc

SEQ ID NO: 196 - DNA, 1084 bp, Homo sapiens
tgagggtcatggccaaggagtttggattttatgctaaaagtaataaaaacacattgatgggcttttggacattcttgttacaaactatttcagtcattcaaaagagtatatataagatatatgtgaattgtaatgaatagtataataaaacgctcatgtacccttcactgttcgcctccccagtactattcttcactcttcatttctccaggaggtagtgtgtgtgtgtgtttgtttgtttctatgtttgttgagacagggtctcattctgtcacccaggctatagtgcagtggcgtgctcaaggctcactacaggctttacctcctaggctcaagcagatcctcccacctcaacctcccaagtagctgggactacaggtgtgagccacacactgggctcattattattattattattattattattactattattattattgtagagacatggtctcactatagtgcccaggctagtctcgaactcctgagctcaagcgatcctcccaccttggcctcccaaagtgctggcattacaggtgtgagctactgtgcctggccagaaggtagcctgaatttgtcctgaattttagtttatagtctttgcgtttcttcctaatattacaaaaatagagcaacatattgtttggttttgaacttcatttaagtggatttctgcagtgtgtattcttctgcagtttgcttttctgttcaacattatgtttgtcaggatcatcctcactggtgcacacagctgcagtttactcaccttcactgctgcgtacgtaatactccacagagtgacacgttgtggtttatcctttctcctgggaccaatttctaatgttgaaccaaaccctgcattcttgggataaacccaacttgattatgatgtgttatctttttaaaaaatatggttgggctgggtgctcccttctgtaatcccagcactttgggaggccaaggcaagaggatctcctgaggtcaggagttcggaccagcatggccaacatggtgaaaccccgtctctactaaaaatacaaaaattagccaggtgtgggggtgtgcgcctgtagtcccagct

SEQ ID NO: 197 - DNA, 1127 bp, Homo sapiens
tagacagactgtcagccatcactggtctcacacctagagtcattcaggttcctcctgagagagacctgaagggttgactccaacccctctccccatttgacagaagagggaaccaagacccagaaagatgtggcggtgacttgctcggggttacggagaggttctcagtgaggctgaaaccttgtatgatgaggagagtggtcccggtgtctcagggtggggctccgaggacatgacacacttagagttctgggccagtgccaggcacaaggaggctctgcgtctccctggccctcgcagccaggactctccatccccgtctccgtgcggcctcaggctacgtccagcatctctgatcccccagctgctccctccctctctttgctcctccagggctggctctggaaccctcctgtcagagaggcaaagagaatggccctggagagcctcgggagtgcccacccctgggctgacaacagcctagcgggggctctggagggttttgtaagttgagacctgctggaaaggtaggcagccgtgtaattctgaacctgccgtggaatctgaggacgatgccctagatccctgtctcccgcctagcacagccttgcaggccctgtccccactgtcatccccagccacttcatctcaggacaccttacgtcagagaggcaggctttcctttccttctggccagctcttccctgcacaagctctggaagcctcccgccctcttctccacacctccacctccaggggacacacctctcccaggagcccttcctggacgcagtcagcagggcctctggagtctgcagccctgggtttgaatacagctgtgggctgtggagcccttctgagcttctgttcctcacgctggaacagcggggacagggggacccacgttacagggttgttgtatggcgcttagcccagtgcttggcacagagcaagtcgttactaaatgactgtcaccgccatccccagctcagcatacaccctctcctgggcccctcatagggccctggcagtggtcattgcggctggctcagaggcagctccacagtgcccactggctgcctccacttaaccaccagcggagcttccaggtctgccaggttgtcgac

SEQ ID NO: 198 - DNA, 1040 bp, Homo sapiens
aagatgtcctctctttttgcatctgcaggtatgatgccgggcgggacggcttcatcgacctgatggagctaaaactcatgatggagaaacttggggcccctcagacccacctgggcctgaaaaacatgatcaaggaggtggatgaggactttgacagcaagctgagcttccgggaggtaagcccggcccccagccccactcccctaccaggggcttcacctgaggacctggtggcccgggagagaccaacccccaccctttgtcaatgaatgaatgacattgccattgaacagcagctgtgagcagctgctgcttggctgagtgaggcttcagagggcctgttacagcaggcaccagggagggttctgagatcctctcggggaggaagaggagggagggacagcccttccttcacatagggagcatatattgagcgatttctgtatacttgaccctgtgcaggctctggggtagagaaaggccctgtgctcgaaggttcctggaagtgtagagggggagacaccacagaaggaaatcagggctgtgatgcagaggaagagggccacggcactgggtgacttcacgcccaggatctcactccgagacaggagctaggggcaagccggtttcgcagggaaggaaatggaggcccaagccagacagcgatgatactggaccccaggaagtacagggatggaccccaggaagcacagggttaggtgtggggactcgaggcccaactggggcccaggaggtctggcaggaagcatgaaggatgcagggaaggagagaggtggcaggggcaggtgggggagtgcgagtggctgggcgggaggtgtgggcagtgcagggtaacagcttagagttcgagagcagggttccatccctctgacacgttcaggcgctgagacttggggtgtcttttactgtcatggaggctccctcattctgtcatgacacctgtaggactcaatacatggaacgcagagtaggttcactgggcaacagcgggagacagaggtaagaggtaggctgaggcc

SEQ ID NO: 199 - DNA, 1010 bp, Homo sapiens
ctcacctcaacctccgcctcctgggttcaagcaattctcctacctcagcctcccgagtagctgggattacaggcatgcgccaccactcccggctgatttgattttttgtatttttagtagagacggggtttctccatgttggtcaggctgatctcaaactcccgacctcaagtgatccacccgcctcagcctcccaaagtgctgggattacaggtgtgagccaccacgactggctgcatttattttcttcctatgtctttcaagctgcttacaaaaaagtcttttggatgaaccttttgttgttgtttagatttttttcttcctttatagattctttcaaatgaagaaaagagatcaaattatgatcaatatggagacgctggagagaaccagggctaccagaagcagcaacagcagcgagagtatcgcttccgccatttccatgaaaatttttattttgatgaatccttttttcacttcccttttaattctgaacggcgggactcaattgacgaaaagtatttattgcacttttcacattatgtgaatgaagtggttccagatagcttcaagaaaccctacctcatcaagatcacctccgattggtgctttagctgcattcatatcgagcctgtgtggaaagaagtcattcaagaactggaagaattgggtaagataattttattcactgaaagatatttatatagatgactttttttttttcaagatggagtcttgctctgttgcccaggctggagtacagtggtgtgatctcggctcactgcaacctccacctcccgggttcaagtgattctcctgcctcaacctcccgagtagttgggattacaggcacccaccatcacgcccagctaatttttgtatttttagtagagacagggtttcaccacgttggccaggccggcttcaaactcctgacctcaagtgatctgcctgcctcggcctcccacagtactgggatgtcaggtgggagccaccatgcctggccccaa

SEQ ID NO: 200 - DNA, 1062 bp, Homo sapiens
tctaattcaggtttctgtgtgcgctcggtctggtataacgtatactgaatggcacagttactagaaaggcatatttcccaggatcagttcataaattggcattcaatctatatagcaatccctggtaaggtcatttagggtgagtcagtcactgagaaattgatccctctaatgttcagaacctggggcagaactggtcattggaggcagtaagaagtccaggctttgtggtcagctagaactagattcagatcctggttccactgcacacaaaccatgatgcctcaccctcccccagcttcagtttccttagccataaagatagcaatacttaccttgcagaatgattgtgagtatgaaaagtataatgtatataaagctctaggtgtgctaaagaaggcactcaagaagtgataatccctcccttgggcctttgtcttgtagccagttgacctccctaggtgatgtctcttctgtctttacgaatgaccaaatctcccaatgtatgtgcctgctttattctttttctttcttctgctcatataattctctgtatgcttccatttattgacattgttccatagttatttttaatgactgcagtgtgatatagtatactgtacttggctctagagaagagccaagaatccaatttggattcttgttctgcaattctgtcagctctgcaacctggaaaaagtcactttacctctctgaacctctctctgtatctgtaaaatgagggaagcggactatacaattcctaaggctcctcctttcctgcccttgagagactgcaacagtcaaagtcaggtagcctacagagagcttggtttagtctgctcagcagttttaaaacattaagtttgggatccctgccatttactcagcaatttcattttaggaatttactaattagaaaataagcgcacaagagcacaaagatgtatgcacaaagatgtatgtacaaagatgtacaaggatgcccgtcagcattccttataatgttaagaattaggctaaaagcaactttaatattgtgctttataataagaaatatat

SEQ ID NO: 201 - DNA, 1072 bp, Homo sapiens
aaggcatgacacttattaattaattaattactcaaactaaatcgtttaagtgaagtctgtaggagactaataattgaaacagatgaagtacagagactgaaagaattaattcctattaatacccatcttgcagaacttacactgtcataggaatctgagcctaaaatgacagtgcctattttctaaacaaaaaaattaaatcacatgttagaaagaattagggatttctttctggctcataaatttgttcatgtgaagatatttgtctttatgcaaatttaattatatttggttatatgtttaacgatcatatctatggaaaatgccagattccatgaaatcaaatattatttttgaaacttcagaaacttacagtgacaataatatgaatgaatttcacaaagaaaaggttgaaatagagaagccagataaagttcacattggtctattatttccatatttaagcacctaatatgtttttttcaatatcttaatttagggatcaaagtaactaggaacggactctcattttgctttaaataattcattctcttaagaatacagggaaagtgaacataaaaaattttcatcgtatttctacatgtgctattcctagactgtcctactgggatcattatctataggagaaatatttgttggaattaacttaaaagtttgtcagagaatattggaggcttctaaaatggtgatagattgtcctgatagatcctcaaacatttacataaaatatctcttctgtgcccggcatagattaacatagccgtttcaagcagctcccaagcgggtggttatttccagtatgttggagcccatcgtaatgagttgggaaaggcttcctggcagaagtgacccttggaccaggttgggttgcaggcaggcagaaatctggagacatgaaatagcccgctttgtaagaagttttcactggtgagcagcagaggagggggatggagaggttattaggaatctccctgtgagggcctcagagcaccttcacgctcctttaaggaacttgggccttggcccacatggagccgttgtaggggtttga

SEQ ID NO: 202 - DNA, 1072 bp, Homo sapiens
agtgtgtttgcagaaggcttttaaaatgtggataccctttatcaggttaaagaaggtccttctactccttgttgactaaaagttctaaccacaattggtatgatttttatcaaatactttttctacatccattagattattctgatttttcttctttaatctatattgtgctaactcatattaattcattctctaatgttaaacctaacttgcactcatgaaataaatccaacaagattatgatttctattatgctttcaatatattgctggattccatttgctaacattttgcttaggactttgacattcatgttcagaaatgagattgacttctaacttttccttatcgtgatacccatgtgttgctttttctcttctcaggaagactttatgtgagattgtcttccttgaaagtttgattgaaagcatctgtaatgccatttgggccttgagcttgggtttctgggtttcgctttaaggaaagatttttgactactgattatttaggttttctgttttaacttctgcattgtaggtagtgattccttcttgtcatctttgagaatgattattttatgccttctcttttgttttcatggttggttttaccagaggcttgtcgattgtattagctttttcaaagaaccagttttgtctttgttaattcttcttcttatattaatatattcatttcttgtttcattaatttctatttttatctgtattatttcctttctacttttatatttttgctgtttttgacttgacagatgtttatttcattaacttcttttctattatgttaattgtaaaattccccttcaagtactactttatatgtatctcagagttcttataaatagtatttttcatcagtcattaaagttcaaaatattttctaatatctgataggcgttcttgttttggttttttttttttcttttttagtcagtcttgctctgtcacccaggctggagtgtagtgatgtcatcatggctcactgcagccttggcctcctatgctcaagtgatcctcacccttcaacctcccaagtagctgggactacaggc

SEQ ID NO: 203 - DNA, 1033 bp, Homo sapiens
tttattatcccttttattgtttcctcatgcagaacttattgagcatagcctattatactgagatacaaaatcaaacttttagaataagctgtctgtgaattagaacactgagcaatctctaccttcccctccaccacctccacccgccaagaaaagctctgtttgcctgaaattagtaagcgtttattggtgtgaagagtttttggtttgggatttttattttatctttttttagctggagagaagaaattttaacttgagctaatagtttgttaatttggttttaggagggaaatgatgcccctgctgtccctgatcttctctgccctcttcatcctcttcggcactgtcatcgttcaggctttcaggtaaatgtcctgtggcttctcggtgcaccaccatggttggtgttgacactttttttgtaaaactccttttttcttactttagcgactctaatgatgagcgagagtcaagccctccagaaaaagaggaagcccaagagaagactgggaaaactgagccaagcttcaccaaagaaaacagcaggtttctctaacaaaacaccagactcacctccccggcacctgccccccagatcctgtcatctgataacgcagcattggaacatagagtgtagagaagaactctcatgcacctcctcccatgtaaactgtggctacagggaaaagtcactgtgatttgtgtttactaagaccctgtaggtgtttagatgccttagatttcataatgaaggcagaaggaaagaagcctatcaggcaagtgttaggtgagccagaagcaggacgtggtttatccctgtaaatgtcaatgaacgtaaccagtcttgtgcgcacacacacccagcagcaagaggccagggtctccgagacaaagaacatagactgaatgatagttgtcttcttcattctgtcctagagcaacttctgcacctgaaaagcagcatcaagcagggcacagtggctcacgcctgtaatcccaagacttttaggaggcctaggtgggaggattg

SEQ ID NO: 204 - DNA, 1096 bp, Homo sapiens
cgtatttaaacaactatgacaatcagtaaaaaccacatcttcctttggttaatttgatgagattattaattccggaatttacttctttttttttttcctctgcattgttgtttatggacaagagagcctgtaacaggttggggcaggagtgatctggtctattaagtaaacatgtttttgagaattattctgaagtgaatggactctcaagataatgtataacaggagtggagataaaatttcttgacctgcaaagagggcccacccatatatgtttttctggctggtatagattaactacctcacagagatcatcctcttcacttcaccatttccttggttgggagttgaagaaagtggctagttgaacccctgctaaagggtagaaatgttacatcatgagtttaagcattctctttttctatctgaggtccaaaaaggcttcaggatagtcccagacttgagacaagtttgtttgttttttgattttttagtttatttaaaatccttaatagtgcaaggattgtgctataattctgatcactgtggaattgcttagtgtactgtcatttataacattaagcacagttatccttaagaaaagtattcagttgttcagacaagtttgaccatcaactatattttttggagttgaaggaatgtcgattgactcaggcctagcccctcattctggctctccttgtttacttttctctttttcatttttcttttttaaataacagttttattgagatagaattcatgcatttaaatgatttttttttactatattcatgagttgtgtaaccatcaccacaatccattttagcgtattttcattaccttaaaaagaaatcctatacccatttatagtcatttcccatttccccctagtctccgcagcctagacaactacaagtctactttctgtctctatgtatttacctatttggaacatttcatataaatggggtcatacaatatgtgagtccgttgtgtaaggattaaaattcccttttatcttcctttcattttagtaaggtcagttccacctggcatatagaacctgggagttgtagcttctaaactgtggtag

SEQ ID NO: 205 - DNA, 1059 bp, Homo sapiens
aattgaatctcagctgagaaagaaatttggaaagggactgttagatatgttcactcacctttactccataagatttttttaatcacctaattcgatcaggtggatctactttcttcacctgtctcacatttgcccgtgaattctctatgtgtagaaacaaaattaatttctttacaagatctattaaaaatctgttgaaattaacagattgctgtgtgtattgtgagagaatggaagcaaccaacaaatattttggatgtccaaactacagaaacatccctcaacttggaatctaccagttcctgattttaaagatggcaaaagaacggaaactataaccctgcatgctgtgtggtttgcattgttaacccaagtttgcttgtctgtttcctaattcacacagagcgtcagaagccatgatgcatgtagtgtgtgtgtactgcagctggagtgggccccagaccaggtatttatagacaccatgttaagccttccatccagttgtcatctgtgatctgacagtctgtatccgcagcagtttgggaagttagcatttgtcattcaccatttcaccttgttcaatctggttacaactagcctatatgcatttgtattttggcatgcatacatggatatgtaacataaactcctgtttaaaaatggattcgttattagaaccatccaacagggagaaaatcccagttaaaacagtgtctattatatctaccccatcttggctactataaatatcacatcaagaatattggcctcacaacactttgttgttggagataactatgctttcatgggtttcataagtgcctttcctctgaaaaactgaaagctgttcttttacattactgcatacaactacctggagttatagagggttagaaattttaattttgttgaagaagaaatggaaacttaggccagaggacttgtcaggggtgactctgaacaacaggaactaagactttgcttttccttctgtctctggcctgacagattttcaggaagcactctgcttccatttcctctgatgtaaataatggtaaa

SEQ ID NO: 206 - DNA, 1088 bp, Homo sapiens
atagactccctcctaaagggccttccatgtaagcagaacgaaccttggcacacaattcagtgtggatatttgggaaacagttccaagtggaatatataatatcagtcgggaaaagatttcattaggatagctttttgtgtatgtatatgtatatttatttttaggaatagatctatagttgtacatgaattcctgttaggaatactctgaatgagcttaacccacttgccaaatatccttgtcccttccatcattttatttttgagatggggtcttgcagtgttgcccaggctggactcaaactctggggcttaatcatccttctgagtagctgggactacataaaggccaaagtataattgcttttgatttttaaaatcttcttgcccatcatttttataaaaataaagctgtttgtccaacacggtgaaacctcatctctactaaaaatacaaaaaattagctgggcatggtggcacacgcctgtaatcccagctacttgggagactgaggcaggagaattgcttgaacctgggagatgggggttgcagtgagcctagatcacgccactgcactccagtgtgggcggcagagtgagactctgtctcacccaaaaaaaaaaaaaaaaagctattgacactgttaatattttggatgacttaaatttagcagctctagaatgcaaagggtatattaaggagcattacaatagtgaaccttcatcgtcagcttttattcaattaagagctccagaaatgcagaaattatgggttaacttctaagaataccatcaaatccctgtgaattctggttgccaacagtaataaccagtaatgggcacctttaccggacagctcctttaccataaccagtagtgggcagttctgcggtcagcacttaactacaagggcggtctctgtttcttcaccagagagagaagattttcctgtgtaatttgtgccatttccctgaagttggttcttgagcggaaagatgtgcttggtaaccagacagcagctttacataggttatagattttgctcattgatgctgttaagaattatttccactcatacctgttcagggct

SEQ ID NO: 207 - DNA, 1051 bp, Homo sapiens
cctggagatggagggcacacagagtggtcctcaggctcaccttgactgagttgattcacagttatcctgcatcagaccattagatttctttagtgctatgattataatagggatttttgaatcaccaaaaacagtttttagatgtttatgttctttgttttactatcaatgttgtgctggttaagggagagaaaagttcaagaagatcttacatatttgaaaggaaattggtactcttgaaggctatgcaacatgagtctttgaacaagaattccttgctactttgattcattcatcaaatactgagtgcctgtgtgccaggcacaggtgaactctggggattcaggggtaactaaaacagattggaaccctgcccttgtgaagctttcagtctagaagggagacgtgaaacaaattttagcttcaaaagcaacatctatttttgcctgttagcatgcatttattttaaaagtcatattagagttacctggttccacttcagagcagactgggaaaatcaggcttacaatggaatcagatgctgtgggcctaaaacagctctttaaaaatctatttttttaggccaggtgcgttggctcacacctgtaatcccagcactttgggaggccaaggtgggtggatatgaggtcaggaggtcgagaccagcctggccaatatgatgaaaccttacctctactaaaaataaaaaattagccgggcatggtggcacatgcctgtagtcccagctactcgggaaactgaggcagaagaatcgcttgaacccgggaggcggaggttgcagtgagccgggatcacgtcactgtactccagcctgggcaagagtgagacaccgtctcaaaaaaaaaaaaaatttttttttaaatggaatcagagaaaccaacaaaatatgtaacatgtataaatgcctgaggagatcagttattgagaaatccatttacaatgctggaggagaggggatggccaggaaagaagtgcaacaaataaatggaagatgaccctaaaaatgcaccagtgacagtcagtcaatcca

SEQ ID NO: 208 - DNA, 1509 bp, Homo sapiens
atggtgctatctcggctcaccgcgacctctgcctcccaggttcaagcaattctgcctcagcctcccaagtagctgggattacaggcatgcaccaccacacccagctaattttgtgtttttagtagagacggggtttctctgtgttgaggctggtctcgaactcttaacctcaggtgatctgcccacctcggcctcccaaagtgctgggattataggtgtgagccaccgcgaccggccaaaaccatgtaatttttatgtgatatctagctggtttttagtgtgtggaaatatgctttgcagtgagtgaaaagattttttggatataattttaaagtatctcaatattcagattgttctccctacatgtattcctgtctgccaagttgaagattacaagcatctaaaaaaaccatagtggaatggctctataaaatcctaacttaaatttagtgaattcttggatttaattacttatgatttcattttgagtatagaaatgaaatgaactctagcatatttaaagatttgtattatatagtttaaggaactgctccaatccttagaattaaggaagatttgtgggaaaattcaaatgagaaacactatttcttatcctgtgtacctggtgctagatttttagtccagccttaaatgcaagggttgcatgtgcctgtctttgtattagatgctgtttgggtcactagggaacattgccaaatgatatgaagattcttttaattatacattgtattgactttgattgttatattcccattatgttacacataacgtatgtacttttacatataatacatttatagtttctttgattcttaaaattgactaaaagtgattttttttttacacatcatttatttttcctttgatttaaaaactggggcttatgtactcaaaaaacattttgcagtttacaaaactatatttaacatatagcgatttgtcttttaccaatcaaattggtaggtagaagtattttgtctgaaccagtaatttttttaaattacactgtttgcagctgggtgcggtggctcatgcctgtaatcccagcactttgggaggctgaggcgggcgggcggatcatgaggtcaggagtttgagacgagcctggccaacatggtgaaaccctatctctactaaaaatacaaaaaattagcctggcatggtggcaagcacctataatcccagctactcgggaggctgaggcaggagaatcgcttgaacccaggaggtggagggtgcagtgagccaagatcatgccattgcactccagcctgggtgacagagcaagactctgtctcgagaaaaaaaaaaaattatgctgtttgcagtgaaggctcatttgcattcaagattatttaaaagtgtccttggattaaaagataaaagagtaatttattactttattgtgtgaaaaggatgctagaacttttttttttttttttttttgagacggagtttctctctcttgcccaggctggagtgcagtgg

SEQ ID NO: 209 - DNA, 1061 bp, Homo sapiens
gccaccgtgcctggcgtagttaacatcttaaggcatagacttcagtgactgtttttctttttgagacagccttgttctgttacccaggttggaggggagtggtataatcccagctcactgcagcctcaacctcccaggctcatcaagtgaccctctcatctcagcctcccaagtagcttcagaggtgtgtgtgtgtgtgtgtgtgtgtgtgtgtgtgtgtgtgtatgtgtagctaaggtcccactgtagtgtgtgtgtgtgtgtgtgtgtgtgtgtgtgtgtagataaggtcccactgtattgcccaggatggtctcaaactcctggtctcaggatatcctcccgcctcagcctcccgaagtgctgggattacaggtgtgaccattacaggtgtgtgagtctggctattagtgacttttttttttttgagatggagtcttgctctgtctccaggctggagtgcagtggcacaatcttggctcattgcaacctccacctcccggattcaagcgattcccctgcctcagcctcctgagtagctggactacaggcacatgccacgatgcctggctaattttttgtattttagtagagacggggtttcaccatgttggccaggatggtctcgataacctgaccttgtcatccgcctgcctcggcctcccaaagtgccaggattacaggagtgagccactgtgcccggacttttgttttgttttgttttgtttctgagacagtcttactctgtggcccaggctggagagcagtggcacggtcttggctcactgcaatctctgcctcctgggttcaattgattctgccacctcagcctcccaagtagcttggactacagttgcgtgccaccatgtccagctaatttttttaaaaaattgctttttggtagagatggggtttcatcacattggtcaggctgagtgacttttttttttttttttgagacggaatctcactctgtcacctaggctggagtgcagatggtgtggtctcggctcactgcattccacctcccgggttcaagcgattctcccgcctcagcctcc

SEQ ID NO: 210 - DNA, 1010 bp, Homo sapiens
atggtgagaaacagaaactcatatttaggggccccagatggatttaaagttttgggcattctcaatgtttcctattttgggttggaaacggaagtgatttatatcccaatggctggtatcttatggaatcgtagaggatatttcctgcagctgattggatatctgttcctgagatataatgtgatggaagatttcctatggaagcttcatttttggagttacctgtcttctagaattacttattccttctcttggataatgttaagtccttccttggatatatcccttctacctgatggagctatttggcttttgtgttcatactatatggaatatttctggaatattagagcctacagattcttttagaagttgatatctgcctctccattttcactacataaagtgtacaaacaaattggattgtaacaaaaaatctggcagaccataatgattcaaccacttggattctacaaacaatactttaacatggaaatgtgtacttggatgaagaagagagaaggcaatgcctgatttttccattttggatctacacaatttctgtattgttggaattacactctttgatggaatggggaaaaattaaaatgatggatgtttcctaaatcctggaatatagccattcttttctaattgctgggatatatgggatgtcttgctgtcaagattccactagcccagggaaagaggattactatatcatttcttaagcaagttgctgtccaatcaaaggtactttagctttgaacacatggtgatgatcagttgtggatacagcaatcaaaattgactgggctggatggctacaaaagtgaactattggcgagcaactgtgccttcctcattcgttggaattgtagaggatatttcctcttctgccagctacctgattcatacttagggctggaaatatttatgaatgtggataaatttctaattgtctgctatctcaagaaagaagtctgggggtttgagagttacagtttgtc

SEQ ID NO: 211 - DNA, 1059 bp, Homo sapiens
ttttcttgtggttcatctaaatatcatttgacacccttgcccattaagaaggtggattacccccataagaggggccaaaattggggaagttatgttcacaattctctccctagatttaattgggattataggtcgtgtttccacacttggaaaaggttggtatgtcctgacctgtgtatattagcccctctcctaacccaagtcaaactctctttttttccccactaactctagaagtatttagtactaatagtgaatcagagaatagccattagatttcagctctgctagctcttgtgcctgccttctgtatcttcttaatggataagaactttgcatatttataaaatagcagctgtagcagtaatcgtcctagaacttttttgcctgttgcttctgttaaatcattaataatggctttcactgattaacatttgatagggtgctaaagtaattatttatggcattttaagtctcaaaggaaaccctcttatttgttagacattgaaatataaaaatctcagaactgtagtaaataaaagagaaactcatttaatacatttaagtaggaaagatatagaatgtttatcatgccagttgtttttcacaatagcagcaaaaaaagctaaactaagcctaggaaggtggggttgctactaagtgaaatgatgggtgaaaagaatattagtggagagacctggaatctaagcatgtactggggatctggtattaattgttataagattttgccagatattcttcattggagagattctaattctttatgtttcatgattccttaatcccttttgatagaagatagatccagagatgggttgaagagaaactccagtgaaatggtcttttaggaactcaggagctgagttctagttctctacaaaagtagagaacttacgatttctttataggattataactagtttttaatattaacacataattgcatgtgtgtaatcgtacatgcaacgtgttttgtactttttaggttgacaggtattcacatcctactaaatgattgtttaagttaagctattttgc

SEQ ID NO: 212 - DNA, 1030 bp, Homo sapiens
gatagcttgttgagatctctgctttagaaaggcaactggtgacttatccataatctctgtttttcctactcttggtacctcagagaaggaaaatttggaacaggtgggagagacattgtattaagaatcagattatcctgatgtgtaaaaagcagaatgaactttctggtgatatgaaagaacaagactgagtggcctgaatgcatatcacagaacctagtatattgcctttctcagaatacatgtccaataagtagttgaaatacttagatacagttcttagttaacatgaaggataaagcaaaattgatgtagatagctaaaagtttttgtcatttaaattgtgattgaagcaagtgtacagaaataatcctctggtgttcagtttacattattcccttttatcagatgttctcttttcctctttaattatattgaattcaaagtgtaatattttgagatgttatgaaattcagaatgttcagttttccttttggaagaaataagttatttcttgtgatctttacaacttgtgaaactgtgacattcctgaaagtcctttaaagatgtttaaagttagcactcgtatagtggacaaaatatagcttggttttacctatggaaacaagtttgtcttctgtctccatgactgatggggaaattaatcaccctccatccttattaatagttacacttttgatgaagagattgctagtggggtatttcagatgagtaaacatgggattaatggcagtctagttgtgaagtccttataaataacacatctattgtttctgcaaaaccatttacagtattttactggtgagaactgggccttcatggctccatgtgctgctatgtactgctcgacgtctttttgtttctctgtcatggccgtttattgagccacatttcctttcaacagaacattttaaatgcgtaaattccacagaagcatttattttaaaatcccttgattgaagttgaacatactttatttctatagttccctattattggattcccgccc

SEQ ID NO: 213 - DNA, 1055 bp, Homo sapiens
gttcacgccattgtcctgcctcagtctcccgagtagcttgggaccacaagcgcccgccaccacgcccagctaattttttgtatttttagtagagactgggtttcaccatgttagccaggatggtctcgatcttctggtcttgatctcctgacctcatgatctgcctgcctcagcctcccaaagtgctgggattacaggcgtgagccactgtgcctggccgaaaaaaatttttaatgttgctaaaaatcagaaagtcaagcctggtctgatggtatgttcctgtagcttctctggaagttgatgtgggaggcctggtgtttgagacatagcaagacctcatctcttaaaaaaaaaaaaacaagtccttcaggtacggtggctcacacctgtaatcccagcagtttgggaggctgaggcgggtggatcacttgaggtcaggagttcgagaccaacctggccaacatggtgaaaccagtctctacgaaaaaaatacaaaaattaactgggcatggtggtatggtggacgcctataatcccagctgctcgggaggcggaggcaggagaatcgcttgagccctggaggcagaggttgcagtgagccaagattgcaccactgcactccagcttgggtgaccgagggacactccgtctcaataaaaaccccaaaattaaaaataataacaagtaattacgcagattaaagttttaaataacaaattttattttattttatttatttgtctttttttttgagacggggtctcactctgtcacccaggctggagtgcagtggtgctgtctcagctcactgcaacctccacctcctgggttcaagcgattctcttgtctcagcctcctgaaaacaacaaatttaaaaataaaaactgccatgtcaaattgtatttgtttgacttggaagcaaactatgtaaactcttttttttttttaattttattattttttttgaggcaagagtcttgctctgttgcccaggcggaagtgcagtagcatgatctcggttcactgcagcctccacctcccaggttcaagtggtt

SEQ ID NO: 214 - DNA, 1117 bp, Homo sapiens
agctaaatttttttttttttttttgagatggagtctggctctgtcgcccaggctggagtgtaatggcaccatctcggctcagtgcaaggtccgcctcctgggttcacgccattctcctgcctcagcctcccgagtagctgggactacaggcacccgccaccacgcccggctaatttttgtatttttggtagagatggggtttcaccatgttagccaggatggtcttgatctcctgacctcgtgatctgcccacctcagcctcccaaagtgctgggattacaggcttgagccaccgcgcccggccttgttttttgttttttgtttttaagcgatagggtctcgctatgttgcccaggctggtctaggtctcatgacctcaagtgatcctcctgccttggactcccaaagcactgggattacatgcatgagccgctgtacctgggctaatataaaaaccattaagaaaaactaatgtcatggtgtcatgttaataaattcacatatatctcagtagaactgtttaaaaatatacacatcaagttctggagacctggtttttttaaaaaaaaaaaacttatttatgttggctacatgttcaaatgatattttgaatatattaggttaaataaagcatattactacattaattacatctgtttctttttactttttttttttttttttttttttttggagatggagtctcgctctgtcgcccaggctggagtgcagtggcgtaatcttggctcactgtaagctccgcctccccggttcacgtcattctcctgcctcagcctcccgagtagctgggactataggcaccttccaccatgcctggctaattttctttttgtatttttagtagagatggggtttcaccttgttagccagggtggtctcgatctcctgacctcgtgatccgcccacctctgcctctcagagtgctgggattacaggcgtgagccactgctcccagctcttcgttttactttttaaaatatgactatttgaaaattaaaattttgtggcttatatttctactggacagtgctcttctagaagcaagctctattaagctgtaatgtcacaaaataatttgtgtatcaatttagtgctt

SEQ ID NO: 215 - DNA, 1038 bp, Homo sapiens
tagaggtttaaaatatgtctgtttacatactggtgctaatagactggaattcagttgttggaattagaagacagaaataatacacatctgtgttgcttctaggcatcatttgtataacccaaactggaggagttctgtgattctttatatgttattttcgatggtggtagggaggggcagattagcttcctgaatatgctgtgtcatggtgtgtggagccatcttggactgtagctttgtatctgtcactggaagaaactgcagagaagtaattatatttaagcagaagaattttagcctgaggtttcttactgagtaattcgtagtcatttataaataaacaaaaaagtataccaaatagcggatggcttaggctttctggtagggagttaggtgcctttctaactccttgtccctgcaactgccctaatggagagttcagaagcaggaaagagcaaacttctttttcattctggatagagaggagatgtcattagtatcaaagttaaattgaaaaaaggccagtacactcaagcctgggcaacagagcgagaccctgtctcttaaaaaaaaacaaaaaaaagcaagccaattgcagtggctcccgccgtaatcccagcactttgggggaggctaaggcttgaggatcacttgaggccaggagtttgagatcagccttggtcaacatggcaaaaccctgtctctactaaaaatacaaaaattagccgggtgtggtggcgtgtgcctgtaatcctagctacttgtggctgaagcttaagaatcacttgaacccaggaaatggaggttgcaatgagccaagattgcactactgcactccagcctgggcgacagaaaaggcaaaaacctcaaacttcaaatttgcttatgggtttggtaaggctacatcagttgtatgtgaccacttggaattaaaacacacacacactcacttgatctgtgtgctttcttggcctgtgccttctgaaacattttagttttttcatacaagaaatatcagattctatataccgtgtgact

SEQ ID NO: 216 - DNA, 1080 bp, Homo sapiens
tttgtttgatgtttataaatattcagaggtgaagtctagatggatagtaggagagctttaagaagttaatttctgaggtccagattttgtactaagtaatctttaggaagtgttattagttgtttatatcagcaataaagggtcattgtaatcagaggaaaaattactagcttgggcaacatagtgagatcctgtctctacaagtaattttaagtgttagcctggtgtggtggcgcatgcctgttgtcctagctacttaggaggctgaggtgggaggattgcttgagcccaggaggttgaggctgcagtgagccatgagtgcacctctgcactccagcctggatgacagagcgagaccttgtcgtgaaagaaaagaaacattagtgttggtggttggttatggttctctttccacctccagctttgtctagtaagagaaagctttcttcctttgtcagtttcactctactaattcagttaatcattatcatatcagctcttttcccgttagaaatctttgtagtttctgatgaccggagaaatctgatagaccaaacaaagttgaaattaaaatattggttacataataaaaactttgttttttggagatggagtctcgctttgtcgcccaggctggagtgcagtggttcaatctcggctcactgcaacctccacttctgggttcaagcgattctcctgtctcagccacccgagtagctgggactacaggcgtacgccatcatgcctggctaatttttctttcttttttttttttttgagacggagtttcgctcttgttgcccagggtggagtgcagtggcgtagtctcggctaaccgcaacctccgccttctgggttcaagcgattctcctgcttgtaatcctgagtagctgggattataggcaccagccaccacacccagctaatattgtatttttagtagaggcggagtttctccaagttggtcaggctggtcttcaaacttccaacctcaggtgatccccccgcctcggcctctcaaagtgctgggattacaggcgtgggccaccacgcctggcctaatttttgtattttttagta

SEQ ID NO: 217 - DNA, 1006 bp, Homo sapiens
tcagtaatgcacaagggttccaatttcttcacatccttgcatttgttattttgtttgcttgtttttttgagacaggatctcactttgtcatctaggctgcagtgtagtggtgcgattttggcccactgcaaccttgacttcccaggttcaagccatcttcctgactcagcacccccgccaagtagctgggactacaggcacataccaccatgcctggctaatcgtttttggtaattttttgtagagacggggtttcgccatgttggccaggctggtcttgaactcctgagctcaagtgatctgcctgcctcgcccttccaaagtgctaggattacaggcgtgagccactgcgctcggcagtttgtttttaataatagccatcctagtgggtgtgaagtgatgtatcatgtggcagagttttttttttttttttttttttttttaagatcctgtgttgtttatgctgaactcgaactcctgggctcatgctgtccttctgcctcaggctcccaagtagtgtcaactacaagtatgagcccagtttcacatggttatgatttgcgtttccctaattattagatgttgcgcattttttcttgtgcttatttgccatttatatatctttggagaaatgtctttgaagtctttgaccagttttgaatcaggttgctttttgttgttgagttgtagtgtggtttctatggttgttgttttatttttttattttatttatttatttatttttgagagagagtgtcactgtcacccaggctggagtgtaatggcgctatctcggctcactgcaacctctgcctcccaggttcaagcagttctcctgcctcagcctcctgagtagctgggactacagctgcatgccaccatgcctggctaatttttgtattgttagtagagactgggtttcagcatattggtcagggtggtcttgaactcctgacctcaggcggtccaccgtcctcggcctaccaaagtgctgggattacaggca

SEQ ID NO: 218 - DNA, 1067 bp, Homo sapiens
tacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccaggtaagacacaagcaagctgagtttgagttactcatcacacacactgtttgtgttgcagtgtatgagagggcagcatatgatcctgaatgaggacactattctggctttatttattgacatatttccattgtcttctgttttaaaagatggttctatttattgttcaacttaataaaaaacattgttttggttagggaggatagatttttctgttgctgtaatggagccttgctgactgttaagagtctgaaaggcagaactgtgtagacccttattgagtccagccttcccaaaaggattgaatttatcaaaactaggaggtagctcctaggagtgtgacaacagaattaccttgaattggaaaggaaactacttctggttgggcgcagtggctcatgcctgtaatcccagcactttgggaggctgaggtgggtggatcatctgaggtcaggagttcaagaccagcctggccaacatggtgaaaccctgtttctactagaaatacaaaaattagctgggcgtggtggcgcacgcctgtaatcccagctacttgggaggctgaggcgggagaatcgtgtgaacccgggaggtcaaggttgtagtgagctgagattgcaccactgcactccagcctgggcaacagagcaagactgcatctcaataaataaataaaaagaaaaaagaaacaaattacttaatattgatgtgggggacttgttagaccagttttatttctattatgtccaatacaagttgggtctgtttttccagcttgcatgaccttgaagacagagtaacaggaataagccttatgggtgcaacccactgagaatttccagggaacatttattatcttgaacctacctg

SEQ ID NO: 219 - DNA, 1027 bp, Homo sapiens
tgtggattgaaaggaaaatctggaagagaaaaatgtttgtaaaaatgaagcagcaggctgagcatggtggctcacacctataatctcagcactttgggagggtgaggtgggcagatcactttgagctcagaagtttaagcccagcctgggcaacatggtgaaaccctgtctctataaaaatacaaaaattagctgggcgttggtggcttgctccagtagtcccagctactcaggcggctgaggctggagaaccacttgagcccaggaagcagaggctgcggtgagccgagatcacgccactgtactccagcgtgggtgacagagtgagaccctgtctccaaaaatagaagcagcaaattagtgtatgattgttttgtgatcacagtgcacatcagaaataccttggggattactagaatatggatgtcgtctgctagcagtttaattctattaggaagtcttaatttgaatcactttttatattatgcaagtcattgttagattaaggggtacaagaagttttctgttcctttatgacttaaaattagagtcagtttaaaaatgaaaatattttggtcacagctttgtaatcttgggatatactattattatttttttagacagagtttcactcttgtcacccaggctggagtgcagtggtgcgatcttggctcactgcagcctccgcctcctgggttcaagcgattctcctgcctcagtctcctgagtagctgggattacaggcgcccgccaccatgcccagctaattttgtattttttagtagaggcggggtttcaccgtgttggccaggctggtcttaaactcctgacctcaggtgatctacctgccgtggcctcctaaagtggtgggattacatgtgtgagccaccatgcccaggctgggagataacattttgtaagatatcagcctttctcatctcctcaaaatctttcatagaatcgtaacttctgtagaaatctgcacatgccttctttcttggttcagccacagcaaacttatagagaa

SEQ ID NO: 220 - DNA, 1006 bp, Homo sapiens
ttcacatttacactaaatatgtaattagacttttttaaatgaggggaagttcacacaacagaatattcatctaaccaatgatttttatgtaatacatccataagcaacaggaaaagggtctccagacccaattcagtgtgtgaaggtaaagctttggttccttaaaactatgtttactctgtggtaggtatattgtatacccttgacaatgcttttttttttttaaatttatttatttatttttaattgagacagagtctcactctgtcacccaggctggagtgcagcggcgggatctcagctcactgcaacctccgcctcccaggttcaagcgattctctagcctcagcctcttgaatagctgggattacaggtgtgtgccaccacgcctggctagttttgtatttttagtacagatggggttttgccatgttggccaggctggtctcaaactcctgacctcaagtgatccacctgcctcggcctcctaaagtgctgagattacaggcactgcgcctggcagacaatactttaaatgtagcttttgttgtttagagaaatacacatcttaaagattgcctgtataaaaaaatccacagccttaagacagttatgctacttgtagccaaagttcacagaaattctttgttgttcttaatttttccttcctttcaagggtgttttttgctgttgttggttttgcttttttgttttgagccaaaacaagacgaatactttactgaaatacaatatagtggtcagtaaacatggaaaacaaagtaaaatacagaagaacaaaataaaggcataatatctcaagccataatgtctatgattctaaacagtccctgcacattttcattttattgtgttcactacagtgtgcatcacacttttttttttaatagaataaaatatataaaaatatattttttctcatccgtgtccttgtggcttaggattttgttgggactgacactaagtccagtggatgaggctcttactt

SEQ ID NO: 221 - DNA, 1088 bp, Homo sapiens
tctgacacccagggcctcatagtatcagtccagcatcctgaatgatatgtctttctttcctttcctactctcctgaagagtgggtagccacttaaagcataactttatgtccagtgtatgtttttaaaaacttgtattcatggtagtttgaaggaatttatgcacttaactatgaaataactatgattgttaggttgaaaaaagtattttaaaaataagatgataagctatttgatagctgatgagcatcatatgctttagtaactttgaggcccagctgtgaataaagtttaaaatgttcatccatattttgttttatattctaactgtagttttggcaacagagattgctggatttagttgatctgattacttaattgccatttcagttttccattttgcttttttcactccttcacaattgggtttgaaactttataaatttcattcttttatcacggtttatacagaatttgagagatttcaggttaatatagtttcagtgatgaggactgttttacttgagatacattgctgtttcctgaaattttctcagaagggctatgttgtgaagaatttacaaatctgataacatttttccatcattaaaatttgaaacttgcatcaaacacctctttttttttttaaaggtggattttgcaaatcgggaaagtcagctggctttttatcactgcatggagaaatctggtcaagacatcagagacttttatgaaatgttagccgaaagaaggtatgtattttaaacttaccagtgtagcttgagttttaatagttttaatacagaaacttaagatggcattaaattttatttttcactctttacccctactttcatcttctagaatagagaatgcttctcttttatcacttcatatggaaacacaggtttatttttttgaatctagtttccaggtaattcctatgggtttggagcaacctgtctggatttctcactgaatgctcctagaacttgaaagagttactgttttgccaggtgataactttatgtacttttttttttgagacagggtctcactctgtcacccagactggagtgcagtggcatg

SEQ ID NO: 222 - DNA, 2002 bp, Homo sapiens
aggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatcc

SEQ ID NO: 223 - DNA, 1208 bp, Homo sapiens
gtttgtcccaacaacctctggccccagcaccccaccaggactggttctgccacacactgaattccagccagcccccaaacaagattcctctccacacctgacttcccagagacccgtggatatggttcaacttctgaaggtaagcatgagcaggggctgcccttcctggcccccaagttttatgccatgtcaaatgtcctaagattccctagttaacagacccacaagctacagcctctggctgtgtccagcatggctcagcgaggggccatgagctcacttcctgtttgtttccctgtgagcagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtaagactctcaggcccaggtgagcaactgccccacctacagggaggaagacgtaggtagtccctgccagcccatctccctggcctgtcatggaagcattaactgtattcttgttgttgttgaaacagtctctgtcgcctgggctggagtgcagcggtgcgatctctgttcattatagcctctgcctcccgggttcaagccattctcttgcctcagcctcctgagtagctgggattataggcacgcaccaccatggcaccaccatgcccagctaattttttgtatttttagtagagatggggtttcaccatgttggccaggccagccttgaactcctgacctcaagtgatctggctgccttggcctcccaaagtgctgggattacaggcctgagccactgtgcctggccagtaacggtattcttgaagtgagcaatgaagggtccactatgcttctacttggtggggggatgtaaagtacctctagacccagaaacaaggctttacagtttttaaaaattattattttttaaatcagctttctcaggttgaaaaaaagctttttttttttttttttttcattcaaatatcagggtagcctttaaagtcatctcagaggtgggggtttttgtggacctgatactgtgggttggatgtgggctgctgtttgactaggaggcccctgctcactggcagctggcctctgcct

SEQ ID NO: 224 - DNA, 1019 bp, Homo sapiens
gatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctctt

SEQ ID NO: 225 - DNA, 1028 bp, Homo sapiens
gtttcatcagccagtgttgcagaactcggcccctctcaggctctgcacgtaccccatcccccgacaaagcctagctctccctctctttctgattcatgggaactacctagagttgcggagtcttctgactccagaaacctgtgtcctggtggccatcccaggagaaacaactttgatcctgaccccaagagctgctgacctggccacaacttctctgtcaagggcctcacttaatgcctggaaatcccacaagtgaaaatgctcaggaaaattccatggcccagtgccgagcagtcttgaaccgcacaagccgtgactaagtaactatctaaaacagctctccctcccgccccaacaccacccagagtgggcgtcaacatcagcaattgtctagggaaaataagcgggccctcttttctagaaagaacccatttcagaatgtttgaagagaaaaatcaacacccactgtctggggccacattagacagattcaactgggcacggctgtcacgccctggcccaggatctgctaaggggtagtgagttctctgcctactcctcctcttctctgaggcctgagtctgcacggggctggctccccggcttctgggcaggtgagagggacactttggggctctccgcccccagtttcggcagctctgccccggctcaggcactcccctgtgacatcagcatcttggggggtgaatcactgccgcagctctgaagctgctgtggccatgcatggctgtcgggctgtgatgagtccggaggaagccacgcccctcacaccagcacaggtcggccttgaagggcgccaaggcctcccaccacgtgatgtctggaaacttttcacaagtgggggtatctgctgagcggggggaagtgacgcaacaaataacggggagcatggcagtggcaacaggcatgagccacagcgcaccagcctccgagccacaagttcagcgttgctgctgctgccagaggcccagaaacagctgttccctccccctacacatccccgcgca

SEQ ID NO: 226 - DNA, 1029 bp, Homo sapiens
gcagtgtgagtccggacaggcacactgacacagcggaacagacgcggcagaaccgacacggcggaacggacgcggatgatgcagagcccctctcaggatggccagccattcctcccctgccagggcccaccacgcctcccatggagagacggtgtctgtttccctcctgtcggaatctggatggcccagagacgactctgacatcaggatgctgggactgtgccaattccagacctaaacctaaagaagcctggaagattctgctgtggctcctgggaatccagtcaccgagctggaggaaagtccaagctcccgtgtgagtgggagacacatggaggggctctggggagagggcacatggagaagagcagagaggccactgacagcaccaatgctctgtggcgagggacacactttcctggacctcccagcccagctgtgcgctgctgcacgcacggcctcaaccaacacctcggggagcaagcgactgcctgtccacccatccaactaagaaagactgactcaccgatgacttatgccactgggttttggggtgctgtgctgtgcagcaggagataactgagacggacggtaaaaccaggaagaaaaggaagtgattcagccaaaggttcaggatgacggttctctctggatgggggagggtaagcaggggacttctgagatcctagaagagttctctttctttacttggagtcccctggatttattacttaaactaaatgtgtatatttcatatacatttacatgaaaacattccaattatttaaaaaaatgtatttttttttttttgtagaagcaggatttcaccatgttgcccaggctggtctcaaactcctgggctcaagcaatctgcctaccttggccttctaaagtgctgggattacaggcgtgtgctactgcacccagccatttttcaaaaattttaataagaaaaaagtgaggttcagttgccagacttgatccagtcatggcacagagtgtgctggccaaggctgggttgctcccaac

SEQ ID NO: 227 - DNA, 1014 bp, Homo sapiens
gggaggggcactgagtggagagacatctagagctattgtctctgccaggaggcactttatattgaacaactgttctgttaaaccccaagagtgctcccagacaaaggctggagtgcatgcccagagtgctaagtggccccagagagcacagctccatgtcagagtcaaatgggcacctgtcaaacatgaaatgttacccaggttattagtatgcactaaactacctgcagggtttccaaactgccacaaagggaagccattaagccaggaagcaactggcctaccatagggagacactgatctttacaaacaacagtccccggctcccagaacaagctgctcccagctctgagccttgacatgagccatcttgtgtccaggtgcttgaggaacctaagggcaggtgagaaggatcaccatttggcttccagttgctcagcattcttgattttctagaaatacaggtggatcaacataaacttccaaaggagccaggcacggtggctcacacctgtaatcccagcactttaggaggccgaggcaggactgtgggaggtctgagacaagcctaggcaacatggtgaaaccctgtctctacaaaagaaattttaaaattacctgagtgtggtggcacacacctgtggttccagccactcgggaggctgagacaggaggacagattaagccaggaggtcgaggctgcagttagctgtgattgtgccactgcactccagcctgggcaatggagcaagaccctatctcaaaaaaacaaataaaaaacttctggccaggtgcggtggctcacgcctataatcccagcactttgggaggccgaggctggcggatcacttgaggtcaggagtttgaggccagcctggccaacatggcaaagcccatttctactaaaaatacaaaaattagctgggtgtggtggtgcgcacctgtagtcccggctactcgggaggctgaggcaggagaatcacttgaacccgggaggcggaggtaacagtgagc

SEQ ID NO: 228 - DNA, 1017 bp, Homo sapiens
agcccccttccaacatccccgactccctgagggcgcccctcattctgctcggccttgccttccccattcggccacatcctcctctctcccaactcagcttcgacccccaaagcctttccctaaccatcggaaccacaggcttttctccggcctctgagtgccagtcttcaactaggtgtcttttaaaaaatcaaaaagcatctcatcctacgggatgtgtgtgaaaaaataaaaataaaataaagaaaaagggggccgggcgcgggagctcacgcctgtaatcccagcactttgggaggcctaggcgggcggatcacctgcagtcaggagttcgagaccagcttgaccaaactagagaaactccgtctctactgaaaatacgaaattagccgcgcatggtggcgcatgtctgtaatcctagctactctggaggctgaggcaggggaatctcttgaacctgggaggtggaggttgcagtgagccgagatagcgtcattgcactcttgcctgggcaataacaagagcgaagctccatctccaaaaaaaaaaaaagaagaaagaaaaaaagaaaaagatagcccatcgctcctccattgcagacccaaaggctgtcagctgaatggaaggtgcttcctcacgacctttgggataagtaaatttgaagtaatagaaatagccagctgggcgcggtggctcatgcctgtaatcccagcactttgggaggctgaggggggcagatcacctgaagttaggagctcgagaccagtctggccaacatggtgaaaccccgtctctactaaaaataattagccaggcgaggtggcgtgcacctgtaatcccagctactcaaggaggctgaggcaggagaatagcttgaacccgggaggcagagtttgcagtgagctgagatcgcgccattgcactccagtgagccgagatcgcaccattgcactccagcctgggcaacaagagcgaaactccatctcaaaaaaaaaattttttttgaaaaataggcca

SEQ ID NO: 229 - DNA, 1072 bp, Homo sapiens
gtccattgagtaaagccttgcgtgcctgcgcccgcgacggaggcgcgcttcaaagcgcaggcgcggggagggggtgggggaggagggaaagcggcgagtaagatggaagatgaggaggtcgctgagagctgggaagaggcggcagacagcggggtaaggaggagccgccgtcccatggcagggccgggcgagacctggcgtgaggggagcctccggggagcgggtctggagatagttctccccaaggaagggccccatacgccgggctgggggtggtggagaggcccccagttcctgagcgccgtgaaggcctcttaaaggggccgcgatccatttctctcctttcctttgcctggtgcgcctccctccgcccactaacgcgcgcgtcacccggggcgccccacccgccacccggggcctcctttcctgaccccccgcgcccacttgctggccgtgggcctctgtgactctttccgatgagccttgtggcccgaggcaccattttaaagttcttgtgctctgaccgggacggacacaccatgtgggtggtggtggggcttgcgcggaccaaggaggcatgtccggcttcgcaggaaagcgggaggaggcagccgagggcggggggaaattgaatcctctttgggctactcaactctgctaaaatcccccaccatccgtcacggtggacgagtcgggttttttttctctttcacttttactccaagaagagtttgtgggcaggcaggcaggtctcacggggactctgccaaagcaaccgaaagctctgcggggcagctcctctgccactcagcgatccgaggccccgggaaggtctaggagttcgcttgtcggagtccagggtgtgatatgtaaaacagccacattcttgggagaggagtggggagatggaccgttcgacttgtttttggagtttttgtttgcctccagaaactgtaggaaaatagtttatctcaaagaggatctgtcaattctcttagatttgtgaataatttggtcttttcagagtttgtctgtggtgacccttgtgaatatggggagatgctttttttgt

SEQ ID NO: 230 - DNA, 1090 bp, Homo sapiens
cacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggtgagtgtggctggcagggccggccagtgatggctgtcccagtccacccgggaagaggagagcatcctggctgcgtgtagagtagtgagaagcaagcagagtcagggtaggaaccatgcagctccacttgctgatcccagcctgctggcactagttcactgtgccgcattggctggagagggctctgaaagccttgccagggaggaggtggcagtttgctggcatgctccctctgcggttggtagtcaccgggggcactgttgtgtagagagtgaaggcacagatgagcttgtgtcaaaatctgcctcttacctcttctttagaacgacttgacctctctgggccttagttttctcatctgaaaaaatgggataataatagtaccaaccttatcaaggtgttgtgcaattcagtgagtaaatgagcataggatgtggagagcctgggctggcagagtggaaagtaccccagataagtgctttgatgatattttctgggtctccagtatgcccactgtgatgtttttgtgaattttctaaattcctttttactcttaacatttttttctctgcagtattaaaggttgcatcatataagtttatcactttcgaatcaaacagtattcattaagatggcctccttctaactttgaggggctgctatggtttggtattctgggacttgaagaaaaaatctgcgtaccttctttctagctcttcataattttgaagagatacctgttctttttgttgtttctcctctaagtcttcacctttccagggtggaaaaatagtcatatgagtcaaccgttaaccgcagagtttggagaggagtgggagggaagaattggggggcgggggatgtgtccctctgctgagctcttgattccagttctttactttggcc

SEQ ID NO: 231 - DNA, 1076 bp, Homo sapiens
tcatcatatttgaagttagtctctttgtagccagtatgtagttggttcgtgtccattgacctactctgccagcctgtgtcttgcaactggtatacttaggccattgatatttaatgatattgacatggtagggcttaaatctgccattttatttttccttttctgtttgttctccctggtttcgttttctggatatgctttctttttcttaccttcctgtcatgacttgaacatctttgagaatggtgttttgccttatccatagtgcttttgagtatgtctgtttgtatagccctcttggtttttccagacattcgtatatctgtgcatctatatcttaaccacacggtatactggtgtcattgttttaccaatttgagtgaatgatagacgagttacctcccttgtaggtctctttaccctcccagtttataaccatttcaaacattttctttatggagagttagaaccacattgaatggtgctatgatttttttctgaaaccgtcaagcatagtttagaaaactcaagaggagaaggaaggcctattttgctgttttctttctttccgatgtcccaaggttccttctttaatcatttcctttccgtctagagaactccccttagcccttcttttagggtagaactgctggtcagagatgtccttagcttttcttaatctgaaactgttttgatcttctccttaatccctgaaagatgtttctgctggagagaggagtctgggctgacaattttcttctgcggcttgaaaagcactgcacaacttctttctgcctccgtggtttctgatgagaaagccatcatcgtcggaattgtttttcctttctaggtaaggtgtcacctttctctgttgctttcaatatattttctttgtctttagtttccaacattttattttttcacgtgtcttgccatagacctctttgggttttatcctatttggggtcctcacagcttcttaagcatataggtttatgtctcttgccaactctgggaagcttttagccatttacttctttatgttttcaggcttgtcctcttcctcttccccttcc

SEQ ID NO: 232 - DNA, 1063 bp, Homo sapiens
tccagccagaaggatggggtggctcccactcctgctgcttctgactcaatgcttaggggtccctggtgagtgcccccaaccttgatccccatctgccttcaggaggggcttggccccattctcctattctgggatgagaaaaaagtcagggagccagaggctcagtgggcatggggcagtgaccttggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgcctttgtgcaggtgagagcccagctttggagtctgaatgcctagccagggcccctggctgggtaatgtgatggctctgagccttagcattctcatttgagagatgagatggggcaagctccatcacccactgctctcacagagcgtgtgtgttagatctgagcccggtgcctgggccactacacagaggcaccggtgataactaccaagtctgggcctgcttcccaggggaaattttttgacaagtatctgtgcaggggggctagactggcccttgaaagtgcatacagggtccatcccagaagccttgtagctttgatcccctgaatgaacaaactgtggacatgccaatacacattactgacatgtatgcccacctgacctgcacccactctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccggtgagtggccactgggcatagataagactgggggcaggggagcctgggccgtggcgttaccttgtgccttcttctctccagggcgttccactacaatgtgagcagccatggttgccaactgctgccatggactcaacactcaccccacacgaggctgcggc

SEQ ID NO: 233 - DNA, 1003 bp, Homo sapiens
aaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggtacttcttcatttcattatggccttttacccgtcttttacgctgcaaaattatactgcataacctaatagtgcatttaggggcttggccaccacaaggtaaagtgacaacattactcacgagagtagcggcaagagacattcaggacactaacccaggacccatgcaattgttggactcaaacagcttagcaaagtggcaagcacgaagtctttccggtgagtcactgcagttttgatattggtacctgttactttcatctattcacggggcggatccctgcaaacccgaagaatcatcaggttcctgattcgcgtgctggaccttgggcttactgctgagccactgtagagaggatcaagaaatgacgctcttggaaggagagaagctgcgggcaggacagtcacgtcagaggtccaagaggcttcagcggcccaaagaaagggaaggtgtgtg

SEQ ID NO: 234 - DNA, 1035 bp, Homo sapiens
catgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggac

SEQ ID NO: 235 - DNA, 1063 bp, Homo sapiens
attcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttgg

SEQ ID NO: 236 - DNA, 1027 bp, Homo sapiens
aggtgcagtagctcatgcctgtaatcctagcactttgggaggtcgaggcaggtggatcccttgagcacaggagtttgagaccagcctgggcaacatggtgaaaccccgtctctatgaaaaatacttagctgggcatggtggtgtgggcctgtagtcccagctactcgggaggctgaggtgggaagatcactggagcccggtaggtcgaggctgcaatgagctgtgatcatgccactgcactctagcaaggcagagtgagaccctgtaaaaaagaaaagaaaaaaaaaagaagaagaagaagaaaagaaagagagcttgggctttgggctgtcatctgcctggttttcattttcctaatctgtaaaaggaggagcagtgattacgtcacagggtgacacacacaggctcttatcacaggtggtactcagggggcctctgttttatgtctctgtagttctggggtttttatgtgtgtttgggggacagctatgtgtgccagtgtgtatgtgcgtctgtcgggcaggaaactcaggccctggtggtgacagtgcagccaaagctcccctctgccctccccagcctgtccctctattactgcttccccccaccacccccgcccccaaggcctctggcctggggccgagcttagctggattgttgtgtctgcggcttcaaccctggccatgggcccagccgcaggggctgcaggaggaggccaggaacaaagctgggcaggagccagagtgggggccccagacagggcagggctggggctctgggcagggtggcagaggggccaggctcaggataggggctggggaggctctaataacaccccctgttgatccaccctgtctctaggatagtaccagggatgggaggacccctagtctgccttcctgtcccatccccactccccaggcctttttcactggctgaccctgggcaggggagggggaatcaccacctgaaaccctagaacagcagggccccctcagaactgtccggctcagctcagtttgcacga

SEQ ID NO: 237 - DNA, 1050 bp, Homo sapiens
ctagtcccatccccaaaggtgaagttctttcctttctcatatttgttatgccttgtcctggcaagggccccagaatgcttgtgcgtgtggaccatgctggccaggaatccttagcttgttctggttttgggggtctcctccccgaccacccacatggtgcagcctctgggaagggacccttggaggttcactgagaaactggggcctgtagcagcccctgcaggggtggcgggtgccattctctggagtggggcttcttatctttaaaacaggctgggggcccggcgcggtggctcatgcctgtaatcccagtactttgggagtactaggcggatccgaggcaggtgggtcacctgaggtcaggagttcaagaccagcctggccaacatgatgaaaccctgtctcaactaaaaatacaaaaaaaagtagatgggcgtggtggcacacggggacctacccctccctgccctgctgctctttggagagagaagaggtggggcacaaaggtgcttggagctctgtggaccagaaacgcaccaggtggccttctggtgcacttgaactcctctgccggcaatgtaggttgctgcttgggggtgctgggaggggtcctttcctctcttccctgcttctgcatctgcttctgccttttcctccccatctcctgcccctcaccatggattcagcttctttcctttgcattcaggttgctggccttactctcatttgcaagctgagaggcattaggagagcaggaagctcagataagggtgagataattgcctcttactggtttttatggctcttttatgacccggaggcccctgaaggagtgtttgttcacagggagaattagacacggcagccctgcgtggcttccatggacagcggctgggagaggctgctccgggtgggtacagggtgggtccagggccttggcaggcatcagggagggtcacgggtacaggaggggcccccagcctcatttcttgccgtgccctctttgcatgcgtgtcttgagctggaacgttgctcgtgtccctgctcccc

SEQ ID NO: 238 - DNA, 1048 bp, Homo sapiens
cctcttccctcaggcctgaactttcccaatcagtaacccagtggagcctggggccctgccagaccagttcctcctgacccctcatatctgagagtggctccctgagctccaagctgagccagagccagccccagccaccatgctggggaccagagcgtggggggcagctgcagatccaccccacgttgtgcctttgcagaagcgcaacacagcaggattcttaagttctttattagagatatttttaaaaggcttttaagtatttttttcttcccccacaccagcaaatgaaataattgcataattagtaataaatttgttcctacactaagtgtggatttttttagtgtgtgttaacaatttattgcacttccttcccctgacccctttcttccactcgcatactcgactggtattaatgcattttttaacctaaactccctcctccttttaaccagacaggtcattaataaaatgttctccaagagcctgagctttttaaagttgtatatctccagatagatggcttgggtgagttgaacactgccgcattaagtctctgtgataaaatatttattcaccattagaattttttttttctttcggactgtttgtgaagtgtcttgctcttttccttgaggtggagggggagggggaaggccccagaatgaggtctgcagatgaagccatttctcaattccggcatctctttcggtttcttgcttgccttcctcccatttgtcggttttgccgtccagtgggggctgggaggatgcaggggcagcaggaaatggtctcctgccggtctccatgccctgggggtcttggagagggaggcgatgaggcttgtggaatgaaaaattcaccactgtcccctctcttggcttaattgttcttgtgggtttatggctctgatggagctgatcttaagacattagcgtccagatccttttaataatcataaacattatcctaatagcctctatttattgattgtatactatgggctaagagctgtgctcaattgtgtatatatattatatgtata

SEQ ID NO: 239 - DNA, 1021 bp, Homo sapiens
gctggcctaaataagactgggaaggaactgtgaagacggtttcaaattcctaaagccctgaaattctccccctaagtttaggaagagcttttgttcttggtgtgtaacactgataaatgaattggtacctagtgattaatctgcacttttattaagatatgacctactttaccttttttgagacaggatcttgctctgtcgcccaatagcccaggctggagtgcagtggcagagttgcagctggctgcagcctccacctccctggctcaagtgatcttccagcctcagcctccccagtagctgagactatacaggtgcaggccaccactcttaattttttttgtttgtttttaagagacaggtctccctacgtagcccaagctgttttcgaagtcctaggttcctcccaccttggactcccaaagtgctgggattacaggcttgacccactgcgcccagcctgcatctttacattcgaaataaaattcagtcaagtcaaagccggtcttggaggaaaatgtggctttgatgacagcagtagggattttccttcagtgcctacttaccagaggataataataacagcaagtttcttaaacataaaaacatcagaaatgaaaaagaactttccataacactataaatattgcagtatttcaagatactgaaccagagccctaaggaaaggctggagacccagaattttataatggctttgggacatgaattttattttaaccagaggacaaaattaatctgcaaaagctgtcttggagaaatttcaggaaataaaagatcaaatgtatctgctgtcctcccttccctctccaggagaataaaaggcaaatgcaaactatcacagggagattttcacctttacctaaattatttattatatactttatatttctggttaatagattgggagagagcactccagataaagaacttcctttataaatgccacatttatttcagtactggaggtttggtcttgtgttgccacaaagatttggaatgg

SEQ ID NO: 240 - DNA, 1067 bp, Homo sapiens
ttggcctctaggctaaaagccaaggataggacagcattgggggtgagagccaggggctgagtgtggaagagcagttcaggcagaggaagcagcagatgtacagagaaggggcagctgcgtttatatagtggacagagtgtgtgggggtcagggaagggagaggtgaggtcacaggagtcatcaaaggccctgtggcctaagcggcatgctctgctcttaagaaatgtgctctttatcctaagggataaagacaagggtttgatcaggggcttgacattgttttaacagctttattgggagagaattcgcatttcatgcaattaacccattcagtgtacagtcattggttttagtatagccagagttgtgtaactgtcaccacaactaattttaggacattttcgttagcccaaatggaaacccatgcccatcagcagtcattcttcatttctcccggaacctctcagtccctgccagccactagtctactttctgtctctgttgatttgccttttctggacatttcatgattcatataaatggaatcacacaggacctgttgtgattggcttctttcacttaacataatgtcttcaagattcatccatgtcatagcatgtatcagatcagtacttcagtcctttttgtggccgaatactgttttactctgtgtatagcacatttggttatccattcatccattgatggacattgggttgtttctactttgtagccattatgattaatgttgctgtgcacattcatgttttttttttttttttgcctggtgcagtggctcacacctgtaatgctagcactttgggaggctaaggcgggcagatcgcctgagggcaggagttcaagaccggcctggccaacatggtgaaactccatctctactaaaaatacaaaaattagcggggtgtggtggcgcgtgcctgtggtcccagctactcgggaggctgaggcaggggaattgcttgagcccaccaggcagaggctgcagtgagccaggattgcactactgcactccagcctgggggacaagagagagtctccgtctcttt

SEQ ID NO: 241 - DNA, 1069 bp, Homo sapiens
acaccgctgctgagtgctgctgggcccgtggctgcccctagggaagccttccgggggcgggcgctcctgtccgtggagtcgggcagcaaggtgaggcgtgggcgtggcggtcgaagggatggaggctggctcatccccagggctctcccctgcacagcctcatgggtgctaaatggggtgggggatcacctctggctcctacgagacaccaagtgcccccttctgccccacagcccttcacccggcaggaagtcattggcttcgtcatcggctccatctccagcgtgttgtacctgctttcccggctgcctcagatccgcaccaacgtgagcctccagcaggggctgggtggggccgagtagaggagagctggcctggccacccgggccctctgggctaaggagtagcacagcataggagccttggttcagaaagtctggtctactcccgctgttggcttgggcaagttaatccaatctccgagcctccatttctgcttctggaaaatgggcgtggcgtggcctgccagccaggctacaagaggcccatgtgtgtcttgggggagtgggaggtcaggggaaggtgaggggctgagcttggaggcctgaggggagaggagaagctggggagtcggggaggggaggcttgctgggcagctagagcctgtgtggggtggaatgcagggtggtgtggggccacaggcctggcacagccacggtctcccgtggacctgggcaggggcctgggggggcttgtctgtgggtgggaggaggctcttctgtgtgtcgggcccatatccctgggcacccagggaaagattggctcagagcaggtgcactgtggtggggcaggtggacatgtggacagttacaatccagagtgacaagaggcctgttcgaggtctctgacctgacctcctcctgccccagttcctccggaagtccacccaggggatctcctactctctgttcgcgctggtgatgctggggaacacgctgtatgggctgagcgtgctgctcaaaaaccccgaggagggccagagcgagggcagctacctgctgcaccacct

SEQ ID NO: 242 - DNA, 1016 bp, Homo sapiens
tactcgggaggctgaggcaggagaatggcgtgaacccgggaggcggagcttgcagtgagccgagatcgcgccactgcactccagcctgggcgacagagagagacttcgtctcaaaaataaaatagtaataataataatacagtgtcgggtagtgattagagataatgagaaaaattcaagcaaacaggtaggcaggcaaggcctaacttagcaatatttgatcatatagctgaagggaaggagggagcaagccgtgtggatagcagaggcacaaggagcagcaagggtaaaaaccctgaaggtgacagtgctgcatcagcactggtgtgttttcaagggccagacaggaggccagtgtggctagcctaggtcgagcaggagctgaaggacagggcaatgacaagatttgacctaggctttaaaaggatcatgaggctgctgtgttctgaatggactgtagggggactagggccttagaaagccatttctatattgaggacatttatttatttaaaaagcactgatatggcacatcctatgtgatgaacactgttaagcaccttacagataataagccatttaatcctcatgacagaagcctgaaaaggtaaggagcttgcccaaggtcacacagcagagagatgaagctggcttagaccagggtagtagcattggagatggcaagaagtagatagtattctaggtatttcctgatgtattggtggtaggcatgagaagaaaggaatcaaggatgatgctaagattttttttttcatatttaaagactttgtcttctgttgttttttgttttgagacagtgtctcagttctgttgcccagactggagtgcagtggcgcaatcatagctcactgcagcctcaacacccccggactcaagtgatcctcccacctcagcccctccccacccccgccctgagtagctgggactacaggcgtgcatcaccgtgccaggctaatttttttgtagagactgagtcgcactgtattacccaggct

SEQ ID NO: 243 - DNA, 1016 bp, Homo sapiens; identical to SEQ ID NO: 242

SEQ ID NO: 244 - DNA, 1016 bp, Homo sapiens; identical to SEQ ID NO: 242

SEQ ID NO: 245 - DNA, 1016 bp, Homo sapiens; identical to SEQ ID NO: 242

SEQ ID NO: 246 - DNA, 1016 bp, Homo sapiens; identical to SEQ ID NO: 242

SEQ ID NO: 247 - DNA, 1035 bp, Homo sapiens
aattcgtttttgacaaggcaatttaatggagaaaggaaaatcttttcaacaaaccatgctaaaacgactaggtttccatatagagaaaaaaatgagcctcgcttaaaagggtcgtagacctaaatataaaagctaaaactataaaacctataagagctttcccgtgtggagtctggagacgacgtgcagaaatggcacctggaaaggggaaggaaaagaaggaagaacaggtcatcaacctcggacctcaggtggctgaaggggagaatgtatttggtgtctgccatatctttgcatccttcaatgacacttttgtccatgtcacggatctttctggcaaacaaaccatctgccgtgtgactggtgggatgaaggtgaaggcagaccgagatgaatcctcgccatatgctgctatgttgaccacccaggatgtggcccagaggtgcaaggagctgggtatcattgccctacacatccaactccgggccacaggaggaaataggaccaagacccttggacctggggcccagtcggccctcagagcccttgcctgctcgggtatgaagatcgggaggattgaggacgtcacccccatcccctctgacagcactctcaggaagggggtcaccgtggtcgccgtctgtgaacaagattcctcaaaatattttctgttaataaattgccttcatgtaaaaaataaataaaaaaagtgaaacctgtaagagaaaatcctttgtgaccttggagtcagaaaagattttggggaatacaaaaagcaagtttcaaagaaaactgatatactggatttgataaaaattaaaaacttttgctctttgaatggcaccattaagaaaacaaaaaggcaagccgcagaatgggaggaaatatttgtaatacacatatctgataaagggcttagaatacataaagatctcttaattttaaggttcccccccacccatagactcagggtctcacatgttgctcaggctactacttctggcctcaagcaatcctcctgccccagtgtccgaa

SEQ ID NO: 248 - DNA, 1035 bp, Homo sapiens; identical to SEQ ID NO: 247

SEQ ID NO: 249 - DNA, 1031 bp, Homo sapiens
tactcttgcccaggctggagtacagtgacacaatcgtggctcactgcatcttctgcctcctgggctcaagcgatcttgctgcctcagcctcctgagcagctgggattacaggctcgtaccaccatgcccactaacagattgatcttaacggatactgagagacaaggtatatttgggaggagtcgaaatctagtgcatttacttcaattttctttatccaatctaagccattaggatgcttaggataatttatagttattgtaacactctgacataattgtcgacagatttgtagacttaccttactttgataaatgtttacaagttagaacaaacgtttctgattgtcagaacctgcacatataaaccactcagaattcctgtttgatagattttaaatgattaactaaagcaactgatttaagcaacataattcactttttactaggaaggtagtcttaagaaagctgctagtttcttggcatcatttcagatgactaaattgaaattcatttgctgtaggaattttttatttatttctctttttttttttgagacagggtctcactgtcgcccaggctggaaggctggagtgcagtggcacgatcttggctcactgccacctccacctcccgggttcaagcaattctccttcctcagcctcccaagtagctgggattacaggcgcccaccaccacacctggccactttttgtatttttagtagagacagggtttcaccatattggccaggctggtctcaaactcctgacctcaagtgatcccccaacttcagcttcccaaagcgctgggattacaggtgcaagccactgcgcctggtcaaaatttttaatttctttaccatttcagcatagtcctgtatgtgagaaaccatgagcttgttagcttataaatatcctattctgattagatgcaaaaacatattactgtttcaatcacatattttgtcttgacactaaaataaatgctactaattctatgtattcccagaaaagattatgaagaacttat

SEQ ID NO: 250 - DNA, 1031 bp, Homo sapiens
ctgtctagtccagatagccacaggaagggtaaggtcttgtaaaatagccaccttcttagtatgtttcctaaatgctctttgtcagtgttgacttttgagaagctgattaatacagactaaattcaccatctctgggtccttggtctggcactttcctggttaattcacatgaatggcatttacatgtggacacctgggacaatctgtcttgtcctcaaaggattaagtaacacagtttgaagctgactttaaactattttttccgtcattaatggggccctgagcatctttcataaatcaggaatgtgtcttggaaatgtaattctcactaaactcagttccaagggtattttctataaaagcacattcttgtttgttctgtcataacacatgcatttgatgattgtaatagcattgacagaaacacgattgaacaggaagcacggccattataaataggtcagtttgatataaattcatgttcaaagcacaaatacagctttattagacacaagacaactctaggaaaatattgattacattttaaagcaaaatggtctagttaagcagcaagtctgaaaggatcctctattaaaaaatatatatatatgtatatatatacacatacacacacagcaaagcccgatgtgtcatataaacaattactgatgtcaatgaaatacagtcaactgtgcaaagggtaggaaaaaactggttctgattttcagctgtggcttatccacagtgtgatcctacgtagccagtgagttgtattttaataaaggattagctattatactacacttttttttttttttggcaaggtctcactctgttgtccaggctgcaatacagtggtatgatcatggctcactgcagcctcaactcccaggctaaagtgatcctcccacccaagcctcctgagtagctgggagcacaggcatgcaccatcatgcctggctgatttttatttatttattattattattattattttgttttgtttttgtttttgtagagatgcagtctga

SEQ ID NO: 251 - DNA, 1078 bp, Homo sapiens
cccagctccgcaggaccggcgggcgcgcgcggtaagtcccgcccgggtcggcacgcgggcgcccggcttccagaggcttcggccgcgggggcagtgccgcgcccccagcccggagctgcgtcccccggcgcgtccggcggccgcgggcaccgggtggaggcgccgccgccgagctcaggagccctgggggacctggcgggcgcctccggacgccggcgctggggacgtgggcgcggcacggggtggccggggggcaccgccgcgtccggagcccgtccccagactcgccccagggttccgtttctggatcggagtttccgcggccgggggagagagggagcgagggagggagatgcgtggccgggcgggccgggctcgcatgtcccccggccgtgcccgggcctcgccgcgccgcgcctctcggctctggacgtttccgcctcccgcggccccctctgcttcggtccccacgtccgtgtgtctgtctctccgtcgctccgtttccgccgctcactttcccctggtctgcccgtctctttccgttccccgcctgcctccgtgttcggctgcccgcgtttgtgtctctgcctctggcttttctctccctctctctgtctctgcgctgccctctgtgggggtctcgccctgtgtctgcgcctctccctgatcccccgccctccgatccagacaatcccccagtgtcggaggctcgccttcccccagcggggttcacgaatagtttcctagaccgggtgcggcaaaccctccccctgcctcccgccggccccgaggcctggcccgggtcatctccctggaattgagtctggggcagggagagccagcctttccgggggctcagttttcttaagaattccacccccgcgaggccggctggacgacaggccctgctgcgggccacctgcccggcccgctcccagggcggggcgattctgatcgtttacaagcggcggcaaagggggcagccgcctgccttggcgtggccggaggttggcgggcatcaagggagaaagccacacttccaggctttcggaggccctcgctccccaagctggacgcc

SEQ ID NO: 252 - DNA, 1071 bp, Homo sapiens
acagcaggaaggccctgaaggccagcctgacgctgggcatcctgctgggcatgttctttgtgacctggttgcccttctttgtggccaacatagtccaggtaatgccacggcagggggcaggtgagtccggcccttgcaggagaggccctggatcccagcccaggcatggggacaggggagggtaggctgcctctcgtggtgcgtgtgtgtgtgtgtctgctccatacatgctgggaagggtggcctgggtccctgccctgggaccaggcatgatgcatcccctccccccaggccgtgtgcgactgcatctccccaggcctcttcgatgtcctcacatggctgggttactgtaacagcaccatgaaccccatcatctacccactcttcatgcgggacttcaagcgggcgctgggcaggttcctgccatgtccacgctgtccccgggagcgccaggccagcctggcctcgccatcactgcgcacctctcacagcggcccccggcccggccttagcctacagcaggtgctgccgctgcccctgccgccggactcagattcggactcagacgcaggctcaggcggctcctcgggcctgcggctcacggcccagctgctgcttcctggcgaggccacccaggaccccccgctgcccaccagggccgctgccgccgtcaatttcttcaacatcgaccccgcggagcccgagctgcggccgcatccacttggcatccccacgaactgacccgggcttggggctggccaatggggagctggattgagcagaacccagaccctgagtccttgggccagctcttggctaagaccaggaggctgcaagtctcctagaagccctctgagctccagaggggtgcgcagagctgaccccctgctgccatctccaggccccttacctgcagggatcatagctgactcagatatcgtgttctgaaggatgctccactgttgagtgtaacttgtgtgtgcagaggatgggctggaggactctggatgttggggagaaggacctcttggttcaggttaggatgaaaacaatcatgacctttgcccattc

SEQ ID NO: 253 - DNA, 1050 bp, Homo sapiens
atatgtggctcttttcctgcacggtgcacttcgtcaacatagtgttaccaaatttttaaatccttttcattgttaggggaaaaattgtttacttaacctagttttaatttgcatttctcttatttatgcatcttttcctgtgtttaagacatatttctattttttgtaaatggtattcattttctttctccatttttttcctattaagttgtcttaatgattttggggagctttttatgtattagggaaattagcctctgtctgtgatatgagttgcaaatagtttttcgcactctgtcatttgtctttttgttctttctcctgtggtctttgctatgaaagaattttagatttttacatagttaaatttgttacgattttcttatatgccctttggattttgggtcataactgggaaagtctttcccactctgaggttaaaaagaattctcccatagtttagaatagtactttcatagtttcactttatttatttatttattttttgagactgggtctcactctgtcgcccaggctggagtgcagtgctatgatcatgtttcactgcagcctcaacctcccaggctcaagcgatcctcctgagtagctgggaccacagctgtgtaccactatgcctggctaattttttattttttgtagagacagggtctcactttgttgcccgggctggtctcgaactcctggactcaagcaaccctcctgcctcgaccacccaaagtgttgagattacagatgtaagctactgcacccagctcatagtttgacttaaaaaaaaaattaaatcttggcttcatctgaaatttatattgaaataagggtaggaggctatggatccaactttatatttcccttgtgattacctagttgtacccaaaccattgattaattatacatcttttctccactgatttaaaatgccactttctttccatatactaaattcccatatgtatttgggtctattcctagacatttggttctggtccactgatctccctgttcacatgttgatgcctcattgttttagtt

SEQ ID NO: 254 - DNA, 1083 bp, Homo sapiens
atgatcaaataaggcttgggaaccagagggaagttgtatgtaggtttcttcaagaccagcaccgtttttgtgcaaaagttcaccaggtgcgagtatagaggatcgttttctgttaagctcacggctctgaaaatcagctgaggtgactgtgtgctgtcagaggcagcagtcatttgccagtgttggcatttagacatgggagtgcgaatgcctttcttactgagcagttattctgtcttttgggcctttcttttcaattcctctgttgtgactcaaagtacaatgagtggataaaatggagcctagtcattgctgttctcttaaggttgtttctagaaggttttcccctatatatatgaatttttccagattagagtgtcttgtgttaaagattctgaacatagtttgattctcaacatagttccctgattattacttgtttcctttagtttcagatgcttcatcaagatgaatcaaataaaagagaaaagatcaagacaaagggaatggactctgaagacgacctgagagatgaagtagaggatgctgtccagaaagtttgtaatgcaactggatgttcagttagtatttctgtcttgcaggaatgatttagaagcaagcattgctgtgcctagcttacttcttagtttcgtagcacctctctagcatatcagcaccttgtgggccaaaataggcccatgagatttgtagtttgattagtgtatgtggcttaatgagagctgtttattaatttccctgttgtttgctagacttcacccagtactgctcaaaggtcttaggaagtatgtggatttaatttttcctgactagtgtttacagtagtacaaatgcagttttatagagggaattcatttataagtgtacattagacggttatttcaagggaccaaccttattggaaatcgacatttttctaaatggaaaaggtcctgaaaccttgtgttaattctcactattacatctttatgtttatgattattgaagtagagctaggcagaaaaatatacccagagttttgaagtggtttttttgtttgtttgtttcttggataggattttaatt

SEQ ID NO: 255 - DNA, 1021 bp, Homo sapiens
cccgagtggaggcccagtatgtctagtcctgggatgactgttgtcagcagctgttactctagtacaggtgctcctgtgaactctttattaggaactgaatgtgtcttaacctctgtgttacatcttggctggcagagatttatgttacatgagattgtcttggtagcttgtagtgtggtcaggagaaaggggatggagcagtggtgcatagctgcttactgctcttataaacggtatataaaggttttacggattttgaaaatatttttttttagaggtcaaaataaataccattttagtggcaacagctttgaactagagaggtagatgtattaaagcagcatagaaccataacttctagataatgtagttgccactaggagatattagaaagttagaatgtatgtgtgtatttagtttttcaataataatgaacatacactttcaggagcaaagtatggttgagaaattgtggcagaaagaattttaaatgttagtcgaagttgtctgtagtttctttattaagctctgaaaacacttccaatgccagtttgattctgagggcttgggaagtgggatctcccttgtggagcagctggagctggctgggagggagcctctccatgggtaatttattatgcctgccctgcttcccccagggagctgcttcagtgtgaaatgatgtgattgtcgggggtggggtgggaggagggccaccttcagtcggggagttgctcacatattacacaggtagcatcaggtggacttcagcgctgaactgtactagtagtgagtccctgtagtcaatgtgcaatttctctaattctgagaaactctgtagactctgcctgggttttactgggtcagcatagaatgctatcagtttacctctgtgaaatattcagtcagttgaaggaaacttggattcctagtcagaggtgactaaaagttaccctgaccaaaaggatctctgcggggggaagagaatggagcttcctgattttaatgtgttgcgtcagtg

SEQ ID NO: 256 - DNA, 1050 bp, Homo sapiens
gtgccatccgggaagcgccagcccctggcccatgcccctcacccctcccagcctgcattctcctcccctctgctccagccaccgctggctcaggcaaaactggcctcagggtcaccctggtggcaggaagggggcagcctccagtgtttggcatccaccacaccctcggtagggccaggctcaggggcatccagggagcttggggttgccagatggggcagaaggctgaaggtcacaaagatcacttacccaggaggcaaaggaacaccagcacgtggggagatttcatcccaggttggggggaagggaggtgcacaaggagcataaaaggcagcagaagaaagcagcagggccacctctgatctcagggagcctcctaattagttaaatacccaggtcctgtccactccctgtcattaacccgtgagtgcccagtgatgcaacgattcttccaggtctgacactttggccaagtccccggggaggggccagctggggcctgtgggctctgcttccaggcagtgtgggggatggcgggcaatctcgtggctctttctactcacacccttcccatcacccaccctttccaaaaaatcatccattgaccacgctgtgaggcgcgggctgtgccaggtgcttgtcattcttggtatcttttcctcatctccacttgactgagactcagagagactgaaaaacctcagttctcacagcctggaggtgcccagggccaagtccgtcctgtttcagagtttccacccgggcagaaccggaggcaggaggccctggcctggcctggcgcttcccctccccgaccctcctgctctggtctgtgactgggatcactgaccctgcacctccgtcaccgttcagggcctgggagtcgctgggtctgtggccttggagtcctggttccactgcgtattaggcggccgtgggcaggtcctttcccttgcttggaacctcagttttcctgcctgtattatgaggatagaaggtgtccctcttgcctcccgcacaggaggatggaaaactcacacgcaaccaggc

SEQ ID NO: 257 - DNA, 1066 bp, Homo sapiens
aatggatgggaaatctactaagaaatcaacttagtaataattagaaaagctctagttctgaggacagagacctgatggagtcaccatagtgggaatttatgacctggcatccggttcagatacctggagcttcttgagtgagggaagattggatcccttgaggaagagtgaagccttcaatgctgccaccagtgtatgctgtaaatcttcctccaggccttccccagaaggccctgaagccatttatgtgggtgactgaggaaagggaaatactcagagcttctgtggcttgttggattctggctctgaagaatgctaaactaagggcacctgtggtggccatgaaaatgcactacttgcatctccagctgcaggaggcctaacgaatcagcagccccagctgctacactccgaatggaggacttgatgacatttcccctggatctgcactagcccatgaggaggaaagcctcctatcaagtcctcccagcagaacacccatgatgactcatgaggatgttgaaagtgttttcctgtgtcaactgtgactttctttcttcaaagtctgttttgttcctgcacattaactgatttatatcaaataagagaataaatgcctagactcccatgagtctatcttttactgataaactcaatagttctgaggacggaagcctgatggagtcagtatagggggaatttataacctggcatccagttcagagacttggagcttcttgactgaggggagatcgggtccctttggggaagaaggaagccttcaatgttgtcacaagtgtatcctggaaatcttcctctaagccttcctagagagacctgataatatgacttatgatacagtgaccccaaattcagggtgttcttgtctactctcaagaatgcaatatcttcttcctctgaattgaacgtagtaccaatatttgtgtgtagctatgcaccttaatagaccatagctaattagatgaggaatggtagacccaattcaaccatacaggcgtcaaccatatcagcatacaggcatccctctcccaccgtttccttcttg

SEQ ID NO: 258 - DNA, 1050 bp, Homo sapiens
tccttttttgaccacttccttatgttacccctgaaatctagttggggctctgtggtgtctgattttccctggctgcttctttagttttgtctccttttccaggctcaacgaggtgctgatggaagcagaagagcctgaagtcttgcaggactcactggatagatgttattcgactacttcaacttactttcaactacatgcctcattccagcagtatagaagtgccttttactcatttgaggaacaggacgtcagcttggcccttgacgtggacaataggttttttactttgacagtgataaggcaccacctggccttccagatgggagtcatattcccacactaagcagcccttactaagctgagagatgtcattgctgcaggcaggacgtataggcacatgtaggtttgaatgaaactgtagttccctttggaagcccagtcataggatgggaaagtgggcatggctctattcctattctcagaccatgccagtggccacctgtgctcagtctgaagacgttggacccaagttaggtgtgacacgttcacacgactatgtagcacatgccgggagtgatctgccagacattctaatttgaaccagatatctctgggtagctacaaagttcctcaggggtttcattttgcaggcatgtctctgagcttctatacctgctcaaggtcagtgtcatctttgtgtttagctcatccaaaggtgttaccctggtttcattgaacctaaccccattctttgtatcttcagtgttggtttgttttagctgatccatctgtaacacaggagggatccttggctgaggattgtatttcagaaccactgactgctcttgacagttgttaacccactaggctcctttgagtagagaagccatagtccttcagcctccaattgatatcaatacttaggaagaccacagctagacggacaaacagcattgggaggccttagtcctgctcctttcaattccatcctgtaaagaacaggagtcaggagccgctggcaagagacagcatgtcacctgggactct

SEQ ID NO: 259 - DNA, 1035 bp, Homo sapiens
ggaaatcgcaaaagaccttcccagcctggacagtctggggctgcgtgctctagaccgggggctccctaagggcaaatacctgaccctgtgagtcctgccaggtacaagctggggcataccagctgatgctccctggaggcacatcagtttattaggctgcttggtagagccttggagggtgtccttggagcaggcctgggagctgggtgggcttggatggggaaggcccccggctgagctgaggtggagagagcttggcacaggggtgtccctgggtaggtcccacatggaggcctgtgcagggcctggcccagtacctgccatcgatgtgacctcttcaccatggccaagtggacctccattttctcacctgtaaagggggacagctctgtctcactctcagggttgttaatgaggacacagcaggtcaggtgtgtcacagtcagcacctggtgcaccgtagttcttgaatgggaaaccaatgttagacgccaaaggaaacagtttcggaggtgcagggactgacccagcaacacacacctgggaagtggtggagcttgggcttggatcagatttgctggctgtgtgacagctcacccagtgacttcattgctaggccttggtttcaaaatgtggtgactgagagtggtgctaaggccctaagtttgggtcacactctcacctaagtgagaacctgaccaaaaagggggaattttaaaacaaaattatgagctgggcgtggtagctcacacctgtaatcctagcactttgggaggccgaggcatgtggattgcctgagctcaggagttcaagaatagcctgggcaacatggtgaaaccccgtctctactaaaaaatacaaaaaaatcagctgggcatggtggcatgcgcctgtagtcccagctactcaggaggctgaggcacgagaattgcttgaacctggaaggcggaggttgcagtgagctaagaccgtgccactgcatgccagcctgggcgacaaagtgaaactgtctcaaaacaaaaacaaaattatgag

SEQ ID NO: 260 - DNA, 1033 bp, Homo sapiens
tgatgactactagttctcttactctcctaaaaattattcacttaatgtttgtttccttatcttcctttatttctttgtttgcaaataacttttaccgcttgttcactactgtatcagattcctggtcatgttatgctttgtgtcttactagtttctacttttagtttctcataccttcagtccaaaatatttttactaaagcaattttcattacttgccatttcagctacctctgctgctgctgctgctattttaagtcctgaatgtcaaaactcttctgggacattgatctcaaactgcttattccgtgaagtgaaaccaggctttctgccaccaatgtggcgtccctttttgcaattttagaaaaatattttttaaatcaaagatttggcattagccattatactaaagtccagaacaatttctaatagagcagaaaactatattgttcagccatggtattcactaagcactggtgctctatcaccttaagacaaagtctgatttaggctctgttactgttgttctgtaatgctttacactttaaccttgcatccttttctgtaaaattaagccattgccatttgccatttcaattctgctgtgtgttcttgattggtatattgctactataatgattaaaagcatagactctggaaccagactgcctgggttcagatcctggttctgccacttattaggtatgtgcagtctaagtaacgtctttgtgactcaggtttacttcctctaaaataggggtagcagtagtgcttacctaacagggctgcagtgttaggaagattgaattaatatatatgaagtgtttaggactgttcactggcacatagtgagtgctgtatagatttttgctcttggcacaactgtgaggacccttccccgccatctttgagaagctgtgtttctctcaaacataaacattttaataaccatccttctcccggactaatctgatgaatccaaaaacatttcttttttcttttttgagatggagttttgctcttgttgcccaggc

SEQ ID NO: 261 - DNA, 1776 bp, Homo sapiens
acgaccaaattactctgtgctgattctgaaaagatttgtctttttggtgcatgtataagaacataagttgcctgatcttaagagtttttttctgattgggtatggtggctcatgcctgtaatcccagcagtttgggagacctaggtgggaggattgcttgaggccagcagtttgagacgagcctggtagcctggtcaacatagtgagaccgtggctctatttaaaaaaaaaaaaaaaaaaaaaaaaaaaaaaaaaaagattttttccgaacttatccatttgtctatggtacaaacctatcctctaatttttcaaaccaaaaaacgtctttataactttgtccttaaacactccacctccaacctgatgacctattctctatttctatgctactaccgcagggcagatcctccatttcaatcttagattattaccctagtttcttagctgacttccttgactatctggttgtctttggcagcccaccttggaatacaggcacaatattgatactcctaaaacactgttcatggatatggaagaagtgactgttctgcttagcttttagagtctatatgacttggactcatagtttttttttgtttgtttcttttttccactttgcatgcttgcttgtgccttttctcctgatactcctatctaactagagatttattttcacattattttagattactctcccatgtttactctgaaaatctgtggcactcatatttcatagtgtaaaattgtagcaatctgagactactacagttgttagcctcttctccttataaccagtaaagtatactagatgatgtatgatgaactttctagcatagaatttggtacagagtaggcatttagtaaattattgaaatgtgttaaaggcctttgaaggcaagatttctgttacccagtgtaatgctgtagtaggcatttagatatcttacttagataacttttgtaataagttaataggatttcgttcttccaagaacctactctattttaacagatgttttaggtcctaacttgtgtcctaattagatagagagggtctgttaggtgcttgggatcttgttcttcaactgcacacataccagcacaactactgttaaatttcttttgcgcttttttcccctttaggacaaaaaaaggatttaacagttatgtgcttttaataacattgtattactttgttggtaaccttcacaacttttttttttgagacagagtcttgctcttgtcatccaggctggaatgcagtgatgccatcatggctcactggaaccttcgcctcccgggttcaagtgattcttgtgcctcagcctcccgagtagctgggattacaggtgcgagccaccacaccggctactttttgtatttttagtagagatggggttttgccatgttgaccaggctggtctggaactcctgacctcttatgatcttcctgccttggcctcccaaagtgctgggattacaggcgtgagccactgcgccaggccttcacagtcatctttagtatgtataacatttcatcctgtggtgtattattacttgttttttttttgttacattaactgttttgatgatacagcatctcattgtttcttgataaagtatttccttctttttggataaattacctgaagtggaaatgtatgtgtagggcattaaaaaaacaaaaaaacaaaaaaccttgtgttttcctaatattttgagggaaaatcttactgtaatctttcttcccttctaatcaaatactcttgt

SEQ ID NO: 262 - DNA, 1027 bp, Homo sapiens
atactcttgccctaagaagatcatctcagaatttctactgacctgttataaatagcattagaggcttgttgattaacaaaggtgtattttaaaatacctttttttagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacaggtaagaatggcatgaaaccccatgtgtatttatggtcgagtcatttattagagcattaggatacaggagttatttctaacagtgatcagcagtgctcaaagatgcccagcaagaatatgaacagcttcatattgtatgttcttttgttagaggcctctgtgttttttggagaatattattagttcctaaaccccttgtgttggtaagctctcgtattgtactgaatgattcgtagtggtcagggttgtgttaaaacaaaaaccttacaggaaaggttcagataagcataaacttgcaagagacgatgtgaatgattttttttttttctaaacacttaaattttcatctgaatatgtctgatcttttcttgccaattctgacaattgatactatactgtttcttgggcaattcaaccaggatagggaattagtcataataattgagactttaatgtcaaagaaggcagccatggctatttctgccacagttctcaagcgtgctttatatagtgtccctattcctatatttttggaagtattccttcctcatgcattccggccgtttttgagtgatttaattggaactccttttgtagtttgatgggaaactcagattttgaagatagggagcaatgttagggtatttggaatgggacttgtaactgatgtgtatggtttaaactttttcaccttcatgatatcgctgattccgtcctttgagt

SEQ ID NO: 263 - DNA, 1045 bp, Homo sapiens
gggcagtttagtgctattatagaagcagttatttaaaagtttagaagattttacaccttctcatgcatagcaactgttttgagagttttaaaaaatgcctggtgcttctctgtgtgttttagtaacattcccagaaaagtgtgcctgtgtgtgtatattgggggagacaagggaaagtcatgtgtgaaacactcatgtccatgttagacactaattctgtgtgcttctgatgcatacctctgttctctagatatgggttgctttgagggaagacacataggccctgtggattcacttttaggttactagtgatgctttagataattggatgcttttaatgtaagatttttacagtatcaacaggtgtatatagtaaatccgtttgtagagagtatgaagtttaaaaggtcttagcaggtacatttttcttaccagagtttgaagtatggagaagtcaaaagaggggaagttagaaaatggggtctgtggttgtgtttgggagctagaactttgaggcttacagattctgtttgttgattcctctaaaactaaagtcttaatataaacagatggtggtcaagcaaagattagttttgtttcatagagcatttgttgatcttcgtccatggtaagcaagaaaggaattccttcttgttaagggatacactccagtttctaatagtcctcctcctctttttttccttataaagtatatttccctttctgtactccttccttccttttatattttactgccagagttggttcctagatgtgcagaaagaattgcagtggaattttaacttttatgtggcatttctactttgtaaatgatgtagaaagaggaaggctttttaacttttgctgcttttaaagaatttactgctgtttctgatttattttgtgtctaatgtgacatgtgggtaccagtcctgtgggatgtcatggatgggggcagggtggaggtgggaacacttggggtggtctggggttggcacttacaattggagctgtgttctgggacttttaggacatatttacttgg

SEQ ID NO: 264 - DNA, 1711 bp, Homo sapiens
tgcctacataacactaacaatgcagttcattcctttgttcataaattcatttatttaacaaacgtctgcttagtacctgtattcgtctgttctcaatgctgctgataaagacatacccaagactgggtaatttataaaggaaaagaggtttaattgactcacagttcagcatggctggggaggcctcaggaaacttacagtcatggtggaaggggaagcaaacacgtccttcacatggcggcaggagagaattgcagagcaaagtggtggggggtagggggaagccccttataaaaccatcagatcttgtgagaactcattatcacgagaacagcatggaggtaaccgccctcatgattcagttacttccctccaagtccctcccatgacatgtggggacatggggattatgggaactataattcaagatgagatttgggtggggacacagccaaaccatatcagtacctctcatgatgcagtaggatgaccaagacaaaattcttaaactggcgggacttacattctagtagggggaggcagacatgattaaaatgtgtatgtcagagatggtgttaagtgctgtagagagaaagtacgggactccacagtcccatcaggtctgattacttacacttctcggatttaaaaaaggagatccttgaaagtcttaaaaggctataaggaagaaaaactgcttctcaaaatctaggttttgtatatatcgtagaactgtaagtattttaaagagctagaagattcagattatgtttatttcctctctgattttaattgctttgaggatattatagtcttacttggttcaagttagttgaacttggttcaggccaagttatcagtaatgggaatgataatgataggtgagtctctctttaaaaagacaatgggaaggacttttagaggttatttagactagccctctcaattttggcggggtggggtgagtgtaacagctttattgagatataattcctgtaccatacaattcacttaaagtgtacaagtcagtggtttttagtttattcacaaaattgtgcaactatcacctgataaattttagaactttctctttccttcaaaaactcttttcttcaaaaacaccctttagctgtcataccctgaaactttctgccccatctgcccagccctaaacaaccgctgaaccacttcctgtcactgtagatttgcccattgtgaatacttcgtataattataatatgtagtcttttttaaccaacttgtttcacttaacgtgttttcaaggttcatccgtatggtagcatgtgtcattacttcattcctttttatggctaaatagtattccattgtatggagataccacattttgcttattcattccatcaaatgatggacacgtgagttatttctaccttttggttacaatgaacattgtgtacacatttttacatgatctctcagttttcaaatgaagtaaatgtagtggggtgatttgcccagttcccagtgtggttccaatgcattgtggggctccggaggaggcagtggtgccacctgcttgaccaagatcgtagctagctgtgaggagcttggagcatgtaggcatttctggaagaattgaaattatgtttagtttcagggccttctgttccttcaggaggagtgatacaatggcatgaggatggactttggtatcacattttctactgag

SEQ ID NO: 265 - DNA, 1025 bp, Homo sapiens
gtggaagccgcggccacagcacagcagctcacagccgtcgatggccttggacgtcttgttgcatgtgcggcccctcgtgcccagcacgccgctgcgcatgtcctgctcacagaagtcggggctaggctccaagtacaccaggtcctcatctgtgtgcggcttgaactgtgcgttgcgtggcaccagtgccctggaggagcccacgcggcgtggctccacctcagtggcaccatcaaacttctccttcagtgcgtgacccacctggcggaagggcggcacggctcgccagcacgtctttacctcacaggagcctgacaccccgtggcacttgcattccacccgcatgtgtgtcaggatggcctgtgggagagggtgggggagaggggccatcaggagatggcaagggaaggcaggggagggccgcggaggctgacagccgagcatcggggtccctggggctgacgctgcagtcagatttgccgttgtgcctcctcttaggaattacgcggtactgggctgctaagcagtgttgtgacaggtgaacgaggtactgtccctgcacttggggcactgggagttgaagaaagagaagcactaagggtggtgtcctatcaacagtgagtgacaggtgtggggtggggagaacactgctgcatttaacctccacgggaaccttggggagtaggcatccagaaggcaggtggcattacagttaggcacatgatcttcgtggtgatggagagaaaggttcacatctagctctgctgctcttttggggaatgagtgtgtgtgagagacagggatggacacatatatgtatgtgtgtgggggggccatatgtatggagggggccacttaccccattctgtaacgcctgcctgcctgtctgtacccccctctggcctgtcctgaaccccactggcctacagaaggtgccaggtgctggtgagagcctgcacaaatgttttctgagtggccgtgtgggtgggagagtctggggccctgcccatgctatccctaccccg

SEQ ID NO: 266 - DNA, 1050 bp, Homo sapiens
catggaccagggactcctgggtccaaatgtcatccttgtgttgcttgaagcaagttagtgaacacctctgagcctcagcgtgttcatctgtaaagtggggagactggaattcctgcacgcaggaggcctaaatgaatgaaatctgtgtgcaggagatgctcgtccctgctgcagcattgtcctagcagcaccttcaagatgctcactgtcatcggtgccgtcaccacccctcccacagcctctcccagttcctctggccacccctctgctgcaccccagaccagacccatgctgacttctgctcatttgtgtgtgtgtttttttgcttgggtctcttggccctcttagtcctgggttcccagtctttttttcagctgatcatgcctgagaggtgggacacgctcccccggggtacagtggatgacctcagcagccatcccaatggcaggcttttgacagagtctccagatgaagtctgcagagtttgaggatgtgtttcctggcgactgtcagtcagaccctctgaggctggggagtgtgagagatgggtggaggggatggtgctgctaggacatcaagagctgggacactggggtgagggcagggacagtggtgtgcaggacaagctcaggagtgtcaaggggacttggaaaccatttgtgggcatcacagagtggatgcatgggaccttcacttatactctgcaatcaatagtcacgtgcttcagtatgtccttagtgcaacagcacagggctggctaggcaggtgtcttcccctctgtttcgcagatgaggaaactgaagctcagagaagcatgtgtttgagcccatgcagcctgcagtggaaggtcaggatttgaaaacgggtcactctggctcctaagccaaagatgacccagggtactgaggcatgaagtttggcagtcaacagacagtgacctgagggaggaggcctgattcttcccttgatgggtctttctagagccccatgtcttttctgaactacagtgaggtgtctgggctgtgttcaggagtaaggggtgctggggac

SEQ ID NO: 267 - DNA, 1048 bp, Homo sapiens
agcccagaggtcatgaagctattctcttatgcttagaagcttttatttatctttcacatttagacagacagtttatctggaataactttgtgcatggtttgtgaagtagaggtcaaggctttttccttgtggggacacctagttgatcctttactgaaaagattttgcttcccacactgcagtgcagtatcacctttgtcatgcatccggtatcacaggtgtggggttgttcctggactccctaagctaattgatgggtctgtctatccttacaccaatattacaatgccttttttttttgagacagggtctcactctgtcacccaggctggagtgcagtggtgcgatctcagctcactgcagcctcgacttctctgggctcaggtgatcctcccatcttaccctcccgagtagctgggactacaggagtgtgccaccatgctcagctaatttttttgtattttgtagagatggggtttcaccacactgcctaggctagtctccagctgctggactccagcgatctgctcacctcagccgcccaaagtgctgggattccaggtgtgagccactatgttcagcctttttttttttttttttttttttaaatatcaacttttatttggcatctggtgatatcttgttcagagaacaagtcctctagcttgttcttcattttcaagtttgacttggatattcttggtgttttgcatttccaaacaaattttagaatcatcttgacacctttctgtctctctctctgtcacacacacacacacacacacacacacacacacacacacacacacttatgggattttaaatcataatttcactgaatttccacatcaatatgaggagaattgacatctttataatagggaatcttctgatccagcttatagtttgtttaaaaaataaagttgactttatattttcctttgtaaagtaataaagcagaagaattggaaatgtaaacatacagaaagaagtgagttttggccagatgtggtggctcacacctgtcatcccagttcgagaccagcct

SEQ ID NO: 268 - DNA, 1079 bp, Homo sapiens
aatgcacataaaagattggcttgtgagcaaaggattttattaaaacattttgatttctgttgctttaagaaaaagaccaaagtttcctgccataggatggcaaatgtattcttcatcactactagttttattgtgggggtctcactgaagggttggcatatccaatcaagcatgtagctctcagacagcatggatttgggagtgagagatgggattgttactcagttcagccatttcttaattatgcccatgggcaagatactgccttaccactctaaaccttgattttcctaatctgtaaaatagggatgataatagaacctactcatagagttattggaaggattaagtgagttaatttacataaagcacttagaatatgcctgtcatagagcactcattatgctaatgtttttattgttgaatctaaagtggggagaaaggaagcatccctccacttgtgctgttgatgacaaaggaattagtgatgctctggggagtgtgctggaaatcctctacagagaattagaaaactccagaatgcccactgcaaaccggacgagccagggtgaaactccctggaaagtgataaagtgtaatttaacttgaaagatgtaaaatgaggaatggagatgaactacatgatgctgcagagacagttagtcttgaaaccctggaggaatcccacctcctaggatgaaggtgggggtagtcaggtgactgctacactgatttctgatccttggagtctatgaccctgcctgttacgtaaagcagagtcttcacatttgttgctgtacacaacaaccagtgtttcactgatggctgcctatggtgttttcttttcctctccacctcttcctctcatggatgtcccgtgaaactagacatagaagatccttatgactgcaagaagtgcaggatgagtttccccactcttcaggatcaccggaagcacatccatgaggtgcactccaaagagtaccacccctgccccacgtgtgggaagatcttcagtgccccgtccatgctggagcggcacgtggtgacccacgttggagggaagcccttcagctgcg

SEQ ID NO: 269 - DNA, 1088 bp, Homo sapiens
accgccccccgaccaagtgaaagaaagcatggagcatgtgaagtggcggcgagcaggatggaagagcactggggaaacgtccaacaggacaggaggccggtggcagaccctgtccatccctggccgatggaatccaaaggtcaaggtctcaagaaaacagcctccttacatctgctcctttgctctccaaatatcgatagagtttcctctctggctgacagggtgctggactccggggcaggcaaggagacgggacaagctgacagggaaaagagtgggcgagacagagcatgatacggggtccaacgtacttcccagaggaggctgtgaaccccccggggcggcaggtgcacttgaggacagaacagggttatttcatcttttatgctgttatgcattgcctcattttctcaccacccattttccctgctatgaaactttcttagccacctgtcatgctaacgaactgtgttctcaagagttaaagaggttgactttagaacttataggatgtggagaattttacctaaaaaaggaaatagcatgtctatatgtccatagaaagacatggaggcaggatgatcaggtgcttactttgatgtgtctgaggagggtgggtgttgagggcagcagtgggggttgagactgagaatgggagtggggtggtcaggtcctgaagggctagaatggaaggctggggagtttggatcaaatgctgagggcagcagggagcccttgaaggttcttgagctatcaagggacctggccagattcatgcttggaaagatcactgacttgcaatgtgtggtgacgttcagatgagccagatctggtcctggacagtcacagtaaagccagcttgtcggttcccggctagactgtgagctccctgaagacagagacccatctggctcatctttgtgtccacagttctggtctgaagagctctgttcaaattccacctccccagaggccttccctgattctctcttctaaaacagacccagttctgcttctttccatcccacctgctttgttgtgcttcatgaaacccatcgccacctgaagaagcatcaaagacttgtttg

SEQ ID NO: 270 - DNA, 1050 bp, Homo sapiens
atgaatcaagtcatgttgttgctccagagcatttccacaactccctgttgcttttgggtcactcttccttggcccataggccctgtgcggcctgcttcctgcctactctgcctaatttccatcacccacctcagtctaggggttctagccactctggcctttcagttccttgcaattcctagactcttcccaccacagggcctttgcactgcttggtccctttagctggaatgctgttcccttatccttggataactctcacccatcctccatgttttcaaggaagtgttcccagagcatagctccatgggccaatcttttgctgcatttgtcaacatcataattttaaaataattaatgtgtttctttgaacatctctacctctcctaccagaccgtcaactttacaagggcagggaccatgatccaattgcttcatcacttagattccctgggcctagcatagcgcccagcccctagtaagtgctcaactgatatatattgattggaagaatgaatgaatgaatgcacggctctcagatgactgaaaggaggatatgcttctgtttgttcttttgggtgacagttggcagagtgctgtgacatccatcatctccctttaattgaacggagtgggattgaagtctgcaggggcttggcacagggccaggccccagggtgggggtgtgggatccgaggtgaattaggcatcatgggcctggccttggggagctcacacactggctgtgcacagccccctgggaggaaggtcccactggtattgttctcctggatggacagatgaggcttctaatactcagagccaggggcggaggcgggggtggcttgatgaggccacacagctagtcagtgggacagacgtgcactcagatccaacggatatcaagccaggtggcccttcccccacttcttgtgggcacttgggtgggaggtgtcagggatccctggcctttgggggtcttgacatcccaagctcttaccagccatgtggctgtggacaagttgcagggggcagcatggattgtcctgc

SEQ ID NO: 271 - DNA, 1076 bp, Homo sapiens
gaatgcaaagggaagccaggttccagggccacagaacagagcccaggattccagactcagcaagggcccaatccacaggtagaatgtggagcttggaaagtgcttgggaactagtggcaggagccagacagggcttagggtttgctccaaatcagtaaatttctttaagtcagtgatagtatctatttttgattctccaatacttttttctttttcttttttgagacagagtctcattcactctgtcacctaggctggaatgcagtggtgagatctcagctcactgcaacctctgcctcctgggttcaagttgattctcgtgcctcaatctcccaagtagctgggattacagacatgcaccaccacacccagctaatttttgtatttttagtagggacagggttttgtcatgttgttcagggtggtctggaactcctgagctccagcgattcacccacctcagcctcccaaagtgctgggattacaggcgtgagccaccacgtagagcctgattctccagtactcagcatgggcctgacacatagtaggtgttcaacacatgcaggctggctggatgggaggagtggatagcagatgtatagatgtataaatgagtgatgtgaatggatggacaggtaaatgaatgggcgagtggataaatgaatggaaagaagagaggtagggagggaggttgcttcagaggaagggaaaaaaccgaagtgggatgctgggcataggggtgagtggataaattggtggtgtaaggatagacagatgaatgtggtaaatgagaaaatgagtagatgaatagatagatgggtgagtggaaggcaagatggcagaatgacttcataaatagctgcttggattgggtgatttgacgaatagatggatggatggataggtgagtgtgtgggtgggtggaatgttgggtaagtgaatggatgggtacacgggcgggcagatggataagcgtatagatgtgtgcggatgggtaaataggtaggtgggtgagtgagcagatgtcaagatagtttatggatgattgcaaggattggatggttggaaagatagat

SEQ ID NO: 272 - DNA, 1034 bp, Homo sapiens
atatattaatatacataacgtatatgttatatacatactcatttaattatttagcattcactgtgtgccaggatccttgttgaatcctcaccatctctctgcaaggtagacatcattatccccattttacagatgaggaaactgactcccagcaaggttaggaggcatctgccaggtcacacaggagagccaggatttgaacccaggactgtctaactctaagcttctgcttcttgcatagaacagacctccctcttggtctctggttgattgtatgtagcactgtattaggcaccaagactgcgcgaggagcaagagaaaacccagtgtgtgctgtggacttatgtggtgctccacagcaggcacagagaagaataagagcatgagaccccttccctgctctgagaagtatcattttgaagatatatgttggccaatatgtgagcccaaggtctggtcagcttgactggttctgaaggtagggtagggcttcacttaggaaacaaaccttgtgctgggctttgaaggttgaataggagtctgcctggtggagatgggtcaaagggcattccaggtggagaattcagcatggacattatagtgctttgcgtgctagggaagtgacccggagttcagcctgatggggtgtttggtaagatcggtggggttgggggacttagagggttggactaggcagctcttgtgcgggagacctgggcaccagccaagaagagacacaggagatgggagcgggaccctgccactgccaacatgatcctacggcaggaagggcctgctcaacaccatgcagcaggggccctgggctcggccaggggtcccccagccctccactgttctcctgtttcctgtgccccacagtggtggggtggagggagctggtggattgcttggccattgagcctccccttcgtgctgccctccaggagcttcacatccacctgtctggcaccaccccacattgggccattactaactcactctgtgacctgaggcaagtcacctctctctgggcc

SEQ ID NO: 273 - DNA, 1035 bp, Homo sapiens
gaccttggagctcctggaatgcccaggttcaggactctctcctgaaagcagcaagggttgttgaaggtttaaactgaaaggacaaagagcccagagatgggtgcaagtaggcaagtcacttgagtactgtgccatgtgagacatgcctccttgatggggagacataaggcacagctgtgggattgagggcagctgacaattctttgggagctcagaaaggcttttggagggacttgaggatgagaaggaggtttccagatggcagagtgggaaaaggcacttcatgcagagggcgcaaatgcccagtggtctgaagctgcatggtaagtttggggcacaatgaggtgcctcatgagattggggcatcacagggcacagggtgggaggattaagagaagaggtcagacaggccagcctcccacccacaaaccctcctctttctgtctcccagggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaagtctccaaggggataggcaaggcctctctggcccaccagatgggagagggaagatcggggctcctggccttgtgccagtctcccagagtgtgggacataggcttctgagatcatgggcctggctcccagggcagctgccagcccaatggtggctgattcgaatgtctgcacaggactctggactctccagggggtaggaagtaggaaaggccacccatccacacatcagcacgtcttcaggacgcatgcacctgtggccagccccaaatgagaccacatctgcccttcaggtgttcaccacctaactgggggacaagacgattattcagggaaccagatgttatgatcaggagcttttacgatcaggtgctaaatcagagtagcctggaggcactgaggcaccggcagcatgggcaagatcagccaggaa

SEQ ID NO: 274 - DNA, 1021 bp, Homo sapiens
ttacactcctttaccctcaatgacacattcactaagactgcttcctctttttgctaatgacatacctccctctcctttatagccagtgtgaattagtagtaagacctgtatcctccatttccacgtcacttattccttaatttatcttatttttatttttattttttttgagatggagtctcactctgttgcccaggctgcagtgcagtggtgcgatcttggctcactgcaacctccgcctcccaggttcaagcgattctcctgcctcagcctcccgagtagctgggattacaggtgcctgccaacacacccagctaatttttgtatttttagtagagaagggttttcaccatgttagctaggttggtctcgaactcctgaccttaggtgatcctcctgcctcagccccccagagtgctgggattataggcgtgagccactgcacctggcctctcctaagtgaatttttaaagcaaatgcaccttttcatagtttcagtttgactgttgttattttccactccatgccctccatttggtttttggaatttttttgctattttcccctggagtagtagttagaagcacagacttggctttagacagacttggtattctagttaactatatttttgtctgagggtcattttattcttttgttggaaattccagtatgtgagcatgatacacacaattaaaaaggtttttgaggagttgtagagagccttagagtcaatgatttgaatgtcagtgctatgatgtaaaacttacagattagtttgaacctgaactgacacaagattgtttcatgagggctttgtttttaataactacctattatgagctgccttgttccttgttgtatgcttacttcccttaaaatgtgaggttaacaatttacattgactgatggttccaaatagagtccctaattttaaatgttcactgcatttagctttccctggtatgatctccatataggtagagtacagagagatggatgaaagcttggccaacctctc

SEQ ID NO: 275 - DNA, 1050 bp, Homo sapiens
tgacctgcttttcttaatgatgtcatttcattgatttgttgtactttttattaaggcaaaatagtaatttgtttagctgatcacctttatttttataatttatttgaattctttttgttgccatcatttattgggtctgatcatgttgtaatagaagaacaagatttgtaaggattttctcgtctacaaaatgagacttgttatgagaatcaaatgagaaaatgcgaaacccacctttatgtataaacatcttgtatttattaagcagagttgattgaacaaagaatagggtggattggtgttttatttaggaaaaaaatcagggcagctttagaccagacagacacacatactgtgttactttgggaaagtgtttgtggtgggccattttcagtaatgagtcgattatgaaatagataactttttaagcatctggaactgtttgtgtgtgtgtgtgtgtgtgtgtgtgtgtgtgtgtgtaaaacttaaatcttgataataatcttttaagttaaatcatgagaatgacagactttgggactttctaacatagtttttttttctttccttaagagaataatataattgaaattcttgcatcggctgttgagttataagaaatgttttgtaagctttgttattaaccagacacaccttaagcttggtagttggacacataacatctgaattgtaagctttctctggaacattttgaaaagtgaacacaaaccaagactgcagcaaaataagtaaggatcaggaaaatttctactatggaatgtggagggaaataatatgtgaaaaagtaaattctttccattggcttctaaagctttgcatttctccctagcttgtagggccttttactttcttttgataagatccttgctactacccagtggaagtcttcaagcacatatctgtggtgttattgttctttcagcagttcagtggaagttccaggcaagctcctgcttcaagcaaaacaatttttctttttttctaaaccttaagaaggctgttttacttcagtattttacatgatactgt

SEQ ID NO: 276 - DNA, 1048 bp, Homo sapiens
tagtaatattagtagtatatagtaaagcatttctaatgtttctgccagcaaatgtaaattccttgcattcttctgtcttattgttgtctgcttaatttctctcactgcttgccagcgttgaattatgattactaatggatgatactgttgatgggattgtgattttctgctgttgattattaaagtcatctttctgtttcatgctgtaatcctaaaagaaggcatgtgattgtgtttttcgctccacagcttcttttgctttcctgttagtgcattttcctttattctggttctttagttttaaattttattgtacacctgtcagtagtgctaattttaattagatcatctaatatgataaagttattttatggacaaagaaactattttaaatgctttgtcttataaggtagttgtttcactcagtaaagtataaactttggaatgttaagctcaaataagtggctaatatctaaggaagtttcagcttttgagacaattgaaaattttttaaaaaggtcagtctgtgagtgaggcaaaggaatttaagcgtcatcactacccgttttgtattcacttgcacttttcctagatgtcctttgctttcttcgttaggtgtggagggcgcagctttccagagccgacttcctcatgaccggatgacttctcaagaagcagcctgttttccagatattatcagtggaccacaacagacccagaaggtttttcttttcattagaaaccgcacagtaagtttccatttcagctttttcacctggattataaaaagtatatatggctttgatagagaatatgggaaaaataaaaagagaagaaagaattctaaaattatctataatactattattacccagagataacctttgttaatagttatttttcatttgggtatttaaaaaatgtatatataatttttgttttcataaaattgagatccttcttggatacattcttttggatcccttttatacttcacaacctcataaatacacattaagaatatttatttaggctgggcgtggtggct

SEQ ID NO: 277 - DNA, 1047 bp, Homo sapiens
ctgaaccagtcaacccctcccctccgcattgccctgcccatttttattaaaacagtgataatctatgctcctataattggccaaaaccatctcagttctttttcatttcttggattactgactgcttttcacattagtcatttgtatttcttctgtaaatttttctttcatatcttttattcatcaggaattcttatttagccagagagtaaatggatgagggaaaggtgctattcagaacatgctcatgttactctagggtggtacaacgcagaagaaattaaccttgtgattcagctaacttgaatatgaatatagctcagagatgtcattgatatgtctgctttttagccaccaccagcttctttgttttggctattagattgcaaaaccactgcttaatttcgattgttaaagcaattgataggttatcctgggtttttgtaaaacagaaaagaacagtgaagaaaagatggtgagttttttaaaaagtgaacagaaaattcttagtgtgtagtcgctgatttgtcttataattgaatcagtttctgtgtatagcatatcaacatttgctctaagtggatttttttttagacaaaattgtcatttttttgtttgtttgttttatctgaagagagttttcactttttacttagatttgagcgatggatttacagggatctctgtcttttctgattcaccaaaaatccagatttggggaagggtttcccgatgttagatttgtggtctctggctgtgaaacagaatgtaaatcaacctctactgcaagaattttatcagttctctagtcttaaactataatactttaaaactgcaactttaggattattgaactagactgtgacctaagtgttattttgtaggaggaggaggaggaagacttgtgttgggagtgaggaacttgggcccagtgtgtacttgaggaaatccatttaccttacagtggccacagagtagagtatctgtgtggatttggtcataatcccttagtaatttggtttatttacatatagccaaattaatttc

SEQ ID NO: 278 - DNA, 1081 bp, Homo sapiens
gtttgtttggagttccagagtactcttacattatttataatcattaaattatcgctacaactcagccatacttgaaaatccctcgtcagcagtgataaacctgggcctatttagggataaaaggtattgtgaacaggctatgttcagtatggactctctgcccctgggcatgggggtgcactggagaaccatttgtcagaaaaattatccatcagatttttccccgctaactttggggatcagggtgtaagagtcagattacagtggtagaaagttggtgtttaaatagtgttgggatttgtgaacaaatattttctatatgggtggccctgtacattaaaaggtattatagacaactggatagagtggtacctgtgactaaatttatcttccagctgtcaagactgttttatatcacatcatttaattctgtgtcgtttagttatatgacatttaattatatgtcatttgttgcctgcttctccttcaaatagtcttcaagttaaacttcatttgttctttgtgcccatagtactgttgattgcattccatgtaaactctacatctttatttttaaattatagaagacagagccgtggtatggtactatgccaggtttgtggttaaaacagaattgatgattttggctacttaatttctgaaacaggatcgtgtgggtggacgagttgccacatttcgcaaaggaaactatgtagctgatcttggagccatggtggtaacaggtcttggtaagtagctattggtttgtgctatatagtacatggtctaagactcataaaagaaatttaaagccagagatgctattttaaaatgtattggtttagaatagtcatcttccgtttagtgagaggtatagcagtatgtggaaaatgtaaattgtacatatcttttgacctagagtacctttttctagttctaggaaattatcatatgaagataagtagataatgttgtgtttgaagctttttttttttttttttttgtgagacagagtctcgctctgtcacccaggctggagtgcagtggcgtgacctccactcactgcagtctcctccctcag

SEQ ID NO: 279 - DNA, 1803 bp, Homo sapiens
gtaacataaagtgaaagccaaggattagatagaagaacaaattgctatggaagaaccaaggtggcaagagggtgtatgaaggtgtaagggaaaggacactaagagatctggagggaaggagagcatttgtaaatggcaaatcaggatttcaacatgtgtttatggaagggaaaagcattgctggcagaggaggtttaagtcttaagtagagaagtctgtaaaggagggtaggattataccagcgagggtaggaagatagaaagtttagggtggggccatgtggtggtggatgttacttgctaggcttgattgtaggttggaacttgagaggtttgagaacaggggaaatgacacgattaagtcagtgttaaaagtataatattaatagtaggcaataagtacagaattgaggtgaggggagggaagcaagtctccagagtggctattaccgtcctcaagaagtgataagagtccacagtaaagattaatcactgatcattgagacgccatctttttctttagacttttctgaatgtagagcaggttgattaagtctttctaacgtaaagagagaacttttttctagtagagatatccagagaaatggactgctttcttggtattagatgagctttagcgcattttttaaaacatttgtttctgtaccactgttgtcctcaggtggggcctgcactggctgccagtctgtgaactgtcaattaccagtgtggaatgagataaagaaattacaccactaaccacactgttaattcagatggtgacttttttttttcctggtagcaaaactctcagtgaagaaagtggtgcgttgatttatccacatcttaccaggaccagccctttgagtagcactataaacagttgttaacctcatgtgtggtttttagcattttgaatgcagggatatttttcccaacgaaattggtagttgtcattcaactctgatctgtataggatttttctaagttgatacatttgtatttggtgcagtagccaagtgataaggaagattttaaaccattctcaaatttgggaagggattctttgcagctttgagttatgcttgccttagttaatcaaacataaggcatgctaatatttctgtactgctgtctccagtagtctgtctcagagcaagaatggaaaactgttgactaataaactagcctttttttttttttttgagacagagtcttgctctgtcaccaggctggagtgcagtggcacaatcttgactcactgcaacctctgcctcccgggctcaagtaattctcgtgcctcagcctcctgagtagctgggattacaggcatgcgccaccacgccccactaatttttttgtatttttagtacagacagggtttttccatgttggccaggctggtcttgaactcccaacctcaggtaatccacccaccttagcctcccaaagtgctaggattaccagcatgagccactgtgcctggcctaaactagcttttgaacaagcttaaaggacaagtacaaagagccccactaatttatgcttataattacaaatacatttgatggctttagaaatctaaagagataggtcagtagctttattctcttattgcaggagaagaaactaaagctcacacacgtgtttgcctaaggttatcataatcagtaagttgaagagccagaatccattgcctggtgttcttgttcagattcccatacttgtttgactacacctggctgacatttcagggaagatggggtgaggttagtgtatgcacctctttctaactgcctgtgtg

SEQ ID NO: 280 - DNA, 1061 bp, Homo sapiens
ggtggctcacgcctgtaatcccagcactttgggaggccgaggagggcagatcacgaggtcaagagatcgagaccattctggctaacatggtgaaaccccatctctactaaaaatacaaaaaattagttgggcatggtggcgggtgcctgtagtcccagctactcaggaagctgaggcaggagaatggcgtgaacccaggaggcagagcttgcagtgagccgagatggtgccactgcactccagcctgggcgacagagtgagactctgtctcaaaaaaaaaaaacaaacacacacattatgacaatttgtttccgaaaataagtttaagttacattagcaacagtttcctttttgtggagattaaatttatttcaatactgggttttttctttgtttgtttaaattaatgggacactcctcatccttctcattcgttttagaaggcagcactgatcttacttatcagatagagttgtggtacctttatgtcaagccctataagatttctttcctatttcccaaatggaatgatgtaggttagaacaagtacttaagaattctcaggaccttgcattgtagccctgttttgttgggatagcagttttgaggagccaaaaaagggtacatgtgatgtagacataaactacattgctatctggaatggtaaatttgtatttttccttcttagatggtaaatttgaaagagaaaattaaagaactccatcagcaatacaaagaagcatctgaagtaaagccacccagagatattactgccgagttcttagtgaaaagcaaacacagggatctgaccgccctatgcaaggtgtggtatacatacatgcctaactggttttacttggaatcctaagaaatagcacagatctggggaattttggaaaagagagccactagccaatcacaagtgccttcagtgcaatgaagacgatttggtacataaggagccatggggatttaatgggttagttcggtttaagacctgcttgtcctgcagaattcttatcctgtcttaataatctcatcattttatcttaaatctcaat

SEQ ID NO: 281 - DNA, 1029 bp, Homo sapiens
cttgctccccatccccagttctttccattactcctcactgcccagtggtgaatggtctttcacaccccagagcctctaacttcacagagggggaacttggctccctgagcacattgctttctgagagcagcagcgtgtcttttcccttccccatccaggctgtcaagtcctgtcagtgctagccttacaatctcttgcaaacctatttacttttttctattgcctacctcccagtccaagccattcttacctgttgcctggacggttaccaatagctactactgctattcctgcttcttttagtgactttctactgctgaaagaaaatgttcaaactccttatcttggcccatgctaaggttcttcattatctagctcatctctacttccttgtccatccccagattccaggcacattcggctgttctcacatcctggaaggcaccatgctgctttctgcctcagagcctctgcgtgtactgtggtctaggcctgggggtgctgcttctcccaccccctcgacccccttccttcccaacctgtcttactcagcattcaggtcttgacataaatttcaaagtatttcaaagacgacttccaggacacatctccactgccccaaatgtaaattaaataccccatattcttttccgtgtagcctacgtttttcttcatagcttttaagttaataattgtctgtgtaattttgcatctgttgctctattggagtaatagtttatatcatattttttatcccccttttctagtactgtgcctaccacctaagtctgttgcataattactcaccggatgggtgactgaagacagtcctgggcttggaggggcctgggatggctaaaagggatgtagtcattgtcatggagctatccaaggtagtcaaggttaagaattctgtgccaaagtaaagcgatgcttaataattcccttttattagcaagatctgaaattatatcttcagaactgctgtattttgccaggttagaagcagtgaggtgcctgagaatctta

SEQ ID NO: 282 - DNA, 1050 bp, Homo sapiens
tacaagaataaaggtatatgtgcagcctgccaattttctctttttcccctaaaatagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacag

SEQ ID NO: 283 - DNA, 1034 bp, Homo sapiens
gggaggcttcacggaggaggtgacgtctgagctggtaagactgtaggagtttggaggtggagaaggtgggagggaaagcattccagtcttcaagaacagcatgtgcgaaggcacggaggcgtgaaaggccagagcatgttccaggctggtcaggattggttatggctagagggaatagtgtgggggtggagcagcagggggaggaagcagagcacggagagtctcctatgtccccttgcctgtctccctgtttgtctctgcctttggctgtgaatcgcaatgctaatgatgaggtaaagatgcggggctgcccagggactggcctggggtgaggcagcagattgactctgcagaggagggggaagtggagatgattgggaagctcttatgacctcatgcatttcagctggttttctccaaaaagaatcaatattttctaaaaatgtagacaattgcattaaaaatgcaatacaaacttatttagtattatttggcctacttaaagatatcaaacagacccatactcactgaaccctattctgtagcagctgctgagctgggaaataggacaccacccctcacgactgcagggctgctgcgtggattaaatgtgagaatggtacagaggatggccttggcataccatggccatcactattatggggggaggaaaaacacatcacagatgttctgtgaggtgaacatattgcaaagtggctcagagcatgacctgggctctgggttcaaatccaggttctttctccaaaaacaaatgacttggctcacgcctgtaatcctagcactttgggaggctgaggtgggcggatcatgaagtcaggagtttgagacaagcctgatcaacatggtgaaagccgtatctactaaaaatacaaaaattagcttggtatggtggcatgggcctgtaatcccagctactcaggaggctgatgcaggagaattgcttgaacctgggaggcggaggttgcagtgagccaagattgtgccacgcagtccagcctggacgacagagtgag

SEQ ID NO: 284 - DNA, 1059 bp, Homo sapiens
tgggtataagaaatattacttctgctagcttgcttccctttggtgcaaaaatgaaaatactttccctgtggtgattgtcttttttttttttttttttttttgagacgagtcttgctctgttgcctgggctggagtgcagtggcgcgatctcactgcaagctctgcctctgggttcacgccgttctcctgcctcatcctcccgagtagctgggactacaggcgtctgccaccacgcccggctgattttttttatttagtagagacggggtttcaccgtgtcagccaggaaggtctagatcttctgacctcgtgatccgcccgccttggcctcccaaagtgctgggattacaggtatgagccatcgcgcccggcccctgtagtgattttctatatctaactgaagtcgatgctcaaaagccgccatttttgtttgtttgtttttggtggtggttttttttgagacagagtctctttgtcacccaggctggagtgtgcagtggcatgatctctgcaacctccgcctcctgggttcaagcaatcctcccacctcggcgtcccgagtaattaggattacagccatccaccaccacgcccagctagtgtttttttgtagagatggggtttcaccatgttggccaggttggtcttgaactcaccatcccaaagtgttgggattacaggcgtgagccactgcacctggcaaaagccatcatttttctgacgcaatacttggccattggttcatcattttcaatttcaggtttaaattttggagcgcatgttaattcagttagataatttactaatttgtgactaattagagttcagttgtccttgggccacccgttcattgctgttcagaggttctcaaatttgctgcttttgtaggtattttgaaacctggaaatagattatttggtgtgcctcatttttaaatgaaaataaagttaccttatcctgtaagatgagctctagttggtgaaaggggagaatcgtggaacatgttgccatatactttttatttcatttaaaatatgagcttttcatttctcaatcttt

SEQ ID NO: 285 - DNA, 1095 bp, Homo sapiens
tacagttgcatgccagcatgcccaactatttttttttttttttttttttttggtagagaaggggtctcactgtgttgccaaggcaagttatccatgttctgattttggttctgctttccctgctagcgttacgaccatgggcaagaaacctggcaagttacagtctggccctctaaagtggagtatgttggatttttgcgtataaccctttatcttctaaactgtgtgcttaagcttccttttcttgcagtttaacactctggctagtcctaacctgctaaactcaacgcaaatgctgaggtgctccagccaactggtggttgaagaccagaatgagtagtctaccaaaggcaactgagtgctacagggttaaggcccaagccttctaggtactctggcccagaaaccacccacacatagtttaagctgccagccactggggaccatgctagtgcctggggatacagaactagtcagagctgcttgttatggaaaccacaatgtggttgtcagaggggaatccagcctaagatacctggagggcaccaggagaactgaacttgactctgcttaaggtggcaaatgcaggaaagcttaggaaacaagtataaatggtttattttcacaaatcagtgaaccaaactgatgtgtgatgataccagttgacctttaacgattttaggaagttttgtaattaccttttgtcaagattgatacttttttttttttttccctgagacggagtctagttctgtcacccaggctggagtgcagtggtgcagtctcagctcactgcagcctctgcctcccgggttcaagctattctcttgcctcagcctcccgaggagctgggattacaggcgtccgccaccatgcccagctaatttttgtatttttagtagagacagggtttcgctgtgttggccaggctggtctcgaactcctgacctcgtggtccacctggctcagcctaagattgatacaattttttatgcaataagtatgtaagtagttaacctggaatctaaaaggagcttgaaaggcaaaggcattcaacaataggcacaaatgaaattctagaccctctcagttacc

SEQ ID NO: 286 - DNA, 1034 bp, Homo sapiens
aaggctgaggcaggagaatcgcttgaacccgggaggcggaggttgcagtgcactgaggttgtgccgttgcactccagcctgggcaacaagagccaaactcccatctcaaaaccatatatataatataaataatataatatataatatatacaatataaatatatatagtataatatataatatacatattaatatataatatataaatatataaatacatatataatatataaatatatattacataaatacatatgtaatatataaatatatattacataaatacatatataatatataaatatatattacataaatacatatataatatataaatatatattatataaatacatatataatatataaatatatattatataaatacatatataatatataaatatatattatataaatacatatataaaaatatatataaatacatatataatatatacacagattcctgaactcttctcagaaacttggtttttgtagggctcaagaattcacattcttacaacactgaaggttgagaatcattgttttctcaacagcagtggctttcaaaggtttttgactacagttcacagtaaaaaaaaaaaaatcccttcagagtagcggaagggcaaaaaatgtattttgtatatcactacatacatatatactcacctctggaaaaagcttcatgaaacaaccttactacaggtaatgcagtcctattgtatagttgtttacttttttttcctaatgctgatctctctctctctcttatttatttatttatttttttgtttgtttgtttttagacaaggtcttgctttgttgtccaggcaggaatgcagtggtgtgatctcagctcactgcaacctctgcctcccaggttcaagcgattttcctgcctcagtttccttagttgggactacaggtgtgcatcaccacgcccggctaatttttgtaattttagtcgggttttcagcatgttggccagtctggtcttgaactcctgatctcaagtgatctgcccgcct

SEQ ID NO: 287 - DNA, 1132 bp, Homo sapiens
tagccaggcagaggccgggcatggtggctcatgcctgtaatctcagcactttgggaggccgagacgggaggatcatctgaggtcgggagttcgagaccagcctgaccaacatggagaaactccatctctactaaaaaaaaatacaaaattagccgagcgtggtggcacatgcctgtaatcccagctactagggaggctgaggcaggagaatcgcttgaacccgggaggcggaggttgcggtgagctgagattgcgccattgcactccagcctgggcaacaagagcgaaaactccatctcaaaaaaaaaaaaaattagccaggcatggtggcgggtacctatagtcccaactactgcaggagaattgcttgaacctgggaggcagaggttgcagtgagccaagatcacaccactgcactccagcctgggagacagagcaagcaagcctttgtctcaaaaaaaaaagagaaaaaacaaaaagaaaaattttttaaaagtgtgtccacggccgggcgcgctggctcatgcctgtaatcccagcactttgggaggccgaggcgggcagatcaccagatcaggagatcgagaccaccctggctaacacggtgaaaccccgtctgtactaaaaatacaaaaaaaaattagccgggcgtggcggcgggcgcctgtagtcccagctactcgggaggctgaggcaggagaatggtgtgaacctgggaggcggagcttgcagtgagccgagatcgcaccactgcactccagcctgggtgacagcgcgagactccatctcaaaaacaaaacaaaagtgtgtccactaaagtcacttatccagtaacttttttttgagcgtctaccatgtgctgggcactgtttaaggggcataggatacatcagtgaacaaagacaaagatccctgccttggagcttacattctaatggagggagacagacaataagcaatccacgagtaaattacagagaatgttataggatggtatgtgtgttgggaaaagaaaaagtagagtggggtgagggggtgaggaaaggctggtcagaggaggcctcactgagaagatgagatttgaagtgggtaagggttgggcacttggatctgtgaggaggagcttttggag

SEQ ID NO: 288 - DNA, 1060 bp, Homo sapiens
actccagcctcagcaaaagaacaagaccctgtcttggccgggcgcagtggctcacgcctgtaatcccagcactttgggaggctgaggcgggcagatcacaaggtcaggagatcaagaccatcctggctaacacggtgaaaccctgtctctactaaaaatacaaaaaattagccgggcgtggtagcgggcatctgtagtcccagctactcgggaggctgacgcaggagaatggcgtgaacccgggaggcagagcttgcagtgagccgagatcgcaccactgcactccagcctgggcgacagagcgagactccgtctcaaaaaaaaaaaaagaaaaaaaagaacaagaccctgtctcaactcaaaaaataagaataataatagtaataaaaagagttgtgaggaaacaagaggaattggcaaaggagaaagagggaccggtaaagtaggagataaaccaagtgcctggtaacctggaagtaaagtcagggtgtgtgaaggaggagggatgatgaactgaggtgagtgctcccaaagagtccggtaaaacgaggactttgaattaggcattggacttcacagcatgaaggcctctcgtggcctctctggagcagtgctgccagggtgatgggccagaaagcctgagtatagtgggcttcagagagaaggtgaggagagtgactggggacaactggtagacaatgcttccaaggagttctgctgtcaaggggaacaaaagtgggaaaaaaactttctatgactgagaaaatccagtagagagaaaaattgatgtgggagaagggagacctgcagtagcaatatccttgagtgggtgagaagggttggcttgtagcacacagagggggtttagacttggatagaagcgtggctggggtgttggtgataagttgggagcctgcctgtgtgagtgcacatgttggctggtggtagatacgggatggagttctgtggatgtgcccggccgcctctcaggcctcttaatgctgaagtaccctaagattcagtcctgggttcagttctcttcagttctcttcgcattgct

SEQ ID NO: 289 - DNA, 1053 bp, Homo sapiens
tatcttgaggtcagctgattagcaatttttattgtattaaaataaataaatttgtaatataaattgaaatgaggtcttgcaatgttgcccaggctggtctcaaacctctgagttcaagtgatcctcctgcctcggcctcccaaagtgctgggattacaggtgtgagccaccatgcttggcctgattagcaattttaattcccccttgccatgtaagataacatattcacaggttcctgggatcagggtgtggacacctggggtggggaggggacattattctgcctaatgcaggtgggaagaacagcatgtaggttaggggctagttctccttgtgccaccacatccccaagaactcttaggaatctgagaatgttaaatttaaacctagccccaggtcattatgaaggtatattcatcgaagtaagagaacagaataggataggatagagtaaaaactgtatttaatggtttgttagtttttaacttttaaatatttagataaatggtatgtgggcctctgtatacacttttgccatcagccatgcaaatattagaggtccgtctaacccaaagtcacatagccggtgaggagtcaaattagaacacagatgtgttactttcaccacacaaggcccctcttcaaggagaagtaaggcactgtctttctcagcttcgaggctctgtatctctgcctgtttcctggtggttacaggctatgtgctctggaaactcctgctgagaacctggcctcctagcccttctgaagctgcagttcttctctcacaccgtgtattgccctatgcggatacctctcatacagaccctccactgggccgttcaagtccacgtacttatgggttcaccagctagttagtgcccccagcagggatacagagatggtttagtcacagtccctgcttgcaaggagctcacagtctagtgaggacatcacacaaagaaatggacagtgacgaccacacgagagactcctccagtgatgggtgcacgataatctggggcagatctggggtggggttaggtacaggctgct

SEQ ID NO: 290 - DNA, 1058 bp, Homo sapiens
attgtttcttttcattttggttattgagctctctctggataacatctgcagaatgtttcatgtgtcccgagtatgtgccaggccaattactcagcaattctgcttcaagaatcagtctgtattccattacaccagtggtacattttcaaaatggaaggaatataaaatgtaaaagtatttgctacgcagaggagggagacactactgctgggactagaatcgaagttttctcacacccagttcaatgccttttctacaacatccctcagttgagccttagggtaccaagtggatggtcattagtcttgtatggactttatatccaatgctgattataaggtctagatgatgctaggtggcagagattcaaagttggacaggtcggttactgtacttgataaataaacagcccagtggcaagacagataaataaactgaccatttacaccctgaaaaggtggtcagttgcttagggaactgggggaggggcgccaaatggaggagtagggacatggtagagagggcttttcagcatagtgagtgaatgaatgctcatttgaagaaacaacttgtgtttaagatgtttttctttcttccagagctagaatctggaagaatctctgggctttcctgctttgagggagagatcaggctaggtgcattgccaatttgctgctgaagatctgattaggttctgctttgatgtgatcaaatgagatgtaatcagtgctggtactttaagtgagtttgcaactatttagttgctctttttagtagtagtattagtaatggtaaaacttagtgcttttaggatgagagtagacggcctgaagaataatatcttgggctcttctaatcaagccatacggctcattggcaagtcatcagaggaaacatctatctatctatacattcatgcaataagtatttatttagtgcctatgtgccagacactgtttgtggggaaaacaagacacatgggctattattgcctcatggaaggaactaagctgtttggattttgaaaaatccctttctctgggcctcaattcctcgac

SEQ ID NO: 291 - DNA, 1023 bp, Homo sapiens
attttcatacttgtaaaatagggatattacttactactgtaaataggcataatacttatactcattactgtaaatggttagcactaagcacttaataatcagatattcttgttaaagtgaatttgactattgaaattaatgttttcttctctgcagctattgaaatatttgaagaaactctccaccctgcctattacagtagacattcttgcggtaagaactgtgtgactttaaatattatataatgatatcccattcccttctcactggagagtgtgtagaataaggttacaagtatgggctttggaagtgaaagaaaccagacacaaaaggccatatattgtctgattccatttatatgaaatgtccagaataggcaaatccatagacagaaagtagattagtggttgccaggggctaggagaattgggaggaacaggatttctttttagggtaatgtaaatgttctggaattagatggttataatggttatataatattgtgaatgttctggaaaccactgaattatgtactttagttaaagtggtgaatattgttaaatgactttatttcaaaattagaattaaaagaacattgactttggcatcaattagtcccagattcaaatctgagttctatgactttaggctgttcctatgtaaaatgggtctgattcctgcttcacagggttattgtaaagactgattcagaactgtatgcaaagctcttatcttagtgcctaacacctgccctaatcactcttgttattaaagttctgaacttggtacgctttgctactgtgtgtcattagagatttggggcatagacacaaagtaatttagtgttaagatttgcagggtatgttgtaggaaggaagtattgcttgttgagtttctcaaagtagaaagccttatttctttagaaaaacgttagcctagttccagacccctctaacaattactttgtcaaattttaggagactggggttgggaaaacagtaaatagcttgcgaaaacacgagc

SEQ ID NO: 292 - DNA, 1029 bp, Homo sapiens
attttaacatactactaagatgaagaccaaaaaatttttgggaaactggtcactcctaggtaattaaataatcagaaaaagatatgaggctgggcatggtgacacacgcctgtaatcccagcactctgggaggccaaggtgggcggattatctgaggtcaggagttcgagaccagcctggacaacatggcaaaaccccatctctactgaaaatataaaatagctgggcgtggtggtaagcacctgtagtcctggctacttgagaggctgaggcgtgagaatcgcttgaacccaggaggcaagggttgcagtgaaccaaaattgcaccactgcactgcagtctacacgacagagcaagactctgtctcaaaaaaaaaaaaaaaatatggaaaagtgcttgtacacaaatgatgtcctggttctggtttcaggtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggtaacagagacgggagagctgggggagaactggcaggatgagtgttctggtcaatagcagggtgttggtgggcttggctggtgtaggactgcttgcccctacatcaggtagcagggtgggtatttcttctgccaccgcccattctaccctacaagtggggtttcagggcactcaaaaagcccgtggattatttaaataacagtagcatctctgctcaagaaggcagatgttcatctccataattccacaggccgacaagcaaagatggcctttgtcaactctgtggccaagccacctcgtgacgtccggaggaggcaggaaaagtttggaacgggaggagcagctgtccctgagaaaatcaagtaagatctgtgttcttacctggcttttgtgtgctatcaacccttagaggtagcca

SEQ ID NO: 293 - DNA, 1033 bp, Homo sapiens
gcattactttacttctcttggttacttgtaccaccattccacccctatccctagcctgccccacaaatctaatattaggaagcctcttaactgaaaccaaatgaacatttgggtcaggtgccagatgtctgctgcctagaatagctttttctaggtgtctaccaccttgaatttatctcttaactgtgtgttcaagtctttgtcattgaaactagtttttcatatcttagattcagttgtgtatgatttaatgtcccttattaggagtctttaggcagggagggaagaaaaaacagatttgttcatagcaatgtcagtatccattttggcacataaagatttttgatgagccctgtttgcatagagccagatgttttcccctcccccaagagtatctacatcagggatgtgacttggtgcgaagagtcaggggaaagaggaaaaacccaatttctaaatgacctccttgcccagcttactaaaatggctgcagagcagacacaggatgaatttgaacctgacacaggatgaatttgaacctttggtctcatttatggaaaaacttgtgcaattttttttctgtgctacactacatacaaatcaccaaattacaaattacccttttgtgatccttggtgtactgagcagtttctttggggctttttctttctgggaagcgggagggaaaggagcaaggtgtcatcctgctcttcatttgtattttggtcccaaaatgtaaatacaattttctatgttacttttttgtggtaactaccgagatgaatattttaattagataagttatatgaaaaggaaaattccatgtctaaataaaaaacaaactccatatactgtgtcttccttacttatagcatcagtggaaagaagttagaaaatgcctgattcttggactgtttaaggcagagtttttttttttgtttttttttttgagatggaggaggcaatctcagctcaccgcaccctcctaaggcagagatcttaatcagcatccttgggctgggccttaaacgat

SEQ ID NO: 294 - DNA, 1048 bp, Homo sapiens
cccaggacagaacctgggtgctgtgtggggctgatggcctggtggcctcttgggccaggagtgtgtcctgtgcctggttttgctcttgaccgccgccccgatgtatgcaggcccccgccgtggagccgtgtggtgtatgtgtggtaacaccatgtctgtgcccctgctcaccgatgctgccaccgtgtctggagctgagcgggaaacggccgcggtaagggtcccctttcacccacggccagacactgtgggagcagctggaggaccggctggagggggtgtgggaaaatggaggtggcagtgatgagcagggagtatcctgaggccagcaggctcggggtagtaacctgtttggctgctacctgggttcccccaggtccttgggggtgggggaggggtgggcagaagttggaggacctaggggaagccttcctgtctccccatttcccatccttttccaggttatttttttacatggacttggagacacagggtaagtgactgaggaggggtgctccttaaggaggggtcctggcccagcagcggactggagaggccttctcttcctaccacatcggagccttttctcccgtccctcctacaggcacagctgggctgacgccctctccaccatccggctccctcacgtcaagtacatctgtccccatgcgtgagtgtcaccccagcaagggaggggctgaggctggggatcatctgggggtggtcctgtcatcccaggcctgttctctcctgtcagttgcatcctggggcttgggctcagggcagtcagaagtggcattttcagcctgagctcctgtggagcccccaggagtggggtccagcaccagcccccagccctagggcctcctagacctgagctctcctagaacccacacctccctttgccccttccccaagtactcaccgactacctgggaccccgtcacaccaagcgctgggctctgcttctccattactggcgctttgccccaaccacagcctccagccccacgtggcaggttgcctggcaacaccttaaacacaggcc

SEQ ID NO: 295 - DNA, 1027 bp, Homo sapiens
cgacccagaagccgaggcccgaggcgggagggggctgcgccctggcaagaggctttccggagtatcttccatctgtcaatacaggctacaggactcagtggccctaattcgagaaccaaacgtcccccgccggtcagtcttttcccccagggcagtcccaagggcggcgagcccgcgcgcacgagagccgagcggtaggaagagccgagagctagcggccggggcctcggcgggccaggggcgcggagaggccgccggagaaaggactaagacaccggtggaccgagcagttactcccggcatgctcctcctccccgggcagatttcaaaccctctgcagccccacctccgcgccttcgcccccggccagccccagcaacaggcggcggcccgcttctcattggccaggcccgcgctgtcgtgttttgattggccgcggagcctcccggccctgcttctgcagtcgctgccgactccattttgtcggtagaggcagaaggagaaggtcgggttgtagaagctggggtggccggcagctcgctcatcggtgttcgtgggctttgtcggtccgtgcctcgtctctccctggaaagggagggaggcttcgacgtcgagagggagccgctgccgcgttagttccgagcttgaagtcagtaagtagcggctgcgctaagggcgcggccatgttggtggccgcgctccccattgttggaggaaggaggcgagcggaggcgagatccgggtaacccgggcgggcgcgggcggtcacgggcggtcgcagcgccgcgacccctgcggctccggagagatggggccactgggaagccaagcccttgtggcgtcggaggaggcgttttccgggttcgagttgggaattactcacagtccggaaatggcaatttatttagggttgtttatctgtttggaaagctctcttacccctttgaaaggagggggcttaactatttggtaacttattttcttggaacatcaaattaaaaccaaaccttgaaagttaagctgttcc

SEQ ID NO: 296 - DNA, 1048 bp, Homo sapiens
taaattgtatttaatacccttaacagtaatatctgaaatgacaaaatataaaatgtttatattatggttatctatagatcatcagttggatataaaatatggacagaatcaaggccagatatgatggctcatgcttgtaatcccagcactttgggaggccaaggcaagaggatcgcttgagaccaggagtttgagaccagcctgggcaacagagtgagacctcgtttctattaaagaaacattttttaagatatgggcagaatcaaatgtttcctttacatttttcttctatcagtgtcttattttgttgtagtttctcctgaaatcagctgtttattcaggttatctatgaatgtgcaaaaaataaaacagttgcttttgttggattacaggcagaataatcccgattgcaattaaacactttaatttcaaaaaataatttctggctgggcacattggctcacacccatagtcccagcactttgggaggccgaggcaggtggattgcttgaacccaggagttcgagaccagcctggccaacatagcaagaccccatctctataaaaaaatttttttttcccagcttgaaaaagtttttgtctttataagcttctaactattggagtaagcttttacattcttccgaatagtagaataaataacacaggtgccattatcatgtaaatgtaatctttgctctagatcattagattttggctctatgtttttatcaatatttcttaaaaatagtgttggagggataataaatcatagaaaaataaactgtaagaaaaataggtggagaaaaggacttatctttcaatgtatatttctcagctatagggttgttaattttatgcatgtactctgctaatcaatagctccatcaggagtgcgacaggcttagtgcttcatttttctttgacagatttggatttgtcccaatgtgattgtatttgcttgtttgctgtctttaaccccagtttttttttttctctgtcttttaaaaaagcaacagggtcttgctctgtcacccaggctggaatg

SEQ ID NO: 297 - DNA, 2070 bp, Homo sapiens
aaaaaactaagctaaaaggaactttggtagacagaactctaacttgagcatttttttttaggattgtgaagttgtacttaattgtttctatgtttcatcaggtggacatgagcaaagtaaatttggaggttataaagccttggataacaaaaagagtaacggaaatccttgggtttgaagatgatgttgtgattgagtttatattcaaccagctggaagtgaaggtactaatatacaaatggctcttgtttctgaatatgtgatataatttgtgaatctttggaaactgaattttttctatggagtgcaaatatagaagggttattttacaatgtttgttgtgaaaagaattcactttgtaaacaactattaaggctggaagtttagtgaaggtgcatagttttgaaagctacacaggtgaaaaatcaaacttattgtttgtaattttgctgttacatgttaagttactttgacagcaattttctaatgataatgtgatttatgatttaaaaggcctgaaccaaaatggaagttattccttgcgtctgaagtatagcaccatcaccttattaggtcacagcagagtgagtgtcccaatgtcgctctgacccaactcccttgatgatgcagtgtgtgtttggaggtgagttgtgtaaagtggccaaacatcaacaacaacaacaaaaaacacaaacaggaaagagcaattgggtaaagctgtacactgctcttttaaaatactattatgagatggacatttatgtgaagcatgaggggcaattctgatttgattggatattgtttttaaaggaactaaggtctttgtagctgcatgtcagctagtcatcagttacattttagagacaggatttttgtttatacttaaacttcagacaaattggcagcatataattgttcctttatacatgagataatatgatgatataactgatgtttaagaacattcttattgtaagacagtttctgttttgccacagcaacccaaaggacagttaagatatgtaccatatgacctttttgcatatataccaatgtgaatttacttttacattaatcatttcccccaaagagttcaccctatgttttgacagaacagttggcatttcaactgataaggtatttctagttttaaaataatttggtgtttgtattttgttttgaatatttttaaagactaattttaagaatgcactttctataaagtatatgcatcttagaaaaccaggaacaggggagaaagttttttaaatgatgattgaagatagattttattggagaaatgctttactgatgtgtattttagtgcattttaaaaacctaagtatctggtagtattccccttgtagtgagcatgagattaaagtttagaactttttaagacaattctttttttgtggttgtgtactcattattgcttgttcgtcttttgcaatttagataaatgatataacattaaactcaaggtggttgagttgcagtagggagtcggaagcaagccaagggaacatctttctctacaggggacttggcgattccaaacccccaaggttccaagaagaaactgaagacacctggaatctgtacttgctttgtgctattgagctgtgcttgttatacagaccttgttgcttgaccaacggatttagcatttaaaaacccaattatttttgagaaatcttgacctcttagcactttgtggacagttgagaatttgaggcattgttataatagattttccttatataaaactcaggcctttagcttagccctcagaagttacagactgcatgcataacttgttagttttcataactggacaatagatattttatgcaaagctatctgtagtgttagggagcagtttatgtactttttccgtttctcattgggggaaaatttccaggcaagcaaatacttttcttgttagtaaatactagaatttgtggatgtttcatgatggtttttaaagttaataaatgtaaggcccactaacagccacagagtctaaaaatacttacgaaatccacaaaggattaacaggctgctctg

SEQ ID NO: 298 - DNA, 1032 bp, Homo sapiens
cttttcttttctgtaatgtcgatttgagagtattggccaggctgccgagacaccttaggtagtatatgactcagctaggatcttcatgtagttttgctttgctgtactgtatttaaacattcagttttggttcactgctcctccctccaaccaaacattgagtttagaatgtcattttcccagtctagtgatttgctagatttttacaaattcttaatatgtgagtgcatgtagcttaaaagaaatttgaatttaacactgaaaggtaagcataaggatttttggtttgttgtttttttgagacacagtttcagtctgtcacccaggctagagtgcagtggtgtggtctctgctcactgcagctttcacctcctgagttcaagcgattctcatgcctcagtctcctgagtagctgggattacaggcgcacaccaccacatccaactcatttttgtatttttagtacagacgggattttgccatgttggccagacttgtctcgaactcctgacctcaagtgatctgcccgcccttggcgggattatagacgtgagccaccgtgcccagccagcataaactcttaatatgggcaatacagatgaactcccagaaagaataaggtcaatgtgaaagtgattttcttttttattttattttttatttttatttttatttttttgaagtaagcttgaaaacatctctttagttcaggtcttagagattaactttcagtgaatatttatttgtaaatgagtggcgataataccagtcttaatgcgtatctgtagtgtaggtgaagaaagaacaggtctggttcaaaagaagaggccgatgaaatgataatagcattggtgtttaacacacgtagaaagtagtcttcagtttgttctcaaatgttcaactatgtgtattttgaaaacctggtctttgcagattgaacaagaaaaactggcatctatgaaaaagcaagatgaagacaaagataaaagagataaggaagaaaaagaaagcagcagagaaaaaagggagcgg

SEQ ID NO: 299 - DNA, 1624 bp, Homo sapiens
tttcttccatattgctttagttcataacagttaatttgggtttttaaaaatgtactctgactcactttttctttccatttcctttcttctaaaaagaaatctgtactcgaaatctgtactcattagccgttcatgtaatacttacctaattccctgttctgcttttcttagatggttgtactgaacccaaacttcagatcatttatttgttttcttcttccagtgagactattgttaggttcacatttttaaatccacggctcagcttctatatttgtggtgaaaggtgagaactccattaggctttttatttttagggttctgcttatttctttcataaatgtctgctggaattagtaaagagaagaggtaatttctttgtccctttcatttatatatttgatactaaaatctccttatggaagtaatatttatagagctaagcacaaattgtcatggtggtaactacttgactattgatgaagtatgtctgccattttccttctgtgtgaataagagaaaaacccttcgagttaggcaggctactgttaagaaagagggcttctcctctcgcaaaaaagctatcttctggatgtttgatgtatatttctcttttctgaagaacatgttgctttaatggtattagtcatttttctggcatactgaggctcttcctgatgaactccattgtaatctgtccgcatctaaatgttttatgtttgggagtttgatttgttgtcaaggattatcattgtttgctttaaagcatcctctttgcctctgaaaagttggtcttttgatctctgggaatgattaagaacctaagtctagagtcccaagttagtgcttttctcccttataactgatatactcgagaatgttatctttcatttgcttgtctttctcttccctgtcaagtagattaggttagcatgtcttatttccatagggaaacatctcagatataaacagtagtgtaactaaagattaatcctcacttctccctttgactcctctcttccaatccatgttatttaaaaacctgaaaaaaattactttcatcctagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactaggcaagtatataaaaattcatttataaataatcacaattttagattaatagtgactgcaaatatgacatctgagttaaaataaaactacttattttccttttagattttttaaattataaaattagtttgttgaaaagaaattgtttaggagagtatattagaagaaaatgccccagagggtgaccattactatcttttggttgtattgtttcaggtattttatatattgtaacttgctttttttcctcaacgtattgtggacaacttcgcacttttaagaaatgtatgtggttgccagatgcgggggtgcatgcctgtaatctcggcacttggggaggctgaggtgggtggat

SEQ ID NO: 300 - DNA, 1026 bp, Homo sapiens
ttttataactggagagagaacacagacagaagtatttatcagattaagttgtttatattaatctcagaactagctgtttcctggcctaggttatggttttttcccccattcttttggactcatttatgtgcttagctacataaactcaaaagtcggattaaaatagctgtatttttgtgtaaactgttcatacctgtaaggccgttctttataagtgtgcaattagtgaatatgaatactttattccacagaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaaggtaaaaatcaaacacatatgaaacatggtctctctttctttggctacaaagcgtagtcagttattgccccctgctcactctcaaagtatgaaatagctagataatatttgtatctaatactctctgtaggtttacttataagcctacctctttcctgctttaaaatcttggggcttttttatgtgtaaaagggttttgtttttagcaatgccctgtggcattgcgcaggtggagaaatcttttaccagccgtgggctgtttgagttggggtaacatatcaaagtttgcgttggcatgataagggatcattttattactatgagaccagttaacttttttttctcctgaagatttttggtttgatatcttaaataagaggacttcatattctcttttagttctttcttggtcgcattgcgctcccaagcaaaggacatggtgtcctcttaaaagctgatttgtttttttaatttaggttctaggcagggttcttctgagtg

SEQ ID NO: 301 - DNA, 1068 bp, Homo sapiens
ggttagaaacaaagaaatggggatgggcaaaattttcattatacattttaatgagcttgatgagaccagcattgctaattattcaccctgttgccttatctccccactccccaaggctgcaatgtggtgatacctagaaaggcaaattttgctttccttttttgtatctgtgacaatgaggcatagataagctgacagagtgaaagggtgaccagcagattatgatagtctgtaaaaagtaatgttttctgaattgtgacatttttattgtagtgataggttcattaaataagacatggccacttttgttggccccttagagaagcagctagtgaaagtagagaagcctgtaactgttccaggttcagtcctcagtttgagagaggggcttcgggatcactgttttcataacctcatgtaccatactgcttttcagcattgggaaaatttcagtccattttcagttaccatgtccaaatctgatgcccatggccctggcctattttgtcttttcctgtaaagtttgtacttctgaatatttattctttgtctggagccacaaagctctccagggaaaaaaacaagtgtttttacctgttactttgcaaaaacacatcaagtgatgatttttttctatttatatcatatagcctaagagttgcaaaagtacctgaacagagggaccaatccttgttaaaataggttgattgttaagaattattaggtacttttaaaaagcatctgcacagatgctaatttcttgtgttttggcatatactttttgcaaacaagacaagagtggatatgtacataggaaagaagtaagccatggtgaaaataagtatttctgtgggttttgggacagggcttccgtgttcaaacaacctacccaaagagaggcactacaggcagtgtagtcagtctcccctgtgaccactggagctgaatattggtttgacctacttggaaataacctctccccaccaccccgctaaatagagccagcatctcactctgtcactcgggctggagtgcagtggcccagtcatagctcactgcagcctccaa

SEQ ID NO: 302 - DNA, 1050 bp, Homo sapiens
acaattttaaaatatttttatttctttgaatttgttaaaatataagtattaagtatagtttgctatttgcactgtcatgattcctgatatctaattgagtgatagccattctttacccaatccagtgatttgtccaaatggcttattacgtagaaattttaagaaaagtcgctgggcgcggtggctcacgcctgtaatcccagcactttgggaggcagaggtgggtggatcacccgaggttgggagttcaagacccgcgtgaccaacatggagaaaccctgtctctactaaaaatacaaaattagccgggcgtggttggcgcatgcctgtaatcccagctactcaggtggctgaggcaggagaatcccttgaacccgggaggcggaggttgcagtgagccgagatcatgccattgcactccagcctaggcaacaagagcgaaactctgtctcaaaaaaaaaaaaagagagagaaagggaaaagtctgttcattgaaaaggcatactggtaaattcttcattttgacttctttagcaaagatgcgattactgtgttagatcactggttctctaattactgccccttggaataaaccattacagaattctgaatgtgagtgtctgttaaatgagatgtatctgtattctgagtcaaacattccatggcaattgctttaatcacacaaaacaggtatcaggatcctgagaggatcaaattgtctgtaggtttatttcttattgggatgttctcaagtggtgttttaggttaatttatggtatatatatgtttatatgtgaatatacttatgattttagttgtagcaatggatagatactataagcagagttagttgttgagattaaaacccatggcctaaaaatagattcttggattcacatcttagctcacttaaattgtctttgtgactgaggtgaagttgcttctttttaagcctcaggtttcctctcttgtgaaatggaacagggagaaagggatgtgatactactgtgttaatagtgtgtctaatacagcaggcttacaaaaggtagt

SEQ ID NO: 303 - DNA, 1030 bp, Homo sapiens
cactgatacagatcaggttttttgtttttttttttttttttttttttaatgagatggtgtctcgctctgtcaccctggctgctggagtgcagtggcgcgatctcggctcactgcaccctctgcctcccaggttgaagtgattcttctgcctttgccttccgaggagcgcatgcaccactacgcctggctgatttttgtattttagaagagactgggttttaccatgttggccaggctggtctcaaactcctgaccttaagtgatctgcctgccttggcctcccaaagtgctgggattacaggcttgagcctctgtgcttggcccctagaccagtttgtttgaaaggggaaaaaaggacaggtaaaatgtggtaaagggcattcttgatctcttctcaaaacctacgtgtgggaaatgcaaatgggggaaatacccttgtaaatatagttattttgaaagcagtggaccaggtgtggtggcacactcctgtaatcccagccttttgggaggcggaggggggtggatcacttgatgttgagaccagcctgggcaacatggcgaaaccgcatttctactaaaaatacaaaaattagccacgcatagtggtgcatggctgtaatcccagctactcgggagactgaggcaggagaattgcttgaacctgggaggcggtggttgcagtgagccgagatagtgccactgcaccccagcctgggtgacagagcaagactccatctcaaaaaataaaaattaaaaaaaaaaaaaagaaagtagagagggtgcagaggctgtggttgtccagagtggtatgttgaacagtgttaacctgccaagaggtatctgagtttgtaaaagaaaactatttacagttgaagcacatagcatgtatggaaattagaaatttggtggtggcgctaggggaaaggccaagagatgtaatggggctttgagcctacctgtctagctagcactgagcttcacatttaagagagagagatgagcaccttctcaaatagtatgactgaactca

SEQ ID NO: 304 - DNA, 1047 bp, Homo sapiens
caattggtagattgatacctaagaaggaaccaggagtgattcagatctatagtgccagggagacaagttatttaaaagttgaggatgagacttttaaaacctaacttgggtttttgttaatgtatacattttcctaacttttttcattctccccacactttcctgtgtttttggattgctgtctgtttaataacttttcagtggcacttgggaaggtgcaaatggattgtacagatggactgttttgacagtttaaagtgggaattctttatattgtttcaaggacaggcttcaaacttccccccgtctttgttttttctaacagaaaaaaatgaaataaattttctataggaaatgatgctgaaaactgttctggtaattaacaaaagctaactcaatattcagacaatattaccttgaatctaattgatttgccattcatttgaggtttccggggggaaaattcaggagacagaaatgaatgtaaagtatgaagttaatgaaaacctattattttaactttttgcctgagctgttcctgaagacctaataatgctacttttggcaaaggccaaatttgatgattttggtttaatgtaaaaacctgtgagaaaggagcctagaatggggaagaggcaggaggctttgagcctaggagactgagcacacgaaaagcttaacagagtatgaataatgataggaaagaggcaattgggagaagaacctggctgtcaggaaatgtcacagttggtttgggaagatgcctgcagaggtgcctagaagccagtaagtaaggatggtgagccatccttttccgcttcctgtttcgttagagctgtggagcctccgtgttctgatgtcccctgagtagggaattgtgagtccataaaaggaaaatgtgttaggcaggatgggaagtgtgattaaggcatgagttaagattttggtcaagtagaggagtaagctaggatgggtttgcctgttttagacgcttgcatagagaatggaaagggactttctgaaggaaaatgacattaggtcatggtt

SEQ ID NO: 305 - DNA, 2073 bp, Homo sapiens
cacatcatggagggccttgtatgtcatgtgaattttgtccttagtagaaatggcagttctcagatgggtttaagtgagggagcttcaggattagagttgcatcttaatatgagtagcctggctctgtggaaaatgaatttaagggaggcaagagtggcaataaggacaactatttggaggccattgccatcaagaaaggtgatggtggcttggattaataaggtgatggagagaagagaatggatttgaggtagattttggaagtggtgtcaataggaggatgttaaggaggtatgtgagagagaaaagtgtgagaaatgacttgggtttgtaattagagccactggtcaagagttgccgttcatggagagggaggaggagcagacagagttcaagttttgacttgttgagtataagatggctgagatgtcaagtggagatgttggtagaaagttggacctacagatctgttcagaaagaagtctaggcagggtagagatatttgggacttgatgacatacatatatgtatatatgacatacacacacacatagaatatttggtatttaaagtgtatgaggctggatgtggtagctcacacctataatcccagcactatggaaggctgaggtggaagatttgcttgaggccaggagtttttgaccagtctgggcaacatagcaagaccccatccctgcaaaaataaaaataaaaaatcagctgggcgtgatgtcacatgcctatagtcctagctacttcaggaggctgaggcaggaaggttcacttgaacccaggagttagaggctacggtgagatatgatcatgccactgcactgcctgatgacggagtgagactctctctaaagaaaaaaacaagtgtatgagatcattgtgtggatgagtaaagagtgaggaaaatgcctagaagcaagttctgaggaactctaaacacttaggggttgggtaatggaggagaagctagacaaggagaacaaagaggaactgtgggggaacagtagtgagtggtgagaggaaaactactagagtgaggtaggaagaagctaggagaggtttgtaaggagggagtgaccagttgtatcaagctgagtgtttgttggatttaacaccctggaagttactggcaaccttcgtagtaacagctttggtggagtagtggtggtgggaagtcataatacagcgggtagaagaatgaaataggaagtaagagactggagtcagtgtgtaaagccaactctaacaagaaacttggctatgtagaagacacaggttgatagctgcaaagggggatacatatgaagggaaggctttaaaaagtatgagctgtaagagctgggttgaatgctgatttattagagaaagaagtggaaaattaaagagagacatggtttaatggatgtccttcaaggaatctcccaaatggccacctattccactaggtccccctcagtggtatgtattgcttcttcgtatgaattttcatacaaccttccctcctacttctttacttgaggccaagtaaactctgtgaggaagaaattttgttcttcatctttgtataagccagactgtccaacactatgtttttttgaagaaccagctaagacaggttcttccttttcctgacccccacactctgcaagtgcaaaaaccattttgttggtctctactaaagaaagaattggctgggcatgctggctcactcctgtaatcccagcactttgggaggctgtggtgggcagatcatctgaagtcgggagttcgagaccagcctgactaatatggagaaaccccgtctctactaaaaatacaaaaattagccgggcgttgtggcgcatgcttgtagtcccagctacttgggaggctgaggcaggagaatcacctgaacctgggaggtggaggttgcagtgaatcgaaatcatgccactgcactccatgacagagtgagactccgtctccaaaaaaaaaaaaaaaaaaaaagaattaagttcaaatctatagtctggcattcaagtctatgaccttcatagtctagctctaattaattggacaaat

SEQ ID NO: 306 - DNA, 1045 bp, Homo sapiens
agattaaagcctttctttacatcttcagcatatacttcaagcaagtaacaaaagtactcaaaagaaactcacgacattaattccatttgttatttcatctagtagtttttgaatgactactttgcatttagcatttattcaaaagaagttctattatatttaagcagtttaacattttggcactgattagagacagtaatgagattatcatgtataaacattaaaaaaataattttcttaaatctacaaagaatagaaaagaaaaacatgcttgttataaaaagacaaataggacacaagtatataaaattaataccccaggctgggcatggtagcttacgcctgtactcccagcacgttgggaggccaaagtgggcagatcgcttgagcccaggggttcaagaccagcctgggcaacatagtgaaactctgattctacaaaaaatacaaaaattagccaggcatggtggtacgtgcctatagtcccagctacttgggaagctgaggtgggaggatcgcttgaacccaggaggtcaaggctgcagtgagccgtgattgcgccactgtactccagcctgggtggctgagtgagtgtttgtctcaaaaaataaaataaaaataatctcctgtccctacctctccccagatctgtcccgaggtaaacaatgttaattttggtttatagccctccatacttgagaagtatttccaagatgtaaattccagggttacagatctgtggtatctcttaaagggatttatttccctttccatcctctagcaaagtataggctcacccttactcccatcttgaggtttccttgacccagttgctcaaagcagatagtaggaattacttgatttctttctcccgctttccacatccaaaccatccacgcgtctttaggattatgctaccccaattcaatttaatctacacttttctttccatgtccattgcttttacctaatccaaagcacatttcaccacaactaccacaagaggccacccagcttcaattcttcatcatttgatgcctctgat

SEQ ID NO: 307 - DNA, 1035 bp, Homo sapiens
ctctctccccacctgccttttccagaaaactaagacccagagaggttaagtgacttgccctgtggttagataggttccaaatggaaaatccagcctactctgctagtcaggtattagccctggtccctaacatcacaacagaatcttttttttttcccctgacacgccaaattatttagtagtataatacagtaataaaaatttgtggccggtcgtggtggctcacgcctgtaatcctagcacttggggagactgaggcagatggatcgcctgaggtcaggatttcgagaccagcctgggcaacatagcaaaacctcgtctctactaaaaatacaagaaattagccgggtgtggtggtgcatgcctgtagtcccagctacttgggaggctgaggcaggagactcacttgaacccagtgggtggaggttgcagtgagttgagattgtgccactgcactctagcctgggcgacagagcaagagtctgtctcaaaaaaataaaaaagaaaaatttgtaattgtcttctgaaccagatataaccatctaatagcacttgatctgtaaaggactttggatcaccaaaattgtccttgacattctatttggcttagtttaagtatgagtttgtccaaatttaagacatgatagcgtgaagggaatagactgttatttaccaaatttgaccctaacaaacagtgaccagttactggcctacagatagctgagtccaaaaggcatcatgaggaattcaaagtttaaccatggggcaaacttcttcattccagttttgattttttttttttttttttgagatggagtcttgctctgtcacccagattttgtttatcttcagagtttttccacattcattctttaacttgtgtttcactctattttcatatgtttttgatgggagggtttttgtttgcttggttttttaaaatgaaagattcatgtccatattacaaatatcaaaaagtgtgaaaggtacacaacaaacaactcccctaaccccgtcccttgagtgttgtgctgt

SEQ ID NO: 308 - DNA, 1020 bp, Homo sapiens
tttcttctgctgtgcggaaactcttaagtttaattagatcctgtttgtcaactttcgttgcaattgtttttggcatcttcgtcatgaaatctttgccagttcctatgtccagaatggcactgactaggttgtcttccagggtttttatagttttgggttttacatttaagtctttaatccatcttgagttgatttttgtgtatggtataaggaaggaatccaattttaatcttctgcatatggttagccagttatcccagcaccattgattgaatatggagtctttgacgttgcttgtttttgtcagctttgtcgaaaatcagatggttataggtgtgtggccttatttctgggctgtacttgagggtggaggatggaaggagggagaggatcagaaataactattgggctctaggctttgtacctgggtgatgaaataatctgtacaacaaactcctgtgacatgagtttacctgtataacaaacctgcacataatacccctgaacctaaaataaaagttaaaaacaatagcaacaaccaccttggggcatacatgatgggactataaaagatttgtaccactctgattttaggaaaatctacctcatcattgccattcattaagtaggattagaaataggttattataaatatatcttttgctattttcttgctctctgaaggaatgtgtacaacaggatatgggccgggtatggtggtgcatgcctgtagtttcagctactggggaggctgaggcgggagtatttcttaagtccacgaatttgaaactgcagtatgctgtgattgtgcctgtgagtaaccactgcacaccagcctgggaaacatagtaagatcctatctctaattgaaaaaaaaaataaaaaaaaaacaggatataggatatttatttttatttttgaaatggagtctcactttgtcgcccaggctggagtgcagtggcacgatctcggctcaccgcaacctccacctcccgggttcaagcaattctcctgtctcag

SEQ ID NO: 309 - DNA, 1092 bp, Homo sapiens
ctgcttccgggattcaagcgattctcctgcctcagcctcctgagtagctgggattacaggcacatgccaccacgcccaattaacttttgtatttttagtagagatggggtttcaccatgttggtcaggctggtctcaaacttctgacctcgtgatcctcctgccttggcctcccaaagtgctgggattacagccgtgagccaccgtgcccggctgaaaaataccatttcttattcagttttatatactttaaattttagaaccactttgatctcttttctttttctttttctctttttctttttcttttctgacagggttttactctgtcacctaggctggagtgcagtggtacattctcagctcactgcaacctccgcctcccgggttcaagtgatcctccttcctcagcctcccaagtagctggaactacaggtgcgcaccaccatgcccagctaatttttatatttttagcagagatggggtttcaccatgctggccaagctggtctcaaactcctgacctcaggtgatccacccgcctcggcctcccaaagggctgggattacagacatgagccaccatgcccggacaatttatttattttctttttgagacagggtctctctgtcgcccaggctggagtgcagtggtgcgatcatggctcactccagcctcaacttcccaggctcaagtgatccttccacctcagcctccctggtagctggtactatagacacgcaccaccatgcctggctaattttttatgttttgtggagacaggatcttaccatgttgcccaggctgggtctcaaactcctgggctaagcagtgtcccacctcagcctcctgtagtgctacgactacagacgcaagccaccgtgcctggccaactttgagaatttaaagtattattgttgtttaagagtaaaaaatgatctgattttgaccaatattttgcccaacaggaagccagcagacctgcagaacttggctcccgggacccacccaccatttataactttcaacagtgaagtcaaaacggatgtaaataagattgaggaatttcttgaagaagtcttatgccctcccaa

SEQ ID NO: 310 - DNA, 1032 bp, Homo sapiens
tggtgattgctggttggggtggctgtggcaatttcttgaagtaagataacaatgaatttttctacattgatggactcttcctttcatgaaagatttctctgtaacatgcaatagtgtttgatagcatttaaaaattttaaagtaaatattctttgcctgaggctaatctcaagaggtcctgagaacatgcacccctgtttgatagtgtttttacccacagtagaacctttttcaaaattagaatccatcttctgaaaccctcctgctgttttaacaactaagtcgatgtaatattctaaattccttgttgtcatttcaacaatgttcttagcatcttcactaggtatacattctatctcaagaaaccattttctttgctcatcataagaagcaactcctcatccattcaaattttattatgaaggtagaacaatttgattacattttcaggctccagttctaattctagttctcttgctattttcaacacatatgtagttcctccctccactgatgtcttgaacctgtgaatgtcgtccatgagggttagaatccacttcctccaaactcctgttaatgttgctattttgacctcctcccatgaatcatgaatgttcgtgttttttttttttttttttttttggacggagttttcgttcttatcgcccaggctggagtgcagtgatgcgatctcggctcactgcaacctccacctcccaggttcaagcaattctcctgcttcagcctcctgagtagctgggattacaggtgcctgccgccatgaccagctaatttttttgtattttttagtagagttggggttttgccattttggccaggctggtcttgaactcctgacctcagatgatccgcccgtctcggcctcccaaagtgctgggattacaggtgtggtatgagccaccagacctggctgaatgttcttaattgcatctagaaaggtaaatcttttccaggtcactttgctttgctcagatccatcagaggaatcactttctatggccttatgaaatg

SEQ ID NO: 311 - DNA, 1061 bp, Homo sapiens
taatttttgtatttttagtagagacggggtttcaccatgttggccaggctgggacttcaagtgatccgacctccttggcctcccaaagtgctgggattacaggtgtgagccacagtgcctgcccttacttaattcagtgaatgctttgaaaaagcaggtgaatcttaactcttctgatgaatttttatttatttgtatgcattgaaacagcatgtttgaagtgggaatgtcgccttcttagtgggctctatggacccagaatgtgaaatgctaattaattagcataattttcatcatgcagaattgtttctaggggatgagtgggaggaggaagagtttctgggatcacaagctgcatttattttccttccctctattgtgctatattgttctagggcacccagggaccattctgtctcactgccttttccttccagaacaaggaggtctcaggtctttattgctagtcttcttcaggctctgcttgtaagactgtttctaaataggataaggagaaaaaggagaagaattgtgcaagcttgtagactggaatctagcatttctaataacatgtttttgtcatttgatgtactgagaactgagtggttttttgtgaacacttcctgatttaatcatgacaaatataaatacaggcaattgtctattctagagttgcttaacattgagaggctaatgaaaagctcaaatcagataacttttactggtatgtgtggctataggttttaaagtgaactttttcttcttctctggggaaagtatttttgtgtatgttttatagttcttgcttgaatgaagaaaccactttgctaaaaaactttgagacttggatttttaactgaaacagcctagatatacttagctaacttactgataaaaggataaaatagaaggaagcgagataaatttggaggggcatgctataaaatgttattaaaccttttttaaaaatgagacatacaggccgggtgtggtagctcacgcctgtaatcccagcactttgggaggccaaggcgggtggatcatgaggtcagcagtttgag

SEQ ID NO: 312 - DNA, 1055 bp, Homo sapiens
gagaaaggaataaaatgtgtttgcttcccctttgagggatgaggatggggcggggtgggggtggggcgggaataaaaaggttagaaagtgactcatttaagtataactttgtattctattttttccctatcaatttgttattatcttaagtagccacctactcttcctgtcctcagaatgctgtaaccaataagaacaaacaacataatataatacatggtacataatctagaaggctttatattaaattacctgctggtaaataaaagttccagttgccaagcaacttctctccacagggacctgttgaggccatgacactttagaaaacaatatttcaaatcactttggagcttaatgggccctccttatgtatgtttgccgcaggcctcagatccatttagtgcaatcaaatgcctttagtagtcctaggaaattagtgattctcctttttatttcccccaacccccacccagatgctgacaatttacacagagatgaatttgtcgttttacatggtaaatcagagtagacaagtctgattagttttaccacctattaaatattttcaaaatccaatatgtttggacaattttaagaccttttaggacttaattctaagtaagggattcaatgcctgaatgctacagttttgggctaatgaaactgaaatagaagggctagtggttaggttggggtacaaagtaaacaagtaaaatgtgaagaataaagggagagacactgatgatagatagataacacatatataattcttttgataacacgttcaagttgattgggagtaaaagtttatgtaaccatttaggcagtcaaagagaagctcatgggtaatttcttttgtggggatgtattaagtatgacctgtccccagatctcctactttttttaagttctgtgatggcattaatttatgtaatttgctaaggtcccaactgtgactagtcattgatatttataatactcagtcattgatatttataatactcataaaagagatgtgaacttagcattgttgaatgtactctgaggcatat

SEQ ID NO: 313 - DNA, 1037 bp, Homo sapiens
tcctggatatgtactaacgaatattaccaccagagaagagagctttctacaaaagtcactacagattttgctatattgctttgtagatagatttttacttttgcctaaaagcatttatccttcataccaattgtaacatctgacaccatgtagaagctaaaagtttagagggagtgagggttttctcaagaccttcctcaagcattttatctttagaagagaaactgatgggcacctgatactctgtctaaatacgtttgttatatgtgttttgccctgtgccattcatttggaactttattgcattctttattttaaaaagcttgtttttacgtaatcatagagcttgctatttgtacatctgttgagcaacactacataactgatttttagttgacttagctatagcagtacaatgattagtaatgtaaaaattaacacagaaattaacctaaggaatgaagggtgggtttgtcaaaatatcaagtaaatttttgtttctaaagtacatttaatgtagatgacctaaagaatgcgttatccatcctatataaaagaaagataaaacacaggtcaccaattttctcatttcaccccatttaccttgtatagaggattgttcattcctttgggactaagttatagttatggtgagtgtgtatttactgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctc

SEQ ID NO: 314 - DNA, 1088 bp, Homo sapiens
aaaaatacaaaacattagccggctatagtggcacgtgactgtggtcccagctactcgggaggctgaggcaggagaatcgcttgaacccaggaggcggaggttgcagtgagcagagatcatgccactacactccagcctgggcgacagagtgagactctgtctcaaaaactaaaaaataaattagccaggcacggtgttgcgtgcctgtagtcccagctactcgggagcctgaggcacaagaatcacttgaacctgggcagcagaggttgctgtgagccgagatcacaccactgcactccagcctgggcgacagagggagactccgtctcaataaatttaaaagaaaaaagtatttattttagtttgtttatttatttatttttttttttgagatggagttttgctctgtcgcccaggctggagtgcaatggcatgatctctgctcactgcaacctccacctcccaggctcaattgattctcctgcatcagcctccccaagtagctgggattacaggcacacaccaccatgcctggctggtgtttgtattttctgtagagacgggtttcaccatgttggccaggctggtcttgaactcctgacctcaagtgatccacctgtctcggcctcccaaagtgctgggattacaggcgtgagccaccacacccggccgatatgttttcttagaattctcatctctttatctttttattttatgttccaatctgttaaacatttttgcatttcagttctcatgttttaatttctaagggcctttgtttccttaattatgaatgcttcctttagggatcaactctctctgtgggcctttcttttttttcttttcttttcttttcatgttagacgtgtaaggtgctgatgtaagaacaaggtttgagggaggcacatctcaaacatgcacatgaacacccaatcatcgtgcctaagaactacaaaagaatcaggttttccttttaaattaaaaaaaaaatgttttagaagtagggcctcgcttgtcacccaggctggagtgcaaatggtgtgatcataacacactactgtctcaaaatcctgggcttaagcagtcct

SEQ ID NO: 315 - DNA, 1081 bp, Homo sapiens
ttcactaccttagaatgatcagtttctgttttgatacatttcgtaccaaaatttcttctacaactcatcaattattcttcgttgtttgtttcacaccattctcgaaatctcacatactcttttctcaaattcagggagtcatgtgatatttcttgttttattcacagagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacat

SEQ ID NO: 316 - DNA, 1027 bp, Homo sapiens
ccagggactggtatgtctggtaatacatgttttccatgtgtggggaccattcagctgtttagagtagatgttattagcaatactcaggtaactatgttaggattagctaatagggtctgttaactgaaattgacctctaaactattttgtctaaacccattgatcaaatagttacattttctcctcctctcccattccagtgaaacagaacagtggaggaagcaataattactcaggcttttggagggcggcaacctagtctggggatggcatattccctcctcttccatttcccattgcaaccataaaggccgttcctaccttaaaaaaaaaattgctcagtcctgctttgaagtgtttctgggttccctgttgctaggttagtgattggattggagttagagtagtgtttcaaacgttttggtctcagggccccttttcactcgtaaaaactattgaggactccagagagcctttgttaatgtggcttatatctatccagatttactgtattagaaattaaaactgagaaaaatttaaaatacacacttattaatgcacttaaacatcataataagcccattacacgttaatagaaattacatttttaagtgaaaaatagttatattttctaaaacaaacagaatatagaagagtggctccatttttgtaaatctctttaatatttggctcaatggaagacacctacattctcatatctgcttctgaagtcagtctgttactgtatcacatgtcatgtaacttacagaaaattccaccatatgcatgagtgagtgtaaaaaaggcagataacatcttagtattgttatgaaaatagttttaacctcaaagagcccttggagggatctcaaagacaccccagaaatccccaaaccacatttagacagctgctggattggagcaagcataggcctgggcttgttcccttgattaatgtgttaattctgttgtgttctacagccacatcttaaaactataactcccacccaggcctggtgctttggtc

SEQ ID NO: 317 - DNA, 1026 bp, Homo sapiens
atttctttgaatacattatttagagttgagtttaatgtggacattttaaagttttcttttcttaataggttataatataccttcaaaaatatatatcttttttcgttatttgaatacaaactttaagctgttatgatttgatattttaattacaggcattgcaggtaccagctctcactctgaatatatctttttaaaaaaaaaatagttggactgatttctatgtaggtatacttgaagacagccatgtgccaaaaaagaaaaaaaaatgttcatggaatttcatcattgaaaggaatgtcatttagatgaacccttaatttggcaaaagaatcctcacagcatccctgacacgtggtggttttacctctgatggaaaacctacagtgacaaggaacttacctactgttcctggtaccctactctgtttttgggcagctataaaataaagttattcctcatattaagccagaattttcttccttaaattttgacccagtatgtcttcactgtttttgggctcgttgatttcttttttaaaaatttctatttttttttaagatggggtctcactatgttgcccaggctggacttgaactcctgggctcaaatgatcctcccacctcagcctcctaagtatctggactaagccacagcttgctgatttcttagaggatctaaagaggctttcccagaaaaatataagggaatgtataaaacttttccttaaaatgtcaagggggccaggcgcagtggctcacgcctgtaatcccagcactttgggaggctgaggcaggcagatcacctgaggtcaggagtttgaaaccaacctggtcaacatggtgaaaccccacctctactaaaaatacaaaaattagctgggtgtggtggcacatgcctgtaatcccagctactcgggtggccaaggcaagagaatcgcttgaacccgggagacagaggtggcagtgagctgagactgcgccactgcactccagcctgggtgacagagcgagactccatctcaaa

SEQ ID NO: 318 - DNA, 1041 bp, Homo sapiens
tagaagcagagggcaagaagctcacgatggacatgaaggtgaaagaagaccaaatcagagaactagaactaaaagtccaggtaaggggggaacaaaagacttcccttgtatttgaattccacttttatgctaaacttgtgctctgtgttgcagtgtagagatgatgccttttaatatagatcaaatctcattgcatctgaaaaatctctatgtgacaaaaagatttgaagttctaatcttgtccagctcatttcaagtcatattaatgtagccagattctaatacaaaccagaaatgttgacaatcccttggtatgttttataccaggatttaacttgctgtagattcatttaactttttcaggttataggccagattagtgtcctttgaaacttacacacctccttttagccccaaccctctttctattgccaggggactgaccctcctgcatggctctgagccttgcagattgttgttcatagcagtgaatgataggaaaggtgctagtgctatggacgtagcctgttttatgggctgtgtatactttagccaaatatttgtcatttaaactaatgtcatatattgtaaagttacagtaatttgagccaggtgggacaagtgaaaaattactgtcaagtcagtggactagaatgatggcctggagtacagtaccgaaaaaaatacgaaaaaaagtaaaggtggcatcagagatagatgggaaaggtaacgattagtcagtaaaaggctttggaatagctaaataactggagaaaaaaaattagaaactcatctcatgccacatataaagaaattccagatgaagagttgaaggcagaaaaaacaaagaataaatgagtttttaaaaactaggtggaaatatacttgaccttgaaacaagggaaagattttctaaacatacaagcaatgggaaaaaatcacaaagcaaaaatcataataataaatgaaaaaattgattggggaaggtatgaatattgcaacaaatattataaataaggaattaatattctcaacatatcc

SEQ ID NO: 319 - DNA, 1075 bp, Homo sapiens
tcccagaggccagctatcttgctgtcagggttagagtgggggtttaaacccacgtttcttcccctccctgcgtgactggggagttcagagctccttgtctcatttccaggacaccccctgaccacatcttagctgggatgagtgggaaccttggtggtcacgggggatttgtcctgaatttgggggcaagaagtggagtgggtcaacctttggcattgcagcttttgtttctgagacccccaggatctgagcattctccctataaggtgcttcctgacatccattgatgtagcattgacacctgttaacctctgttgacagctctgagccccagtccccatgccctatagcccttggaacctaggagacaagatccccttccctcccctgtcatcaaaggacatgtcaggtacatcacagtctttgtggtccccaggcttcctgctgcccatcaggacacactttagatattgtgtaagttgtaacaaatgatcgcaaatttagtggcttaaaacacaaatgtattctcttatggagaagaaaaatgtattctgtgacagaagtagatcaggagtctaaactaggtcggcaggattgtgtttttttctggaggttctggggggaatccatttccttaccttttctacctcccagagactgatcacctgcatttccaggtttgtgggcctgtcctcatcttccgagccagcaatgtagcatcttctggtctcctgatttcatcgtcacattgctgcttttagctctgactctcctaccccgctcagcactccttctgatgacatttggacactctgagtaatctgggataatctccatcgccacatccttaactcacttctgtaaagcccgtttgctgtgtaaggcagcattcacgggtctcagggattaggatgtggacatcttgggggcggacacacgattcagcccaccacaggtgtcatggaagaggcactgtaggaggagacagtctagcggtctcctggctgatttgctgtgttaccttggagaagatcctgcctttctctgggctgcttgcctatcagcagaatgagaa

SEQ ID NO: 320 - DNA, 1050 bp, Homo sapiens
ggttgtattcagtttaacttacagcttgggacttcagggcaaaaaggtaggaatgtatgcaagtgaacaatcagatttatgcaactacagtctaagcttgtgtctccagatttccagcaggcttaaataatggcgttttcatatccctgccacattgggtgtccagcccttgcttgggtggatagtgatctgacttgggctggtaattagcccatatttttagttcatgggcaattctcaatggtaactgggtctattaaacttgattcagatatgacagcttaaattgtaaacagctgcgaagagtttcatacttaattaccatatttaagttttgccataaagtgcctgtacttccatcaaaaatgtaaatgttggagacattcaaatgaggttttatactttcgtgaagtgtaattggcacggatcagtcagtttgtttaggaattttaaatatttttttaaaaggagttttaaaggcagtggccacaggtccatttctcaattaaattgagttgtctgggggagggcagggagcggggctgaggctggtgaggcctgaacttgtagacttgaaagaggctggtgctttcttctctcagccagggcttcagaaggaagctagatgtttccggctatagctacgaactctgggacttccactcccagaagctgagctgattaaccctggactggaatggctgagagaggaaggtgttgagatgaatatgggctggggataggtcctgggtggaatgaggcctgcacctcaggtgaatgtaattcacccagcattgttgccacctctgggaggctttggcctgctcccgagggcaggggtgttcagattgattcttgcttttagggtgcacaaagctgggggaaacacaggcaggggagccagtgacactttcacatgcatagtgccagagggaggtgggtggggctcgaggagtctgggactggtgacaggagaggtggtgacatctgagttgggtttggaggggtgagggagagttcccctggggtgaagggccgaggtgtggccct

SEQ ID NO: 321 - DNA, 1055 bp, Homo sapiens
ttccttctgcccttcctccaggagaaggggcccaaggtccccgtggatggtctccacctgtgcttggaaccagtgtaactggctgctccctgctcccagggactgacacggggatcatctctgtgaccgccctccgtcgggcccctgcctgccttctcccctccacgcaaggctgtgctcttcctctggtttctgtgtgtccgtttgagtgtctgcgccccgcctccccatacttcctgggatgatgtgtgaaacctgacacctagatttatttggaaatattctatgaccactttacagatgaggaaacaggcctcaagcgtggaggggtagagtgaagagtagaacccaggtctgatgccaaagctgctttcttctctgcctcctcctcacgcaactcacacctccttttcttctagctttgttgtcctcccaggaaccaaaaaaccccagctattttctgaccaaaatgtgtttcataacaaaccatctggtgcctttccacacagaactggcaggagcctcgtgtcctgctagctgtctctcttgttgatttccgtgaaaatgcaagtgtttgaagtctgctcattccgagggtgaaacaaaatccaaccctgtcagaatcatgctgttctctttgctgacactgtgaccctgggtcgggacagaccagcagcaatctgtctttagaatcgctttccttcctccccttttgcccccgtggggctcccggcatcctgaaagccagcaaagcctccagcatcttttccatcctgaggtgcctcccagtggcctggcttgtcggagcaagtttcatcagccctagggaaaacacggccctcctgggaacctccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcgaggcctgacacaggccagccttggcacgaggggggccaggggttctg

SEQ ID NO: 322 - DNA, 1027 bp, Homo sapiens
aggcgtgagccaccgcaccctgcccaagccttctacttttcagctgctgtgctcagaattgagaaaacctgatggtttcctcctttatacaaagcatacagccatcagcgacagaaatctcagctaggcctttcttttatggggagaaactgaaagggcctgtctctgaaattttgaaagagtccgggtgagccaccatcacccatagttgtacctcaaaagcaagtgcagggaagagaggaattttgtgaagattttgaaacacctgtcatgggccgtgggttcatttgtgccctgcgtatggcaaggtctgttttgcccactgacgggagctgccgtttcctgtagctggtttacaggccccagcaggaagtcccagatctggaggcagcataggaatgagaaaattctggtctcttgttagaaatcagagcagcagacctagagaaggtgtattcagttcttgggcacacagttagctgtgtgtccttggaattgttactgaaccgctctgaacctcagttttcttatctataaaatgggctcaatacttgcttctgggagtagcaatggaagattaaatgagataaaatatgtgatcacatctggcaaaagggctggtacatggaggtgctcaataaatactggcaccatcgggcacactggcttgtgcttttaaccatagcactttgggaggtcgaggcaggaggatcacttgaagccaagagttcaagaccagcttgggcaacgtatcgagaccctatcttttttaaaaaaaaattgtaaaaatcagccaagtgtggtggcacacacctgctacttggaagtcccagctactagggaggctgaggtgagaggatcacttaagcctaggagtttgaggctgcagtgagctactatcataccactgtactgcactcctgtctggatgacagagcaagactctgtctctaaaaatacacagatacaaataaatactggcttattctccagttcttaactgaaatcctttcacaggacaagaaac

SEQ ID NO: 323 - DNA, 1033 bp, Homo sapiens
gcgttggacaaatcactttcctcacccttccctgggactcagactctgtgaattgaacagtttggatgaatttgtgctgctcttcgccaggaggaagcatcagaattgcctgcagggcttttgcaaatgtagacttccatgttccgtctccagaaattctggttcattgggtctggagctggcccagggatctgcattaaaaatagcatctctgttgatggttctgatgcacaacccaggttgggagccacagttaaccgggttaggatcctgaagtgattggtccccttccctcactcccattagctcaggtggtgttttagcaaaggggaagctcctgccctctctgtgggtgctgaggctgttgcctgggtgggggtcccactttactaggtgtggcaggtcaccagttccacaggaagcagtggtggctggagaacagccctgaggcgtgagtggagccggcacatctaggagttttcattcagctgatgtttggtgaaagtgggatctgtaggctgggcgcggtggctcacacctgtaatcccagcattttgggaggccaaggcaggcagatcacctgaggtcgggagttcgagaccagcctgaccaacatggagaaaccccatctctactaaaaatacaaaattagccaggtgtggtggtgcatgtccgtaatcccagctactcaggaggctgaggcaagagaattgcttgaacttaggaagtggaggttgcagtgagccgagatcgtgccattgcactccagcctgggcaacaagagcgaaactctgtctaaaaaaaaagaaatgaaagtgggatctgcagatgggaggagaacaactgtgaaaatgaggtgtcctctggccatgtgatgcctgggggctaatcctaccttcaaggtatcacaggagattctcctcactgcttctgaagtgtgattgaaaggggctgaggtgtggatggatgtcagccctgctttccttcatggccacccagaagcttttggatgctttgggtaggacaaacctcc

SEQ ID NO: 324 - DNA, 1044 bp, Homo sapiens
gaattgggaccattggtgcaaactctaccatgagtgtctaggcatggctccggaacagagcacaccccagcctcgattattttcctgcaaacacagaatattttgcctaaacaaggaacctggggttctgccaccctgatttgcattcagttaaaagagctaatcctttacttgctactggaagaaatgctgcccatctctaaaacaatcagacatgatctctctgatagagtagtacactctccaggcccaggctggagctgtagatcacaggcaaccgatgaaatttgcttaattatttgattcaatcagaagttggcttaattattttcttgctctcacctcttttgaatccattctggaaactgattatgtctataacaccaacccagagataagcatttcaattgggaaatgtaattagccaaggaaaatgaatgtgggagctgccttttgtcaaagcaccattaaaacccagctctggtcaataccaatgtggtgtgaagacaaaaggctcagtttgctcctcttgtgactggagagggaaggcccagcaggaggtgggaaaataggtatcttgggatcttagcaaaaggaagctcattaattcattcattcagaggcttttctaggccagctctgggatggatgctagagatgcaaaggtgcactggccacgtcccttgcctcgaaagagttctcttcttagaggagggattcacacgtaattatgtggtcaaagtgctacgggaatacagaggaaggagccactgattctgcctctgggaacttcacagagcaggttacgttgagctgggctttgaagaataagctggagtctcccaggtgaggagggcattctaggtaaagggcacagcacgtgcaagggcatggtggcgtgagagtacaggagtacttgttaggggtccactagagcaagcctgctgagggcttcttgggttatcctagctcctcctagaataaagtgtccttgggccatcccacctcaacttttcagtgcctggggatcctgcctcgcctccc

SEQ ID NO: 325 - DNA, 1026 bp, Homo sapiens
atggtttgcaaggtggaggtcttgctcccactgtggaggatgaggaaactgaggcagctagtaagtggtggatccaagcgtgggtttccaggactcaacccattctgctggcccactgcctgcagctaagctatcccagcaactacaaagaccctccctggggctcagctccctaccaggctctcctggcactgcctctgctatctcttaatgttttacaggggtgaatgggacctctttgatttcctttcttttctcctttccaataatcatcattaatcttgttatcagagccatgcatctgcacctcttggctgtggtccacaggccgtgtttgccatgatcaatgcatagctctgtgtggccacaatgtatacccaagacagcactgcaaccctgtgtccgtgggcctgggaggctctggcactgtcaaagacagctggaggctcccccaggagctgaggtgaggcacctggctcacatgccctgtggtcttgttgaattcttgttcctggactggtaaacagctacccccacagctggggagcatctccagctgccttcacagggtctcaaagcacagacccaggtgctcctgcccccgtcctcctcatccgtaagtgcctagaggacaattcaccaaaccaagatgggtagctctggagtcccgttgggcccagccactcatcatacagcagccagtcagatccagttcctaagccatccagaccccctttcttgaagccccagggccatgtgtgatctggcctccaccccctcactgcccactactttccccctttcccgctgcacacaacctttatcttgggattttcaatgtgctgtgcattctgcccgccgtgcccttggcccctttctcctgggcctccttcaagcctctgcccgaacgctgcccatctcctggctgtgctcccccgccacacctaaatggagctcctccttagccactctgtttttctgcatcacacacgttacatttagatgtgtctctgtgtgtctttcccc

SEQ ID NO: 326 - DNA, 1047 bp, Homo sapiens
tcccatttgcacccgaatcacagcactgtttatcctccacatgcagaaccaccaatggttgtgagccatccggtgccttcagccagaggacagcaaccgggtgttctgtggggtctttgtggcccctgatagcattatccacatcatctgtaaattcagcataactcttgtaccaggtctcgagctcccaagtcttacaggggttgcttgatgatggagacaaagaatattccaagtcagacaggcctgggttcaaatgaacttcagtgagtcactttatctcagtgtcctcatcaggacatggggccagggaggattcactgaaattgtacggcgaaagctcctggttccatgcctgtcacatagtaggtgcccccaccgagcagctgctgttactgtcagcagaggagccagcctggccaaaggggggatgacgggggctgcttctgtcttttcagtgggaactggggctgggccacagccggcagcagcagcatcttggcggagtttggatccctgcacttggaattcttacacctcactgaactctctggcaaccaggtcttcgctgaaaaggcaagtctcctccccacccttcttcctgcggagcagagggatgagcgtgcggctgccacagggttttcagaggcgagtgggtcctccctcatggatcagcaggagggcagtggggagcccgggagcccaagctaccactaaggtagcaaatagtagctacctataccccaacgccaggtggcagggaaggtgagcacgcagagtcaataagattctacagagggaaaaggagagacaagattctgccggggaaaaggttctcactggtctgcgtgagctcagtggcaaccacccatatgtgaaatctggagaaagtgcaactgaaatctaggcaccaccttgcattggcaggaattggccacccactgcagaagtcccctttccagagacatttagcttttccatgtgagatctgcctgccttcttccctgtgcctgtttagctcatgccatcagcaggctggcatggcaa

SEQ ID NO: 327 - DNA, 1050 bp, Homo sapiens
gagctcactccagtccctggttattctggagtaatagctacccctgcctgagcacccgctatgtgctgggcactttataatggctctactcttcccaacaaccctatgaggtgggtcttcctggagttcccatatttacagaggaggaaactaagactcagagaggtcaagtcacttgccctgggccttccagctggtcagtgataaagccgtgattcaagcccaggatgtgctggctccttccagaccagattgatagagcaggctgcaggcttttgctctggagtccatccgtctatctctgtctcctctacatttacatactctggctattttcatcccccaatcatgcctcccacagaggcaattattggcagtcaacaaattggcccaaattctagaagcgcccgcaccctccaggggagctaatttggcctgcttcactgctcaccaccaggacagtcgagagtaacgcaggtacaagcacattcctgtccccgtaatggacttcgttaacataaatggatatgaaatctgacgtggcaaagccaagtgctgtcacctggaaaggaaggtctgcctgcagaaaggtggctctcccgcactcccggccccgtacacacataactctatcaacatgagacagtgtggtcccaagggcctttctctcccaaggggtcttgtgctggctaggacgtgctgagtaggatttaaccactgtcggagagcaggcactatagataaagccctcttgaattccacttctcaccttcatagccccaaaggttgcaaacccagcctctttctgctccagctggggcaggctgtgctccatggtcacggccctgatctgtgttggcccagtgctgccctgtgttgggcaggaatatgtatggtttatgttgtcagaattcattcacgtcctggctctgccacttaaggaccaggtggccatcagcaagtcaccagacctctctgagattcaggtttcttgtctgttacactgagataatcccttgtcggttatgagggttggagataatgtatata

SEQ ID NO: 328 - DNA, 1080 bp, Homo sapiens
gacggggtttcatcatgttggccaagctggtctcaaactcctaacctcaggtgatccgcctgcttcggcttcccaaagtgctgggattacaggcatgagctgccttgggaatcattattattaatatttatctgtgatatcagtaaaataattgaataagcaaggcttactaataaccctgcatattcctgttgctcccttcttcttgggtttctagattgcgttttggaaagttttacctcattgacttacaaatacagaaataagtgattcttcagaatagggatttggatcaggagcagcagggagtgctcattaaaagggcagattccagactctcacccctgcagattctcattcagtaggtctgaggtgggttgtgagcatctgtagtttaaaggcatcctgggtgattttgaggacttctggttgagaactgctttaatgcatcattcagcctgctagccagtcagtcagcaaatgccaggcatcatctctgtaccactaccctgccctgagagggcagacagggcaagacccacccccgccctccgctggctacactttgttactggtgactattactcaccccttttgaaataggcgtcatttgtcccttagcctttcaaaatgaatccttctatactgggaaggttatagacttgccagatctctgagcaggaaaagatccaagaaatcaaatccagccacactgccagtccagcccctcctacagctggggcaatgccccccccgcccccccccccccgccgcaaaaaaaaaaaaagcaggggaaagtgggtctcctcactctcaaaccagtgctctccctatgacaccaaagagcctgtttctgtttcttgcttcattcattactccggttcccttgactgagttcctctcagtcccagaagacctagaaaagggtcgtggttggtcatgggtttcgagtaaacaggcctgggtttcaatcccgattcccccaccatctagctatgtgacctggggaagtgactttacctctctgaacactttctcatttgtcaaatggagttggtaatgttattatctgcctccctg

SEQ ID NO: 329 - DNA, 1031 bp, Homo sapiens
ccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggca

SEQ ID NO: 330 - DNA, 1031 bp, Homo sapiens
agatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaa

SEQ ID NO: 331 - DNA, 1038 bp, Homo sapiens
tgtattgtttggggaataagaagaaaaacaagtcttatgcacattcagtaagataccattaaaaaaaaaaattggttgaattcacaaacgtagaaaccacggatatggccaggcgctgtggctcatgcctgtaatcccagcactttgggagcccaaggcgggtggatcacctgaggtcaggagtttgagaccagcctggccaacatggtaaaactccatgtctactaaaaatacaaaaattagccgggtgcagtggcatgtgcctataataatcccagctacttgggaggctgaggcaggagaatcacttgaacacgggaagcagaggttgaggtgagctgagatgacgccactgcactccagcctgggcaacagagtgagactgtgtctcaaaaaaaaaaaggggaaaaaaaagaaaccatggatatggagagctgactgtatattaaacacataaatatatgtatgcactgtgcaggcatattaagtagataatatatatttcaaataagtaatattttagaaaaatgacttgttgaattctggggtattggtaaagaagagggcacgtttaattcaactcagggtatgttttatttaactttaaaatctcacagtgccttactcagcgtagatatttggtaaatgtttggtgtattctcttaggcatgctgccttgcatagagtaggcaccattataagctttggttgaatcaattcaagattcattcagcagaattttttttttttttttgaaatggagtctcgctctgtcacccaggctagagtgcagtggcgtgatctcggctcactacaagctccgcttcccgggttcatgccattctcctgcctcagcctcccaagtagctgggactacaggtgcccgccaccatgcccagctaatttttttgcattttttaatagagacggggtttcaccatgttagccaggatggtctcaatctcctgaccttgtgatctgcccgcctgggcctcgcaaagtgctgggattacaggcgtgagccactgcacccggcct

SEQ ID NO: 332 - DNA, 2116 bp, Homo sapiens
tcaagtttattactcagagcaaaagttgcccatataatacgttgctcttcaatttttatttctgcatggttatacagtctgaatgactagtttacaatcccaggtggtattataagttttgcttttactggccaggcatggtggctcacacctgtaatcccagcatatggggaggccaaggcaggcgaatcacttgaggtcaggagttcgagaccagtctggccaacatggtgaaaccctctctgtactaaaaaaaatacaaaaatggccaggcacgatggcttacacctgtaatcccaacactttgggaggctgaggagggcagatcacaaggtcaggagatcaagaacatcctggccaacatggtgaaaccccatctctactaaaaatacaaaaaattagctgggggtggtggcgcacgcctatagtcccagctacttgggaggctgaggcaggagaatcacttgaacacaggaggcggaggttgcagtgagccaagatcacaccactgcacttccagcctggcaacagagcaagactctgtctcaaaaaaaaacaaaatgcaaaaattagcggggtatggtggtgggctcctgtaacctcagctacttaagaggctggggcaagagagttgcttgaacccaggaggtagatgttgcagtgagccgagatagcaccactgctctctaatctgggcaacagagtgagtgagagtctgtctcaaaaaaaacaaaacaaaacaaaaaaaggcggggggcgggggatgtgactgttggaaggggaaaagtcctcgctgacaaagaaatgacactaatgaaaataaaatcaagaatgatccactggtaccacagatgatagagaagcttgtcagtgagcagttccctacttcttgcagcaaaggggagcatgggctaaaaatattttagaaaaatcaaacggcacctgcaacacactcttaaataaaggccaagcttgcaaactattcctcctcatccatgttgctcaaatgtgaaggaattctatataaggctaaaatctagtgaatcttctcacttcaatttccacctctctggctcaagtcattcttgtgacttagcctcccaagtagctgggatgataggcacatgccaccacactgggctaaattttgtacttttattagagatggggtttcaccatgttggccaggctggtcttaaactcctggcctcaggtgattcacccaccttggcctcccaaagtgctgggattacagacatgagccactgcgcctggccctcactgctgctgctttgtggaatacagtttttcttcaagtgagactaggacaatctcttcatattcttttagttcctgggatgttttacagtactctgtccaatcacatctacatctctagacaagtgctccatcatgctttcaacagttgtggttggtgcataaaaattcaccaagaaatacccacctctgctgtgctgttgacgaagatcttataaggaagtgctcatttgcccaggttttgcaagtccctcactattgctcctctgttcatcagggcttgtatcatacttttcaaagcagcagtagtctctggctgcggcatggctgtcaagattaaagccagcttatagccaggcattcccaagggcttggtgggcggctcagaactgggatggttcccgggaagcaaaggagcaggatggcagggacctggaagtggctgggctgaatggctgccggatggcaaaagctacaaaaaatttttaaaaattagccaggcatggtggtccctcctgtagtcccagctactcaggaagctgaagtgggagaatcactcactggagcccaaaaggtcaaggctgcagtaagccatgatctcacagttacactccagtctgggtgacagcaagacattgtctcaaaaaaaaaaaggaaaaagatcagtagttctgtgccccagcacaaccccacaattgtgtatctatcttgagctcttctctttcacctgatatatatatatagttgaccttggaacaatacatttaaactgcacagttccacttgtacgtgtatttttttcaaccaaacacagatcaaaaatcatgtattcaagaga

SEQ ID NO: 333 - DNA, 1047 bp, Homo sapiens
agctgtgactgaaggatgaatgggagtccttagaaatggaatggatgcagggatattccagacagcatcaacaaagatcctgggttcagggaaagcttcctagaggtggcgacacatttgggcaactgccagcattatgtgtggctgaagctggggctcaattggactggaaggaaaaggttggtgtgaggaggggcctggcaatataggacgggccttgagtgccagcataaggaacctggctttatctcaagaaccactggaacatttcaacagggaaggcagcctggaggatggtcagcaggggcaggagtggcagtgggaggcagctgtctgggagagacactctgaaccctagactagggtggtgggtggtgggaatgtggagaagggatgcatctgggagaagttctgggggtggacagaccagacaggacttagcaatgtgtgggtgagggaggcagaggaggcctgagaaactaaggtttggtgcctttcacaggtggacacctaggaggagaagcagaatagggagcgaggagacagaatgatgagggccaaggagagtctgaggcaaccacgaagggagtacccagtactgagttggatattttggcctagaccttgatggggtggcctgggccttgggctcacccctggcctggactctgactttagccctcttacagctaacccacctgctttccggggcccagcccgtgccctcaccagcctcacagtttccaggagacagtggagcaacagctctgagggactcatcaggtgcctcaagcttgagccttctgacaagacactgttctggcaggctggaccagggctggtgctaaagttcccccaggagggctgggggagttagcattggcctcacctgcaaggtgtccctgatggggccccggatgtcaatcacctcgccttgccggatcacaaacttggggagcctgttcagaaatttctcagcagtcatcctggagcctacaggcagagttgggaaccggggcccaggaaggactatgagtggtggtggag

SEQ ID NO: 334 - DNA, 1041 bp, Homo sapiens
tcggggctcgggctccagcctgcgtggggactccaggggcagaaaggtcttaagccagactcaccacgcagggccgctagccgtcccgcagcgccgccatcttgttgtcacgcggtttcctaggcgaccaggacccgtgcacttctcattggctagtttgagggaggcctgagcaacctgcagacagcgaaggtggatacagtcgcctgtgctcggattctattggcccacagagtcggtattcttcgcgggcgaatcccagaatgcaccgctctgagagggctccaggtccggggcggggtggggggggggggtggttcgttcctaccctcaggtgcgggaggaaggagcctgggattaggttaatgaaactgctggcagcctcacattcaggacctgaatgtgtgatcccgacagtgccgctattttgctaaattgatcttgggaggaattatccctcttagcttatttccccatatgatcagtattgtaacacgaagtactgtaatacttcacggaggctgctttgaggatggattgcaatgatgcaagtacttaataaatgtttcctaaatctgagtttctgtgacaaatccttgaccagattggcgcccggaagggcggcccaaattctagttcccttgtgttaagagttgggtaagacaatttcccctcccagagcctcatctgtaaaattgtgttggattagactcagtcaccaaaacagctaaaggcagttaagaccacgaactttggaattaggagtcctggctccttactgtgtgttcttgggcactttatacaccttagtttttatatctgtaaaacagtgataatacctacccccactgggttgccgtgaggattaaataaggtaatgcaaagtacacgattttaaaggggaaagccgaaacagaaacacctgtagagagcactttttcaaaaacgtttcctgctgttaatcatcatcatcatctcttcaccctttcagctgtgatggtctgggagtttatgatttctgatctcaggcactcacttctt

SEQ ID NO: 335 - DNA, 1627 bp, Homo sapiens
gggggctggagacggtgtcgggcagctcggggctaaccctgagcggctcggctgcccgcgggcgccagaggccatattggaggagcggcggccgcggcgggaggagccatgttggcggctgtttatcccgctctcctcgggctcgccgcccccgccccgtgccccctcccccatcgcgagggccccttccctcccctccctgcgggcgggcaattcaaacccgaaagggcgggaaggcggcgctcggggttggcgggcgggggaaagcgctgccgccaaaaaaccgccgccgtgaggggcggggcttgtgcggtatggccccgccccctcgcccacgttccccgcgcacgagacgcgcgctgtcgccgcccacgagttccccgggctgcgcgcgcctccctctcccgccctcgacggctgccatagcaacggcgctgggctccgcctccggagggggtttgtttgcgccatctgcagctgttgctcctgcctgtcgcggtggtgcgggctccgctgccctccccggctgcgctccggtccagccctcgcttctcggggtcggcgagccggagctcctgcgcgcgcttcgttcttatacgaacgtcgggctcactcatttatgtcctagaaaagttgtgtggacgactgctttaattttcatttttagcactctaaagtttgggaagtaattaagaaccacctcaaaatctgcagttttttgttcttgtttcttataggctgaaggggatgctaagggagataaagcaaaggtgaaggacgaagtaagtcattctctcttcaagggtcaaagccttggactagcagaggccactggactcggtgattaaccgtaacctgtgtcctgaatttacactcctataatctagagcaaattgataccaaactttcaaagcgacttacctgtcctatttctaactttctcgttgtctttaatagccacagagaagatccgcgaggttgtctgctgtaagtgtatgcttttgaattttcgtgcttgtccctgaaactaaaaaacatcaaaaaacaattccctttgcttccatgaattatggttagtgcctggttttgaatcattgcctctacttgggactcttgcccctttgggttttgctggttctgaaattctgatgcctgtagccaaagtgggacatttgagtgggcttctggaaatccaacattctagaagaaagccaaccacaaaaacttttgaggaggaggagaaacttctctacccttggtacttttggttggttgtgggtggttttcttcagtccattgtactgatgttcactttttcctctcttcctgccaaaaaaagaaacctgctcctccaaagccagagcccaagcctaaaaaggcccctgcaaaggtaagtgctaacattggaactgatcattttcacagaatgaggactgtccttagtgccttaacttaattagcataatggtgcctccattaatggaggttataaactgtgtggatagcttacctcgtccgtgtcattcataacgttggtttcctgatcaagaattctgttgttagtttataggaaaatctgcatttaaatattaaataccccagggtttaaactaatttattcttctgt

SEQ ID NO: 336 - DNA, 1049 bp, Homo sapiens
caactctcaaaattctagaagcaactgaagcttgtaaatatggtaaaaatgtggtattcaaatatattggcaccgagtagttcttttctgccagtgagctgtaatacctggggcttgaatggagtcctgattcctgtggcttttatctctgggtttttccttgtttagattggtcattatcattactgacgcacacttacgttgttattactgatgcatacttgagttgtgtgttgcgttagtggtaaagagcacaggactcacaacaggaggaggaaggaggaggcttaggttccacatacagctccagattaagctgtgtgaccctgggcaggtcatttgctttctctatttttcattttctccctcatcaataaaatgaagttggtctgcatggccttctcactctaagatgctacatatctgtgcttccatagctggcttgttatgaaggcagctttctgtacataaatcaggggtcttgagaccatctttcttcccctggactgaaggaactcaaagctattttctcctgggattcacaggaacaagctctgaacagttgggtgccattgtggtctgtagacttttacagaaaaagctctaccagactgttgccttgaaactgttaatctgtttgtcattagtcattccacctggctggtggttttaaaacactaaatagtcgttggaaagttaggtagatttcattaaagcaagacttgaaaaatagttgcttcaggatccccaggaggcttttgcacttggggttggggtgaggaatggatattcataagttcagtgttgatattctgctgcttttggggaggggtagggagagagagggagcattaagctctccagactcctggtgtttgggcaggtctaggtctggtttgggcagttggttgtaatctgagtgcctggacttgccctgtaagttttgctgagagagaagcaaatgttcctgagactggaagaggaaaagctgcgtttcagggtcaatttcataggtgcatttgttgtttctcatcgctatggtttaaaaa

SEQ ID NO: 337 - DNA, 1056 bp, Homo sapiens
aaaacttggattggcactgacataggttgcttaatattgcatggtcctttcccagtatgttggtagtgagggtattaggaacttcagacttattgctgagagcatagtttctaagtcagagagatcaggaaattccaatggggatgggaaatagccctatgtgattacaccagctaggtactaggaagagatttaaaaggtagaaacaatatctccttcagaggcatttagttttcttaggaaagcatgcttatgtgcacacatctggaaaacttgaaaagcaaggtttcataaatggatgtagaccacactaattatgtgagctgaaggaattagaggaaaaggttcaatcagtttggcagggttaacctgggacagcttttcagaggctttttttgtgaagctaaatgttcaagaaacttagaatactaatttgccttttcataatgctattcttaagttccatgggcttgatagaatccacattgcacatccatctccagaccagtagctgtctcagtgttccaatgactttgagaatttggactctaaccataaaactccctgaaagagtggttccagggtcttagtggttcttgtggtcaggtagagcctttggtacagactgttaagttcttggctagttcaggggcacttttctagtaaatttggatttggaaggtcatgtcaccttcagagttgtgtgccctggacagctctgtagtaatggtggttcaactttgttggtgagtctgtcttggcagagttagttgacctttcttaaaacaagagccacgaagtaagtatctgttgggactcttaggctgctatttctgaggagctgggagctgtgttcaagtcaagttgcttgtgttagaccttatattgaggttgatgggttaggtaagcctgcacatatgcagtctgcccatttattcatagaaatggcctttaatactgtttttggccgggcgcggtagctcacacctataatcccagcactttgggaggccaaggtgggaggattgcccaagcccaggaccagccttgggacca

SEQ ID NO: 338 - DNA, 1688 bp, Homo sapiens
caaagtgctggaattacaggtgtgagccaccacgcccagccttttttttttttccccccccctcaagtaatggtccatgacctgctgaaagtactggagtcttggataaacattctggtttagaaataccttttccactttttttgccttgccattttggcattttgcaaaagtgggttttcagttactcagaattgggcaccatagttaacctcctatggattacaggtgtttaggggcttgaactctgatcattcccaggttttagaggaatccaagttcgggtgaatattgacttagtagccttgagtattcttcctgaaattacccctcctctccatttaaatggatgaaattagttttttactgaatgtgaagggacatctgaatgaacttctgtttgtttttgttagtcacttgtgcatagctggaatattatcttgggacaggttgagtctatttcccagtggcttctgcattttctaagggtggactggaatgggaagaagtctaatgccaagaatgcattccaacatgctgcagagtaggaaatttgatccctaaaatgttgacttagtgttggtcatggtacatattagaaatcacccagtaatccaggacagatttttgtcaccctccaggaagttatgttgatataaatactaaggggctttgggtactgagctaagtgctctgcaggcccaaagcgctgcttgaattgctacccatatgaagaggaaatgtgccatgtgcctttttttctctcttttgcatttgggcttccttatggctttgttgcttttatgttcccaagtctgcaaagttagatattagacttcctcctcccttggcactggcagattcatgattttccatggctcatcactagcagccaagatttttgtatgcttttctctcttaaacttgttcgttttcagcttgcttgtttataggcatctctgttaaaaggaacccttcttttccccttaagatctagcaccaggggtgcttgggggttgttgtgatatcagtcaattaaaagcccatttggtgtgtgcttggtgtttttattttgctcatgttttctttgaggtcacaacgtgcttgccgggcatgagtgcctttgggcccagctgtttactctcaactgccgtgtactttgactttaagaaaagtgcaaattcagccacgtggtagagggattaaaggccacatagtgttggatgcttccttttggaagaaacagatatatctttgggctcttcttgcccagtgatttctcctgtctggggtagacattgttgctttctgttgtccttagagaacagggcagaaatgctgggaattggtttattactgtgtctctttggcaaatatgtatgtctttttctcttgccctttggacaacattctgttctggtcctaaggtgttggagttcacaggttgatctagcgttatgtgaaactcttggtaatttaggtttggataaccggcttttagtctccagatttctaacattgtgcttgtttaggaatttaggcttctaaagagaaccatattacaaagcttttggggaacaattctgtaggtagtttatctgttcttgggtcacagatcctcaccaggatcctgacttttttttttttttagacggagtcttgctctgtcacccaggctggagtgcagt

SEQ ID NO: 339 - DNA, 1164 bp, Homo sapiens
ctcacagtaagcctttattgacctctctccctcaccccctacttcttagtggccagtctgagttttgctgtgaattcctttccttgtgtctcttcttgtgaagttttagtaaataaaccctgtaagtaggccgagagcagtggctcacacttgtaatccccgtgctttatgaggctgagatgagaagattgcttgagcccaggagttcgagaccagccttggcaacatagcaagaccttgtctctcttaaaaaaaattttttttaaattagctgggcctggtggcatgcacctattgtcccagttacttgagaggctgaggcaggaggatcacttgagcccaggagtttattggaggctgcagtgagacctgattgtgctattggactacatacagcctgggcaacagagcaagaccctgtctcaaataaaaataaaccctctaagtagattcctgaacaagccacctcatctctgcagtgaatgaggactctctgaggggtggacatttgagccaagacctgtctccagttgtataacttaatgaataaggattgtgcttggcacagatgtgggagttacagaagtggtcaggtgataaatattaacagtttgaagaccaagtgaagaaccagtgttctaattcatttggactttctgaacaccttatgtggtttctctgtccttcccattaaaaacaagtattctgctaccaggcctctttttcctcctgcctgagaagcgtagctgtgatcactgggacctagctgcaatgaaggcagtggtttccaggaggagactacagtttgatctgtgatttcatatttgtatgtacagatgaatactttagtaaggaatcttatgtttgtgtgtgcatgtgtgttttaaactctatcacttttaagctttattttctctgttcttggctttttcttttttcctttttcattttctcctttgatgtctaactctgcattagtagaatgcagagcacatggaaactccagtaactttaccacaccagagctggtaaaatggagatacaacatacaccagtttcagactaacatcattttggtgaagattgatttttttttttttttttggcagagtcttgctttgttgcgcaggctggagtgcaatggcgtgatcttggctttctgca

SEQ ID NO: 340 - DNA, 2462 bp, Homo sapiens
gtttttggggttctgttgacccagtacagatttgtaacattgtttttctttacagtttgtgatttcaatcctctgctttcccaatgccactttgaattggcttctttaaaactccaacataaaacctcaagtgaccaatatgtggtctcattatggtattttgggttaaaatgaaattaagatagctgggctcacccagccaaacacatttaccaaagggaaattttgaggcatcatagactgtgaagtggttagggaaaaagagagttaaatgttggctagtttagaatgccaagtgtccatcccaacttggttatactggccagagatggcaaagaatagagacaataaggttctgaaaagacagctggtgactggtatggccctgtatactcctgggataaatcatgaagtgagggtctcctgtacatacttgtatagtttgtatagacagtggtgtagatgaggttggtatgtaccagcatacttttggaactttgagaagaactgtagaatttgtagtactctggttttccatccagggaattgctgaccttaaaacctgaggatttggatgcatctataatcttttttgtttgtttgtttgtttgtttgtttgtttttgagacggaatctcgttcggttgcccaggctggagtgtagtggcgcaatctcggctcactgcagtctccgcctcctgggttcaagtgatttttctgcctcagcccagcctcctgagtagctgagactacaggtgtgtcaccatgccgggctaatttttgtatttttagtagagatggggtttcactatgtcagccaggctggtctcgaactcctgacctcatgatccacctgcctctgcctcccaaagtgctgggatgacaggcatgagccaccgcgccgcatatataatcttaataaggttgactattccctgggccgttctttaacttatttaattgtgcctgctatagttcagagtggacttagggggacctagtgaaagactggtattttggggaagtagtccaaggcagccctaggaattaatgaaataaacagtggcattgctgctgcttcttggtgtttttatcaacatacagtacttgattggattgatgtacaagcatgatgacaaacagaatcccagactgcatgtaacttcagttcctacagctcagtgatctgtcacagataccttctttggcgggatatagaactatgtattagagaaatttagcgtcttttttgtataactgaaagaccagcccaagtttgcagttgtagataaaataaaaagaatgggagaagttagagaaagaaaacgaggctttgaagttttgtggctaggggcagtttttatctttatttactttgtttatttgtttgtttgtttttagcacttatctgcaaattagtttaacatggaagagggaggagtattttagaaactagatcagaagatgcatttagaacaaaagttggaatgtgcacacctgggtaaagctctgtaaggttactcttgcccctccatgtattccttaagtgtaccatatcacttaatggtaggtaatgataagtagggcagaaaacatcaaaaggacagcaatattcagttgggcatgtggtccatccataccaaggaccttttcctagtagaagcaccagaggatggtctgtgggaggaagtacctttttctgatttcaatctatatcacctcacatggggacaaattttctaatttttgagcatatattgggatgcagtataccagtgtgtctttgcgtaccatcaggatttcctagactttgatgatattttccatttctcaggaatttttaggataagaactttttaaagttcacttaattgcccagtcctgttgttgaaatgttgtttaatttaaagcataaaatatgctggggagagtggcacacgcctataatctcagctactgcagaggctgaggcaggaagatcacatgagccctggagttccaggccagcctgggcaatgtagggagacccgtcttaaaaaaaaaaacataaaatagttgggccttgccaatgtaagaagtcatatggcagaatcttttttgaaaaacctgtgagtatcaggctgggcgcggtggctcacgcctgtaatcccagtacttggggagactgaggtgggcggatcatgaggtcaggagtttgagaccagccttatcaacatggtgaaaccccatctctactaaaaataacaaaaattagccaggagtggtggtgcatgcccgtaatcccagctactcaggaggctgaggcaggagaatcacttgaacccgggaggcagaggttgcagtgagccaagatcgcgccactgcactccaacctgggtaacagcgagattccgtctcaaaaaaaaaaaaaaaaagaaaaagaaaaaaacctgtgagtatctgccacatgctagttgcttacat

SEQ ID NO: 341 - DNA, 1029 bp, Homo sapiens
ggtctctctctttcaaaatatcttattgtatgtaatgttttcagattgtggttgaccgtgggtaactgaaaccttggaaagcaaaatcaaggataatggggggtactcctgtagatccaaagcatttcagttcagcattaatagggacaggaattgccaggccactagagtttcactttctcttctacattcccctttcctttcctgcttttgggcataggggagcatttgtttgttttgtatacatatctcttatctctgcctacctgaaatttatattctagtcaaggatacagatagcaaacaagataaataagtaaagcattagtatgttacgatacttgcccaggtgaaccagaaaaatctgagactgagtataggaatttggggaagcttgattttggctgaaagtgctgctcatttgggaatctgaggtgcatttctagcttttctttactggccaggcactgccctcttcagaccattgtttggctaaggaaaacgaatgtacatctgaattctagagacactctgtgctggagatggatttgcactataacaggcatttcacatacttatcgtttgaactgtctcatatttttgttaaacagtttttaatccctgtttaaagatgattctggtgccaagggatgaagtgacttgcttaaagtggtgtgaaactctatactttttttttttttctttttaaaaaggtacaactgaggccgggcacagtggctcacgcctgtaatcccagcactttgggaggctgaggcgggcagatcacctgaggtcaggagttggagaccagcctgaccaatgtgatgaaaacccgtctctactaaaaatacaaaaattagccgggcatggtgacatgcgcctgtaatcccagctactcgggaggctgagacaggagaattgcttgaacccgggaggcagaagttgcaatgagccgagatcgcgccattacactctagcctgggcaacaaaagtgaaagtccgtctcaaaaaaaaaaaaaaaaaaaggta

SEQ ID NO: 342 - DNA, 1083 bp, Homo sapiens
gaagtttagctaattttgacctaaatgaataagttatttcttgaattcaaggaacttaaaggctgacttgtagatgtctgttctgtctccctgcccagggaataggtttgtgatctgtttagtttgtttttgtctttttaagtcttgtgcttttagacatggacccacatgaggggcagagaagatggagatatcagaagcactgtctgctctccatcaaagttgagaaaaatatcagtttcttgactttactcttacaggcttaatttttaggtttttggcttaatgtttagctacaaggtaggatcctggagcaattcagcatgcattgtcacattgagcgtggctggagcaaaagcagtttttctggtggtgattttgtgtgaatactttttttttttatttttggtagagtacttgatgcccaggtgcttaagttatggaatcaggtacttatttatgggatggactgaccatatcctgagacaggcagtatagtctagtgattaagaacttgggctctagagccagagttcctggctctagcttctgccaccaactctgtttcataggggtggtggtgaacattaaataggttactagagagtgcacacgagcactgcacattgtaggcactccataaatgtcagcctttgtaatcatcgcctcagagggcattgggactgtgctttatacctgaaaggcagttaacaccatactaggtggttgtaggaacctttactgttagtcttagctctgtgggcaagttactcagcctctgaaagttaatctgctgggcacagaaataaaataggctactctgaaatctagtcatctagtaagatggtgggtagcaaacccaccatgacaaatcctgcttcagttaggaaatggaaattcagccacatacccagataagaatcttttggaattttgactctacttggatgtaaagcctgtgtcttcatttattctgacctgagagaaatggtttcaggatctctaagaaataggcagaaggcgggaactctcttcatcatgaagcctcccatggattcccctgaaggtctctgagacacctca

SEQ ID NO: 343 - DNA, 1047 bp, Homo sapiens
tctctgagtgtgggagaccaccaccagttgtttcgtgcgtgttttggggaccctggctcccagtgccttacccagttcagaacccatagtggagccatccacagctcccagcatacctctgcaacttcatctccagccactcatttgtaccttaagctcctcacaattcctggtcctcttgattaggatgtatacctgtttctctctctttctgtcatgctcagcaaacttctactttggcttcaaaacctagctggaatactctctctgagacttcttccccattttcatattggcatagccttatgctggtacctctgcttgaactgtatctgacatctgtcatgttgtgcccagaacaggcagatatttgtaaacctttgttgaatacctcctagattcttgctacctagttgagctttgggagctgacgttttgttgtttaggtttattgagaggagtgacaaatcctctcaataaatgctttaaaaattagaacatttggctgggcacggtggctcacacctatagtcccagcactttgggaggctgaggcgggtcatcatgaggtcaagagttcaagaccagcctggacaacatggcgaaaccctgtctctactaaaaatacaaaaataggcaggtgtggtggcaggggcctgtagtcccagctactcgggaggctgaggcaagagaatcgcttgaacccgggaggcagaggatgcagtactccatctcaaaaaaaaaaaaaaaaaattaaaacatttgaaggattttaattttacacagtttctgttcccttttgttcatttcatgatagaaggagagagggcccacagtccttatctaggtttttgatggttgattttcaaaaagataacagaaatgtcactagcgattttggtaaccagagaagcagggtctttctgaggttggtgacctgttttctttatagctgaccatgtatctgtgcctgctccccttgaattatagcccaggtgctctctcagagtctcgaaaaggaaatccccaccccctctgtcatatctg

SEQ ID NO: 344 - DNA, 1054 bp, Homo sapiens
caccctgggcaacatggcagaatcccttctctacacacacacaaacacagccagacatggtggcgcctgcctgtacacacacatacagagccagatgtggtggtgcgtgcctgtagtcccagctactcaggaggctgaggtaagaggatcacttgagttgggcaggttgaggctgtagggagctggcatcatgccaatgtactgcagcctggggtaacagagtgagaccctgtctcaaaaaaaaaaaaaaaagaagaagaagaaccaaggatgtaatccctctatcttgggattaacatggggctcttcatagctccaggtactttagtccttcgagaaaggaggatgtcctttgctgttaccttgtggttggcctcttgaaatcattctatgctggaacgaattctcattgcatttttaaagtatgctatggcatacctggcctacttcttaccaacaagaaagctagcattttctgacttctcagctaacatggaaagctggacacaggcacaaatgcacacctacctacctgccttcagagcaaactttgtctccaagagctcagcagaaatgctcccagcctaatgaggtacccaagtggtttgtggaaggtccacccagcttggatacttgaaggagagcctaaaagctgccctctgacctccagtgttaactgtcagatcttagggtcaaagtcactttcagccgatctttcccgggtgagcttgtttgtgtgagcaggaatagactcaaatcaaaccaacttggatctcctcctccttgagatgtgtggtgttttcggttttgtttttgtgtgtttgtttgtttgtttttgagatggtgttttgctccgttacctatgctggagtgcagtggtacaatctcggctcactacagcctcctcctcctgggcttaagtgattctcccacctcagcctcccaagtagctgggactacagctgcacaccaccacacctggcttatttttgggggtatttttagtagagacagggtttttgccacgttgcccaggctggtctcgaactcctgg

SEQ ID NO: 345 - DNA, 1065 bp, Homo sapiens
ttcacagtacttgtctgtgttttgatggttgcccccttacattttgcctcatttggtcggcagttgctgaagactcaatgttcggtcttcactcatcaagtcattcattttggtttttgtcattgttctttgtcttttcaaacctccatttagtagaaacagctggcatgccctggttaatggttcatgtcactctgaaggtgcctaaaatgacacaccactatatagaaaatcagatagagactccatgcaagtggctgctaaagaaaatgtagatggtaaagtcccaggataaggatggagagcatttgttcgcattgtataaagctaataactatatggatgctacccacaaataggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtcagtatactacccagttaggagtagatacgggtgagaggagaaaacagttccttgtctgatatgttgccatctagcttgtaaccttgtgagagaagggctgtcctttgcctttaatccacccagcccaggccctgaagtagggcaaggcaagattccatttgtctccacttattctgtcaccatgagaaagtctttcaatttcactgagcctctgtttcatttataaaaatggagattaggtgtttactccaccattgagcacagacaatttatacatggtagctcttggttattatttttttattaattatttttagtgaataagtcataatggaatagatctttgctcaaaattgcagccctaggctgatcaaaagttgagaatcttacacagagcatggaaatagaaaggaagttatcttcttctggaagttgaaatgcctgtgtggcagcaaagccagccttgctctgacctgcctttacatgcttctggaatccccccctttttctcatggcgataaaggctaccatgaag

SEQ ID NO: 346 - DNA, 1080 bp, Homo sapiens
ttcaagatactgtcatatcttggattcttgaaatacctccaaattggcctccctgcttctgctttgcctggttgaacctattctcaacagagcaaccaaaaggacccctataaaaggtaagtcagatcaaacgccttcagtgcttctgactcagtaagtaaaaatccagactcttaaaaagtggcctacaaggccctgagttatctagcttacctctacctttcctgcaccatctgtcttgcccgttgctcaccccactgtatagagatgtttccaccttggagtctttgtactttatactctctcaccaaataactgcatggctcaagtcctcgactgcttcaagtctttgtccaaatatataagtaaggcttttcatggtcaccttacttagaatagcaatctctgccccccactatgtttcccttgtctgccttatttttcctgtggcacttgttactgtctggcctgttgtgtgttgtacttacctgtcaccttccactgaaatgtaaactgagggtggtgggaggggtgttttgttcactgctgcatcctggtgctaacacatagactggcacatagcatctacttaagtagtagttgaatgatactgtcgatgttggctagatgcagttgcttttatgaggctaatgtcacaatatatagtttctctgttcacccccttccttagggaaacaatagagaagcctcaagttcctcaggagaaatcagaagcagaaagagaaaaaatgctatcattgtggacacttagaagtgaaatttgaaacaagaaacaacagttttctattgtgtacctacttatattctggacatagcacatcacaatcctacaacaatcctgtgcctgtgaagtcagtatgtggctcccattttacagttgaagaaagaggctaagaaaagtgaaaggctttttaagttcatacaccaagcaagttccacctgactccaaggatcatgcttttcttaatataccacactacctcctttctggatgagaacccaacccaggagtaagggatctagctgtggagctcagcaagcaagatttgtttttattgt

SEQ ID NO: 347 - DNA, 1023 bp, Homo sapiens
ctactcaggaggctgaggcaggagaatcgcttgaacctgggaggtggaggttgcagtgagccaagatcgcgccactgcactccagcctgggtgacagtgcggcgagactccatctcaaaaaaaggaagaaagaaagagagagagagcgagagagagagagggaaggaaggaaggaaagaaaggaaggaagaaagagaaagagggagggagggagagagagagagaaaggaaagaaaggaaggaagagggggaggagagggaagtggagggaaggggagggaagggaagcagagggaagggaagaccagaagccatttgcttttacattttagagcccaaagtacacttgcacagtcttgcctgaagtttgtgtcaacttcttggttctctgtcatgatgtagtccacagagaccttgattatcttgacctagcacgtaacaaagaagtagaaagtacttttagatgccttaataaaacatgaaataaaggatgggagggaaatatcacaaaaactcatgggcctggtacttcagagaactatctggtggtccaaattctgtaaatcggctgggcacggtggctcaaacctgtaatcccagcactttgggagcccaaggcaggcggatcacttgaggtcaggagttagagaccagcccggccaacatggtgaaactccgtctctactaaaaatacaaaaattagctgggcgtggtggtacacgcctgtagtcctagctacttggaaggctgaggctcttgcttgaacctgggaggcagaggttgcagtgagccgagatcgcgccactgctctccagcctggcaacagagcaagactctgcctccaaaaaaaaaaaaagtaataattataggccaggcatggtggttcatacctgtaatcccagcactttgggaggccaaggtgggtgagttgcttgagcccaggagttcaagaccagcctggacaacatggtgaaaccccatctctaccaaaaaaaaatttttttaattataaaataaatataa

SEQ ID NO: 348 - DNA, 1059 bp, Homo sapiens
actccgatccccaatgagtgcccagctaagaaaatgtttgagacagtagattccagtttgagagccggagcttccctggctaccacctccaacctgggcaccagggcccagccagacaactcataacactggcccacctctctggtatctccctcaggaggacacctgtcaggattttgccatctcctgcacagcctgaggggagctaacaggcctctttgcagagggttagctggtaagaccgtttcttccctgtcggccagcactgcccgctcccctcacacaccatctcatcctcatcgcatgcctcgccaaccccatggagcccgtccatctgtctggtgtgtggtgcggtgtgtgtgctggtggtggtagggtctccagggactccccgctaagcagaaggatcgggatatagggcaaggctaaaagcccagccccattgtggactgaggaagtagcttctcgcagagcagctctccagctggaagaggaggtggagggtgaggctggggagaggatggcgaacctgccctgaggtgcttgggtctgtgctggtggggtcctggtatgcaggggccaccggtcactaacactcttatgtcctggctttctgtccccgctgagctttctctcacccgcccgttttctctcctgcttcattgcctgctgcctaagccttggcccttctctcgggcagaggcaggtgctgtggcagcacctctccccaccaccggggcccctgcaggccgcctccctcctcccaggcctgctaaccctctctcttctccttctttgctgtcctgccggggatctccagtgtgtgcgggggcttaaggacctcctgaggaccgctgctctctgcctctccaggaatggcctggggggagccaggcacccggcacctccacctgcctaacctgtggcccatctgccaccatctgtgcctacagggtctgccccccagcctgcccggcctgtgtgctctctaggacccccatagggggcaggggctggcctctttgccccattcccgctccatgccggccagagtgtaga

SEQ ID NO: 349 - DNA, 1015 bp, Homo sapiens
gcgactgcaatttgtactcccatgaagctggccctagtcaagtacgcagtgaggtcgatgaggaggaggctgtcctgtggtaagtcccttctaggattggaagagatgagtaaggctactttcagcttcactgctctacaagctgggggggtcgctagcaagggagaggggcaaaacttgtccctttttaacttccaaccctgccagatttgagtccagggctttctagaagtctccacggcatcgggtgaccatagcaactcatgccaaactctcgggcccacggctccgcctaccgcttcgtggacgcgcttgttgattggctccgaatgtcgaccaatggtcggcgaagcgggttgcttgccgcacggtcaatggccgcaaaccgggaggaaggcgggaagagaggaggtggaggcgggcctgggcagccgcgcgcgtgcgtgtttccggctccgctgcggaaggcggacgactagagtcgttgggcccggcgcgacccgcaggagcgtagagagcgcgggactagagtgcagagctccgggacgtggatcggagccggcgcgatgggcggagagcaggaggaggagcggttcgacggcatgttgctggccatggctcagcagcacgagggcggcgtgcaggaggtaacggcccgcgcggcgtcggcccacccggcggccttggccacgctccttccgcccttctctgccttcgagggctgagacccaccccagcggctcgcgggcttctgggatgcccctacattctcactgcgcccagcttccggcctggccacccgccagcaggtctcacccggttcgcatcagtcccgggcccccggcgcccctcagtagtagcaaattatcgcatccctgagcttaggatccccctttagtttcacatatgcccccacccccgtttccactttgatggcggcttccaaggagcatcccttagtaagaaccgtcgcaaatatcgtgatttggatccaccaaggcttggggcgagccgt

SEQ ID NO: 350 - DNA, 1470 bp, Homo sapiens
tcagtaacattggccaggctggtctcaaactcttgaccttgtgatccgcccatcttggcctcctaaaatgttgggattataggtgtgagccaccacgcttggcccctttttttttttttaatttttatttaatttatttatttatatttctgagacagagtctcactctgtcacccactggagtgcagtggcatgatcactacttaccttgacctccccaaggctcaggtgatcctcccactttaaccccttaagtagcttggactccagtgccatcatgcccagctaatttttctttttcttttttttttttgagacagagtatcgctctgttgcccaggctagagtatagtggtgtgaccttggctcactgcaacctctgccttccgggttcaagcgattctcctgcctcagcctcctgagtagctgggattacaggtgcgcacaaccatgccgggctaattattgtatttttacaatgtagagatgaagtttcaccatgtcagtcaaacctgtcttgaactcctgaccgcatgatcctcctgcctcgacttcccaaagtgctgggattacaggtgtgagccactgcgcccggcccccagctaatttttctgttttttttgtagagatgaggttttaccatgtttcccaggctggtctctaactccagggctcaagtgatctgcctgactcggcctcccaaagttctaggataacagatgtgagccactgtgctggcccatgttaaccatttttaagtgtacagttcagtagtgttaagtgaacttacactaagaaacatatttgtaagacctctttgcatcttagggaactgaaaccctgtacccattaagcaacttcgctttgttccctcccctacctcctggtaactgctgttctgttttctgtgtaggttgactactgtagatacttcatataaatggaatcatacaatatgtatgtctttgtgactggcttatttcgtttaatgtaatgtccacagatttatccacattgtagcatgtgacaggatttccatcccctttaaggctgaataatattccattatatgtatatatcacaatttttttttttctttttgagacaagtcttgctctgtttcttgcccacgctggagtgcagtggcacgatcttggctcactgcaacctcagcctcccgagtacctgggactacaggcacacgccaccacgcccggctaatttttgtatttttattagagtcggggttttaccatattggtcaggctggtcttgaactcctgacttcgtgatctgcctggctcggcctcccaaagagctgggattacaggcttgaccaccgcgcccggccacaatttttttttttaaatctattcttctgctgatggacttttgggttgctttcaccccttggttattgtgcatagtacttttgtgaacataggtgcacaaatcttttgagattctatt

SEQ ID NO: 351 - DNA, 1153 bp, Homo sapiens
ttgggggtggggtgggtgagtagagaattagagacgacactggctagtgtgtgtgtgtgtgtgaagtagagggtagtaaatggagattggtcctggtgtcacaggcagctctgccccctccctccacttccagatgtcccactgctcctcatcaagcttcctggccagggcacacacatgtagacttgaaccccagctcctagttagtgctatgtccattaccacatagccaactaacaaaaggcacctcccacacctgcctgaccctccagggccccctctagaagctcacccgtctggctttattcaggctgggtgcggtggctcatgcctgtaatcccagcactttgggaggcccacgagggccaatcacttgatgtcaggagttcaagaccaggctggccaacatagtgaaaccccttctctactaaaaataacaaaaattagctgggcgtggtggcaggtgcctgtaatcccagctactcgggaggctgagaaagaattgcttgaactcgggaggtggaggttgcaccgcactccagcctgggcaacagagcaagactgtgtctcaagaaaaaaaaaaaaaaaaaaaaaagctcacccgtctgcctccattttcttcttaattagcaaatattgataggggctcagaaagcagagccaaatcagaggagggtctctacttttaagggcttatgtctcctggctcttttccaggcaggcttttctggctgtcaccatcccaggggatcccttgggggctgagcagtttgttggaggccagctctagcctcggacagaaggctgacccaccccttttccccacatgactttcagaacactttcttggtggcccccagctctggggacaggactgagtacagggatcttgggggacctgtgcattgaggacactgacggccaccaatgaatttatatctcagcaaagggaaatgaggggggaacaggagcctttcttcaggctggtgcttggggctgggagaccagttcaaggttctaatctgggacctgcccctcaactggataaccatgtgagcgttgccaccagagggcagtgtggggctgctttctcgagacgaaggggtgtggcctggaggaggttcagtcctttattgttcctgcccccaatcat

SEQ ID NO: 352 - DNA, 1803 bp, Homo sapiens
tagatgatctgggtaaagtggcagtgaagtcttccctttctaacaaagcctgaaaccgttttgagaagaaactattttgagggcagcttctgactcaaagacgttacgaaatccccacctaggacaccggtatgcccagtggtccctactaagcttttctgtgtcttttagagtcgttgagtggccagcttctgctcactgtactgaaggaactacttaatgctatttctgtcttgagttctggcttattcttccttgtgattcttatatctttagcgggattgaattgaatttttgctgttgagtgtaatagccagatcctctgtaacagaccagggagtaactagttgggctcctttgggccaagtctgagacttactgaggtttcttcattgtaggttgttgtatttcgttggcaggtgggaaatgaccttttccgtcatagtttgtgatcatgctgctttaaggctggagtcctgctctcctttccttttttgacctatatgggagcacttctgttcgagtcttatctcaatttgaaggaacagtgcttttggatcaactctgccgaataattgagcagtagcccatatttctgcctgggacaccttcattgagggtcacgagggaaagagagaacacgtgtaaatattatgatgatgatgttaacaactatttaccagtttcatacaattgacagttttttttagccgggaggagttcagtattgactcattgggcatcttatgtagggtgtttttgcacacctagactttaggatctggaaagacaactgaaaatcttgaagcccactgccaaacatttgtggatcttgggccaactgctaaggaagatctagactatgacttggtctttaattatttttatttttttctcctttatgtatgtatgtatttatttatttattttttgagatggagtcttgctctgttgcccaggctgaagtgcagtggcgcgatctcagctcactgcaacctcagcctcctgggttcaagcaattctctgcttcagcctcccaagtagctgggattgcaggtgcctgccaccatgcccagctaatttttgtatttttagtagagatggggtttcaccatcttggccaggctggtcttgaactcctgacctcgtgatccaccgacctcggcctcccagagtgctgggattacaggtgtgagccaccgcacctggcctctccttttatttttatttttttgagatggggtctcactctgttgcctgggctggtctcaaactcctgagctcaagggattctcgtacctctgccttcctagtagctgggactacagacacggcctccgtgaccactctcttctctctttttaaaaattaaggaatgttgctgacatgtgcagttctgagtctcagagaggaagtcaaacagaacatgtaatctggtgatacttgtgttttctttgggtcactggtttagttatctattctgtttcctttcttctttccacctcacctttccagatgctccactgtatctttaggctgccattgcagattgctgggcccacaaaacccttaggttgtactttcttagctgtcatctcttgaaaagccaaagttctggcagttgctattagaaaccagttcctggctgagcgcggtggctcacgcctgtaatcccagcactttgggaggctgaggtgggcagatcacgaggtcaggagattgagaccatcctggctaacacggtgaaaccccatctctactaaaaatacaaaaaaaattagccgggcatggtggcacgcgcct

SEQ ID NO: 353 - DNA, 1093 bp, Homo sapiens
ccctgggtttgagttcctgttccatctccagttttagctgtgtaatattgtgaaaattgttgcatgtctatgaatatgtttcctcatatgtaaaattatgacagtaagagcatctaccctacaagctttttttgtttaagacaagtgcagtagtgacaagaggggaaacagtagaacaaggagttcaatatgtaactgtgaataatcaattgagataacttggtacctttggaccagcccgtaaaacttttttttgctgagatggagtctcgctctgtcgcccaagccagagtgcagtggcacgatctcagctcactgcaacctctgcctcccaggttcacgcgattctcctgcctcagcctccttagtagctgggattacaggcatgctccaccacacgcagctaatttttgtatttttagtagagatggggtttcaccatgttggctgggctggtcttgaactcctgacctcagttgatccacccatctcagcctcccaaagtgctcggattacaggcgtgaaccaccacacccggccaaaactttttgaaccactcttcttctggggtcttagcactctctccctggaagtggttttcccccagttctttgctgctgcttgtcattcatgtttcagcctaaatgtcatcttctcagagaacccctctctatcaggcaggatttgtagttgtatgcaacagaaaccaactctggctgattattgaaaagatattaaggaaattcacaaaacatcagggaaggtcatagagtcatgcttgaagaatgctaaaacaagagaaactgggcaataggcaggacccacgactaaaatcattcatagactcagcctggtgaacacactgttgccaccactacttacacagctaacaccacctgctgcactggacttaatggccactgtggccaccccttgctacactccaggtgaactctctgtggtcctctgactctgagacactagatcccagttcagggtttaggggtgatgtgtctggttggcatagcctgggccatatattcacattgtagctgcaagggagcctcagaaagagaatctcagtcacctcctt

SEQ ID NO: 354 - DNA, 1045 bp, Homo sapiens
ttcttaaacaactgcaattactaatgggatctatgctgcccattgggcactgaacaacttgttaaattttctaatcaaagcaaacactgctgccttcatttcctgtcccacattgattttcatttgctttttatcacagcaaccactaaagacccagcttcttttttttttttttttttttttttgaggcggagtcttgctctgttgcccaggctggagtgcagtggtgcgatttcggctcaccgcaagctccaccttctgagttcatgccattctcctgcctcagcctcctgagtagctgggactacaggcagctgccaccagacctggcttattttttatgtttttagtagagatggggtttcaccacgttagccaagatggtctcgctctcctgaccttgtggtccacccgcctcggcctcccaaagtgctgggattacaggcatgagccactgcgcccggccaagacccagcttcttaaagatgacatcatcaaaaggattgtggcataatgtaataatggaactgtgaactaccttgagctaatagttctctcattagccaaagatgttgaatatctttcaaaatatcctactttgccccctgtgaatttgctgtgggtgccctcaggcaccttgatgcacagttggggaactatggtttagtctgtgggaatagcagttccactactgaaactactgagaggtcctgccggaaacacaataggtggtattataaaacagatactgtgggctggtatcattcctctgtgtacccaaattaacgtctgcagaagcttcttgaaggcatttccagaccagacaaaggaaggacaatgttccagaccagggagtagtgcagagtctcaggttccttcatgaaccctgagtgactccatctggctggattgtagagggtagactggaggagcagtcaaactgaaggacttcctatggctggtgagagaccacagactcaatcctgtaggcaagggaggcattggaagacttcacgagggtctccatttcatttggagttggtac

SEQ ID NO: 355 - DNA, 1050 bp, Homo sapiens
ccatctcagttgcaaactgggtttagatcccaggttgtctgcctcccagaccaaagttctttctgtaacatcagcctttgtcaggggagaagcaggtgctctggtactacttggcgccttttgggaggagctctcatatggggagaggtggtttgccctcctgcttcaaccttgacagctgataaacgtaacccctcctcaccgtgctggatagtttgccaagctcttaaacacccattttatcagaattaaacatccattttctaaggtaggttatcttctcagatggtgaagctgagctgcttgtagcattaagtgtcttgatcaggttcgcaccccaataagcaaaggcatgaagagctcagtcttctgatctaacttgctctttgcactacatcttatccactctcacctgatgggatagcttgttccgctatcaataacagccagtggtgatgtggagaagggatcatttggggccttaggtgttgctgattctaaaaagatcgtagtttttgaattatgttaaaatacttgaattattttgtgttttcaagtacttatgcatataagagcatccaaatctgttctttaaaaataaaatattgggacaggcgcggtggctcatgcctgtaatcccagcactctgggaggcagtggagggtggatcggtaggtagttcgagaccaacctggccatcgtggcgaaacccgtctctactaaaaatacaaaaattagctgggcatagtggcacgtgcctgtaatcccagctactctggaagctgaggcaggagaatcgcctcaacccgggaagtggagtttgcagtgagccgagattgcaccactgcacttcagcatgggcaacacagtgaaactccgtctcaaaataaatagtgaaataaaatcttaggaaaatgtgcacattaattcattcagtgttcttctaacacatgtgctaagtgacccctgtgttcccagatagttctaggtgatgcgaatatacagtgatgaataaaggagatatggtctttagacttttgagagtttaag

SEQ ID NO: 356 - DNA, 1034 bp, Homo sapiens
ccctctctctctctctttttttttgttttgtttttttttttttttttgagatggagtcttgctcttgtcacccaggctggaatgcaatggcatgatctcagctcactgcaacctccgcctcccggattcaagcgattctcctgcctcagcctcccgagtagctgggattacaggcgcctgccaccatgcccggctaatttttgtattttcagtagagacaaggtttcgtcatgttggccaggctggtctcaaactcctgacctcatgatccgcctgcctcggcctcccaaagtgctgggattgcaggtgtgagtcaccatgcccggcctaaggccccgtctcttaaaaaaaaaaaaaaaaagtcaccaacagttagcgagtgcttactctgtgctaggccttgtaataaaataccatcttagcctcacaacagccctgcaacaaggtaagtgccatcatcccattttacagatgaagaagtaagcagagaagtagtgatttgctccgggtcacagaggtaggaagagtggaactatggttcaaacccagcagctgggctccagagcccccactcagagccaccctgtgcgatggcctcactggagcacaggagtggaaatgagaggtgctgtgatgcgaaaggagaatggccgcggaggtgaaaaacaagctctcctgacagcagcaggcctgtgagatggctattgtccccacttcataaaggaagagagtgaggcttacagggattgtcattgatcccaggccacagggaaccatgcggcagagccagattttaacccagatctgctggcctctaggaccctgcctcttaatgtccctcttaacagagggatgttgcctagagactggctgcagcgcaggggcactgaactctggaggaggctgagctagtcctggagctggggaaaagtattcccacagggagcacagaaggcccaggggtgttgaaggacaggaaatagcccacagctaaggctctacgggtataggtgacgaaggggagaaagccagag

SEQ ID NO: 357 - DNA, 1059 bp, Homo sapiens
gcagtgagctgagattgtgcccctgtgctccagcctgggcgacacaacaagattgtatctcaaaaaacaaaaaacaaaacaaaaaaaaccccagaattcccatgaatcaatatgaaaaagaaagatacaactcaatagaacaaaagttgtcaaactttttaatctcaggaacccattacactcttaaaaatcattaaattctgtggccgggcgcagtggctcatgcctgtaatcccagcactttgggaggccgaggcgggtggatcacctgaggtcaggagttcaagaccagcctggccaacatggagaaaccctgtctctattaaaaaatacaaaattagccgcgcatggtggcgcatgcctgtaatcccagctacttgggaggctgaggcaggagaatcacttgaacctgggaggtggaggttgcagtgagccgagattgcaccattgcactccagcctgggcaaaaagagtgaaattccgtctcaaaaaaaaatatcattaagttatcttcttgaatcttaaaaaaaaaaaaaattactaaggacctgtattagtctgttctcactctgctataaagaactgcccgaagctgggcgtggtggctcacgcctgtaatcccagcactttgggaggctgaggcgggcagatcacagggtcaggagttcaagaccagcctggccaacatggtgaaaccccatcgctactaaaaatataaaaaattagccgggcatggtggcaggtgcctataatcccagctactcaggacgctgaggcaggagactcgcttcaacccgggaggcggagattgccatgagctgagaccgcaccgctgcactccagcctgggcaacagagtgagactccatctcaaaaaaaaaaaaaggaagaaagaactgccagagactgggtaatttactttaatttatattgaagtatttaatttatataggaaaggggttttgttgactcacatttccacatgtctgggaggcctcaggaaacttacagtcatggtagaagacacctcttcacaggaccgcaggagagagaatgagtg

SEQ ID NO: 358 - DNA, 1029 bp, Homo sapiens
tcctattcattcttcctattttttgtgcccattaaccatccccacttccccgccaccagtcccccaccattgcttttgctccgtcctgttgatatttacactcatggagcaaataaacacgttagtattattttgagtaatggtcaaacaaatgaaaaggtactcagcttctttagtaatggtgaaattacagattaaaataacaatgaaatactatttcatgcccaccaggagggcagaagtttaaaattctgtgaacactgggagttgtcattatggatatgatgcaacaggaacttttttatctggccggtggtataagttagaacaactactttggaaaacattttggctgtatcttcagaacacatgcagaccttgtgatccagcaattctaccctagagaaacctgtatgtgttataccaggatgtatgtacaagaatgtgcatagcagcattgtttgtagtagtcaaaaattggaaacatccagatgtctgtcaactgtagaatggataaattgtgttatgttcatatactataatatcatacagcaaagaaaatgattgaaccacagttacattcagtatcagagatggatctggcataatctggaatgattcaaaaaaagcactaaagaatataaacagtataattccatttatgtaaagttcaaaaacaggcaaaatgatattgaataagaatatagctcactattcttaaaatgcaagaaaatgattttcacaaagtcaagataatagatactttaaaagggagggatggagttgtgattggagaagggcacatgagtaggcttttaggactctggcaatgttatttcttgatctggggaaaaagataaagtaaaaagaaaaaaacaaaccaaaaacccacagtgttcctctgagtggatagaaatttgaaattcttttcattttgcttgtcctgtattgctattataaaaagggtaagctttttaaaaatgaaaatacattgatttttaccatttttgctttgttttttatttattt

SEQ ID NO: 359 - DNA, 1050 bp, Homo sapiens
cttctgctgggttggagccattcttatttgacccagaatggagccaagcctgtatggcagcagagaacggtcagtggtatttgttatctgggggaacaacaggtctgaggatataagaaacccaccgaggagattcaaggctcagtgagggagtttccttctcactgtaacacatgatggatgtggtggacccagtgccattttcattttttaaaaagctggagtttctgaccatgatcctgactatggcatttttaaaataaattaaaaacagacaaaaaagcaaaactgatgtgctggggggaagctgacctgataagagagttggcgatcatactcttccttctaaaactcaggttgtttttgttttcccccttacgtttctgatttggttattcccagcacacggcactttcttgggtcacattcggttggaacctcacaagcctcagcaaattcccatcgattccacggtctcatttggcgcatccacaagggcatacactctgcgcgagaagcctcagacattgccatcggctgtgaaaggagatgagaagatgggtggagaggatgatgaactcaagggcttactggggcttccagaggaggaaactgagcttgatgtaattccctgtttatgtcattgttttgtctttggggaccctggtttttggagtatacagctgttctatgtagctggaaatgccagtgacttagcagcagggggttctcttgagtccagtaatgggcctttggcaatctggtgtggccagctgtgacagctctcggagagccacattgtatggatttggttgtgtatcaccaggcctaacaaggaggctgagtcccagccactagtctccttgagctgttttgtgcaccttcactggctgttagaagctaagactggaagctacatttctctgtcccttgactgcttagagctaatgctgtccaatatggtagccactaacaatatttcaagtattatgtagtcacatatggctagtggctgctatgttggctagtgcaaagagagaatgttttcat

SEQ ID NO: 360 - DNA, 1050 bp, Homo sapiens
tccttaattttgaaggagaaagctactaggaaggaagcagccagttgtcctttttcatctcaattttgttacttaaaaacaattcttggcgttccttccagccacatttccttttaattctcagcttattgtgggcatgaagacatgatagcctttcttcagcaacaacaaaaaacacaactcaaggatatttgcacagatgacctgttctcagctcaaggccctttacctcttgaatatcactgccccactagtcaatgaggatgttccacattctttctaatgagacttgagacttgttagtattcgtagtctcgggacagtatgaatcttctctaaatgcagaagtgtctcaactccctttggaggtcaagattagcccctcatgccttcctcacctttatttagtatgattttctccatcagattccctttgtactgactgctgtctttcctgtatgaaccctggcttagaacctgacagagttcaacactgcccacaacaagcggatttctacccttaccattgaggagggaaatctggacattcaaagaccaaagaggaagaggaagaactcacgggtgacattcagtgaggatgatgagatcatcaacccaggtgaggtatcttgctagtttattctgatgaaaaagctgtggttggcccgggcgcggtggctcacgcctgtagtcctagcactttgggaggccgaggagggtggatcacttaaggtcaagagttcaagactagcctggccaacaaggtgaaaccccatctctattaaaaaaaatacaaaaattagctgggcatggtggtgttcgcctgtagtcccagctacttgggaggttaaggcaggagaattgcttgaacccaggaggcagaagctgcagtgagccgggattgtgccattgcactcctgcctaggtgacaaaaaaaaaagaaagaaaaagctgtggttggtcaggcatagtggctcatgcctataatcccagcactttggaaggttgaagttggtggattgcttgaggccaggatttcaagaccagggt

SEQ ID NO: 361 - DNA, 1072 bp, Homo sapiens
cctccccatcatacagttactgtttatttcactcactttatagaatctgtgctttgaaatcctgtttatcagattctgaattatatgaaggccaagggctttgtcttttcactgctgtattcttgctgcttgcaatatagccatcaaaaatatttgttgagtgaacaaattaattctgtttccacctagaaagcacttagcatagtgccttatacttgagaaagtgatcaataaatggtgtaaacaatggtcctcaccctggctgttatgctggggccccaccccagataactaaattagaattgcgggaggtgggaccttggcattgttatttttgtaaagcttctcaaaggattctaatgtaccgcttgggttgagaagcccttgtttgatacagcaaggaggttaatgatacctgactttttattaagtgcttattgttatggaggtattgaggtaagctacacagtgttatctcatgaaatcctcatcactggccagtggaagtagttactgctatccccattatttggtaaagaaactgaggctcataaagctaagggatagcaggtggtggagctgtcatttgagctcatgcaatttgtgtcaagagccccatctttttttttttttttttttttgagacagggtcttgccctgttgctcaggctggaatgccgtggtgcgatcatagcttgctgtaacctcaaactcctgggctcaggcagtcctcctgcctcagcctcctgagtagctgggactacaggttgtgtgctaccatgcccagctaatttactgtttgtggagacaggggtctcactgtgttgcccaggctggtctcgaattcctggcctcaagcgatcctcttgcctcagtgtcccaacgtgctgggatgagctgctgcgccagccaagggcccctatcttttaactgcattgtatattgttgttgttgttgttattgctgaaagtgttgatggatccagaccgatgacttagagctccttcttttgacaattcctgggtcagattttggagtgagttgggattcccaaggctattcctatccttcc

SEQ ID NO: 362 - DNA, 1048 bp, Homo sapiens
agaggcctggctggtgcctggtgggtaacccagggcaggcactgagcagctctgacctccccccttgtcccttccaggccttgctgaagaccggcgagcacacttggtccctggccgagctcattcaggctctggtcctgctcacccactgccactcgctctcctccttcgtgtttggctgtggcatcctccctgagggggatgcagatggcagccctgccccccaggcacctacaccccctagtgaacagagcagccccccaagcagggacccgttgaacaactctggggtaagtcacgggcctgggtcttgatcggggaggaagcgggcatgacctctggtccttaggtagaagctactgcttcccaatctcgtatctgcactacctgctgctatgagagaccatagaaaagttatttgactttgaagcttagtttcctcatctgtgaaatggggagataaagaccctctactcacactgggctgtgagggttaaatgaaataccatgtgactgacactgtgtatatgccataggctcaaagcctgttggttttagcactttaaaactacaaagtttaccttttactctgtaatgtggccttgtatgtttcaatacaaaaatacagatactttaaaaattcctgctcagggaagatgtgtctattctgtagctttgtaaacgtcactttaggaagcacagaccccatgtgctgtccagcacagtggctggcacagaggatgccctgggcctttgtgagcattaggaaggcctggcctctgggaaggatgagtggagcttcccagaggctgaaggaggaggagtagctggtcaccacggggcctctcctgcagggctttgagtctgcccgcgacgtggaggcgctgatggagcgcatgcagcagctgcaggagagcctgctgcgggatgaggggacgtcccaggaggagatggagagccgctttgagctggagaagtcagagagcctgctggtgaccccctcaggtacagggtcacaggcatccaggctcccgtggctgctccttct

SEQ ID NO: 363 - DNA, 1049 bp, Homo sapiens
tttggttccccctaatctttgctataaggtttattaaatatgttggagaacataaatacaatagctttggctgctgaaactaacattgaagacagaaccaaaattaagatactgtacttttttagtcagaccatcgggactcaagagaatgctctctctagtttctgcttttaataaaaacttttaatcagtttcaaacctgcagttaagtcttggatttatgttagtacatgccatgaatgtgacatcagaaacagaaacctatttcacctcccttacttattaggtaaaatgcataacatgccaatggaattgagtcaatacaattatgtagtctagcctttctaactggtagtagcctgtttgaaatcttttattattgcattataatgggaaagaactttttttccttgtgcttttgctgttggtttacttcatttccaaaaccatctgttcattcagtcaacaaatacggaaagtctgttatattctaggcactgttgtagacattgaggacaaaacagtgaaaacaagtattttccctcttggggtttacctactgattagggttggctgggaagaggaaggagtctgacagtaaataagcactaaataaataaaattccctcatataactgcaaccttgagcaactcaacctctttgagctttagttttcttgtctttaacatggatgtaattgattcctgctcttcctatcttgtggattgtttctaagagggagtagaataagtatttggatacattattcgcttcaaattcctgtagcaagttatttttactactattagaagaagaggcccagcacggtggctcacgcctgtaatcccagcactctgggaggccaaggcaagcagatcacttgaggccaggagttcgagacgagcctggccaacatggcgaaaccccatctctactaaaaataaaacaattagctgggggtggtggcccatgcctgtagtctcagttacttgggaggctgaggcatgagacttgcttgatcccaggaggcagaggttgcagtgagcag

SEQ ID NO: 364 - DNA, 1049 bp, Homo sapiens
ctgtattcccagcactttgggaggctgaggcgggtggatcacctgaggtcaggagttcgagaccagcctggctaacatggtgaaaccccgtctctactaaaaaaaaaaaaaaattggctgcgtgtggtggcaagtgcctgtaatcccagctactcaggaggctgaggcaggagaatccctgaacccgggaggcggaggttgcaatgagccaagatcatgccattgcactccagcctgggtgacagagtgagacttcatctcaaaaaaaaagaaaaaagttttttttttaaccatttttttgtttttctttctttctttctccccccagccccccccccctttttttttaacaacccaagggcacaagggggaaaaaatagaggaagtatttagaatgttttgttttgttttgattttaaggatgggagaggtttgacatgtttgaagggaaagggaaagcagccagcagagaggcagatattggagatgtgcacagagaaaatgtagataatgaagaagtcttaggaggaaatagaatgaaaagctcatgaaacagtaaactttgaagaggaatatgaagaaataaagggtgagagaagatatatttggaagtggtggacatggaaggtgaaataagagtagttgttaccagttgattactgttattacccaggcactgatctaggtttatttatttttatttttatttatgtatgtatttatttttttaagacagagtcttgctctgttgcccaagctggagtacagtggcacagtcatggctcactgcagcctcaactcccctgctgggctcaagcaatcttcctgtctcagcctgctgagtagctgggactacaggcataccgccatgcctggctaatttttgggttttttgtagcgatgggatttcgccacattgcctaggctggtcttgaactcctaggcttaagcgatcttcctgcctgggcctcccaaagtgcttgaattacacgcatgagccaccatggccagcctataatttctttctttcttttttttttttttgaaac

SEQ ID NO: 365 - DNA, 1035 bp, Homo sapiens
gatctcacctgagcccagggaggttgaggctgtagtgagccgtgattgtgccactgcattccagcctgggcgacaagagtgagaccctgtctaaaaacagtaaataaaaataggacaggctcagtggttcatgcctgtaatcccagcactttgggaggccgaggcaggcggatcatgaggtcaggagatggagaccatcctggctaacatggtgaaaccccgtctctactaaaaatacaaaaaattagccgggcgtggtggtgggcacctgtagtcccagctactcgggaggctgaggcaggataatggtgtgaacccggaaggcagaggttgcagtgagctgagatcaagccattgcactccagcctgggctacagagggagattctgtctcaaaaaataaataaataaaataataataataataataaagtaaaactcatagaagcagagaataaaatggtggttaccaggagctgggtgggagtggagattgggaaggtgttggtcaaaggatataaaatttctgttagacagaaggaataagcacaagaaatctgttgtacaacatagtgaccttagtaaaaatatattctttttttttttttttttttttttgagacagagtttcactctttttggccagggtggagtgcaatggcatgatcttggctcactgcaacctctgcctcccaggttcaagcgattctcctgcctcagcctcccaagtagctggaattacaggcatgcaccaccatgcccagctaattttttgtatttttagtagagacggagtttctccatgttggtcaggctgatctcaaactcccaacctcaggtgatctgcctgcctaagcctcccaaagtgctgggattagaggtgtgagccaccacgcccggccactaaaaatatattctgtacctgcaaattgctgagagtagattttaagtgttctcaccacaaagaaacgtaattattttaggtaatggatatgttcattagtttgatttagccattccacagtcttcacataca

SEQ ID NO: 366 - DNA, 1036 bp, Homo sapiens
attgttcttagtaaatgacatttctgttttatcctcacctccattaaagctttgagagtaaattggttttttttcatattcagtatgctactctctagaataatgggtctcaaactttttgcttctataagaattcagttatatatttaatgatagagtgccaattaccttttgtttatgtgacatatctattgatgtttgctgtattacaaattaaacctgagaaactttaaaaatattaatttgtttaaaaacaacattgataaacccattatatattacacaaataacatttttaattaaaaaaatcaagaaccatttgacaagataaaatgagaaatttaaatttctctatcttagccaggagtggtggctcacgcctataatcctagcactttgggaagctgaggcaggcagatcacttgaggctaggagttcgagaccagcctggccaacatgacaaaaccccgtctctactaaaaatacaaaaatttagctgggcatggtggcacacacctgtaatcccagctactctggaggctgaagcatgagaaacgcttgaacccaggaagcagaggttgcagtgagctgagatcgcgccactgcgctccatcctgggcaacagagcaagactctgtctcaaaaaaagaaaaataagtaaataaactctgtcttaatcactcagtaacttatgtatacttctctttggttggaaatgtagttctgctcatatttcagaaacaatgtgtgctttgtagtgcttcattagtacttggccaatggaagataacatgaaagtgactgggcgcagtggctcatgcctgtaatcccagcactttgggaggctgagatgggcagatcacttgaggtcaggagtttgagaccagcctggctgacatggtgaaaccccatctactaaaaatacaaaaattagctgggcatggtagtgggtgcctgtaatctcagctactcaggaggttgaggcaggagaaacacttgaggcctggaaggcggaggttgcagtaagccgggatca

SEQ ID NO: 367 - DNA, 1482 bp, Homo sapiens
gcatactaccaatagtagttggtactatgaaaaacagataacacatgctgatgaaacgtggaattgggaggccaggcatggtggctcacgcctgtaatcccagtactttgggaggctgaggcgggtggatcacgaggtcaggagatcaagaccatctggctaacacagtgaaaccccatctctactaaaaatacaaaaaaaacccaattagccaggcgtggtggtgggcgcctgtagtcccagctactctggaggctgaggcaggagaatggcgtgaacccgggaggcggagcttgcagtgagccgagattgcaccactgcactccaacctgggcgacagagcgagactccgtctcaaaaaaaaaaagaaacgtggaattggttctttgagatactctgttattactggaagactttttttttttttttaatagagacaagatctgcccccactggtctcaaactcctgggctcaagcaatcctcccaccttggcctcccaaagtgctgggattacagtaatgaacctggactgcacctggccgtggaagaattctgagtgggctttaaaaatccttttaagttcagcatgtccagtagaactttctgcaaagatggaaatgttctgtatctgccactctcccatgtgtagtcatatgtagctagctactgagcacctaaaatgtggctagtaaaagtgagagactgaattgtaaattgtatctcattttaataatacaaatgtaaataatcatgtgtggctagtggccacagtattggacagtacacatagacatttgagaactgagcagcaagtttgataaccaatacttctctaccaatgattaaaataatgtaattcttatttacttttagtatgcttggaaatgttgctttttgttttgctgccattagaaccaataacagtataatatttggccggacgcagtggctcacacctgtaatcccagcacttcgggaggcagcgggatgtggatcacttgaggtcaggagtttgagatcagcctggccaacatggtgaaaccccgtctctactaaaaatacaaaaattagccaggcatggtggtgcgcacctgtaatcccagctacttgggggcctgaggcaggagaatcacttgaactcgggaggcggacgttgcagtaagctgaaattgcaccactgcattccagcctgggcaacagagcgagaccctgtctcaaaataaaaaataaaaaataaaaaggctatagtattaggaagaagacagaggaagttaatttaggaatgtgttgtttactgcgggtcttcacttatacatcatcttcccactgaggcccttccgctcacccagtttataatttagcacccttcctttcagcccaccttattttcctttcctcccttttttactctgtggtacttgtcaccatctaatgtaatgggaagagggcagggattattttcccctgttgtattcactgc

SEQ ID NO: 368 - DNA, 1034 bp, Homo sapiens
cccaccactaagcctggctaatttttgtatttttgtagagacggggtttcgccatgttggccaggttgctttcaaactcctgacctcaagtgatccgcctgccttggcttcccaaagtgctgggattacaagtgtgagccactgtgcctggcaaattttttttttaattgaaaataattgtacctgttcatgggctacataatggatatttccatatgtatgatgtgattagattagggtaattagcatattcatcatctccaacatgtatttatttatattgggaaggttgaaatcctcctcagctatttgaaactacatattattaactatagtcattctgcagtggcatagaacactagaactttttcctcttatctagctgtaattttgtattctttaacaaatctttccctacccatcccttcccattatctctcccagcctctagtagcctctgttgtactttttactcctatgagatcaacttttttttagcttctatgtatgagtgagaacatgtggtgttaaacttcctgttcctagcttatttaacttaaaataatgtccttagttccatccatgttgctgagaatgacaggatttcattgtctttctttctctctctctcttctttctttctttcgttctttcgtctcaactctgtcaccgaggctggagtgcagtggcgcgatctcggctcactgcaacctccacctcccaggttcaagcaattctcctgcctcagcctcccgagtagctgggactacgggtgcacactgtcatacccagctaattctttttttttttcttgagacagaatcccactctgtcacccaggctggagtacagtgacacaatcatagctcactgcagcttcagcctcctagattcaagcgatcctcccccctcagcctcctaagtagctgggactacaggcacatgccaccacacctggctagttttttttattttttgacgaaacgaggtctcactctctttccctggctggtctcaaactcctggacctggac

SEQ ID NO: 369 - DNA, 1026 bp, Homo sapiens
ttttttttttgagacagagttttgctttcacccaggctggagtgcagtgatgtgatcttggctcactgcaacctccgcctcccaagttcaagattctcctgcctcagcctcccgagtagctgggattataggcgtgtaccaccacacccagctaatttttgtatttttagtagagacgaggtttcaccatgttggctaggctggtctcaaactcctgatctcaggtggtctgcctgcctcggcttcccaaagtgctgggattacaggcatgagtcaccatgcctggcccctaattcatttttcttcaacaaagaagcagcctatagccagaaaatgtctgcctctgtctcttttaacctccatgaggtttccagataataatctggtattgggtttaacacacctgactgaccttaggaccctaggctgacctggagagattttttaaaacagattctgaaagtcctacctcctggagattctgtattttgaaaaggcaattgggctgattccaagtatttggacagatttcggagtcttggaaataatgtactgtttgtcctggagagtaggaaaaagaggggaaggaaggagggagaatatgaggatatgaatatgtatgtgtgaatttgagataactgagtcagggccaggtgtggctctaccccaacacaggaggtaagaggaaagaaggacatctgcctctaaaagttttgtaaaagtgaaaatcaagcacatttgcatgagaagcaaagaaaatgttgctctgttttttgtattcagtggctttattttttttatacatattttgcttatgtatcaactattttttttttgagacaaggtccctgtattaagccattcttgcattgctataaagagatccctgggactggataatttataaagaaaagagctttatttgactcgtggttctgtaggctgtacaggaaacataatgcttgcaactgccctgcttctggggaggtctcaggaaacttacaatcatgaatcatgacagaaaac

SEQ ID NO: 370 - DNA, 1031 bp, Homo sapiens
aatatggagaaaagtcttaggttaagaaaaaataggccaggtgcggtggctcacgcctgtaatcccagcactttgggaggccgaggtgggtggatcacaaggtcaggagattgagaccatcctggcaacatggtgaaaccccatctctactaaaaatacaaaaaattagccaggcgtggtggcacgtgcctgtagtcccagctacttgggaggctgaggcaagagaattgcttgaacccaggaggcggaggttgcagtgagccaagattgtgccaatgcaccccagcctaggcgacagagagagactccgtctcaaaaaaacaaaaacaaacaaacaaaaaaagtcatgaaactgaggcagatggccataaatgtaaacatcactaagattagatttaagttttgggggttttaacctattttttaatctaatatttaatctgtttttctaaaacaatgattccaaaacactatacatatttgtgtgtgtgtgtgtgtgtgtgtgtgtgtgtgtgtgtgtaattggactggatatgtgaaaaccataacagattccacctgcatggaattatctgtggcacttgctgaaaaattagaataatgcctcagctcacaaggggcaaggcaaacttttcaaatgaaaatttttaaatctacttaaaactacctatgccttccataagcattaatgagtctagtagataaaaggatgattctgtagatgccagtggaatttgggattcagtgtctggcatagttatcttcacagggaactgcagaagctattacttaaattgttctgataaaatcatgttttatcttgggagaattaagaatgctattcttatgttaaaataagtgatggtagagaaagcagggaatataatcagtaaaatttgtatgggtttagtaaattttttgcatttacccaaagttctatttaagtctactttctttatataaatgcacaatttcttagaagaattttcaagaaagggagaggaaagctaatgagtgcttcaaagctaata

SEQ ID NO: 371 - DNA, 2936 bp, Homo sapiens
ggcacgtgccaccacgcccggccaatttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgt

SEQ ID NO: 372 - DNA, 1022 bp, Homo sapiens
gtctccatctcctgacctcgtgatccgcccacctcggcctcccaaagtgctgggtttacaggcgtcagccaccatgcccagcttttttttttttgagatctaatctcactctgtctccaggagggagtgcaatggagccatcttggcttgctgcaacctccacctcccgggttccagcaattctcccacctcagcctcccaagtagctgggattacaggcgcacgccaccatgcccggctaattttttttgcattttttagtagagacgggtttcaccatgttagccaggctggtctcgaactcctgacctcaagtgatccacctgcctcagcatcccaaagtgttgggattacaggcgtaagccactgcgcctagcctcaagcctgatccttttttttttttttttttttgagatggagtctttgcctcccaggctggagtgcagtggcgtgatctcagctcactgctacctctgcttcctgggttcaagcgattctcctgcctcaacctcccaagtagctgggattacaagcgcctgcaccgcacccggctaatttttgtgttttttttttcagtagagacagggtttcgccatgttggccaggctggtctcaaaactcctgacctcaggtgatccaccacgcccggcagagccttgatctcttaaccactatcctcacctcccctttccctaaggatccacaatggcctcactggctcttgaaggcaggctggcaccttgatcattcttcctggtcattagtattctgatctggttattttccattttatgtccatctaacctacttggaggatcctcaagagactgcatatgtaaactcagtacttattcttgtactgtgcctgccatatagcaagcactggctgatttaatttttctgtgttcttttttattgatttgtttttatctttattattttctttgcttattttggggttagtttgctcatctattcctagtttcttaagctagtagctgagctcattgattggagacctt

SEQ ID NO: 373 - DNA, 1050 bp, Homo sapiens
aaaccccgtctctactaaaaatacaaaaattagctgggcatggtggcaggcgcctgtaatcccagctactcaggaggctgaagcaggagaattgcttgaacccaggaggaagaggttgcagtgagctgaaatcgtgccattgcactctagcctgggcgggtcaggagttcgagatcagcctggccaacatggagaaaccccatctctactaaaagtacaaaaattaaggctgggcgcggaggctcacgcctgtaagcccagcactttgggaggatgaggtgggtggctcatgagatcaggaattcaagaccagcctggccaagatggtgaaaccctgtctctactaaaaatacaaaaattagctgggtgtggtggcaggcacctgtaatcccagctacctgggaggctgaggcaggagaattgcttgaacctggctgcagtgagccgagatcgcaccactgcactccagcctgggcaacagagtgagaccccatctcaaaaaaaaaaaaaaaaagagttgaggtctccttccaccacttgtgtgaagaccccagaaaacttgctttacctctttaaacttcagttttcttatcttccaactgccatgaggtttttgtgaggaacaaatgagctgacatggatgtttctgtagttaacaaaataaagggtcttacaaaataggcaataataataataatcacttattattattacatgaagctacatgaatgtgtaagatcttggaggaagacagcagagagagagagagagatcagagatcccagggttaaaagttggagaaatttcacagtacatcatccaaaagaggagtccatgatggaggcagaggtaaacttggagaggtaagaaaccctgaagacaggggagtgctttgtggcaggctctgcatataagaattcagcctggccaacatggcgaaacccagtctctactaaaaatacgaaaattagccaggctttgtggcaggcacctgtaatcccagctatttgggaggctgaggcaggagaatcgcttgaacctgggaggcag

SEQ ID NO: 374 - DNA, 1070 bp, Homo sapiens
atagaacggggatcccaggtgagaaactcctagtgtgaaatataccacctgtgtgcctggcataacagcagctcaccaaatgtatattgttgacacatgagccctctcctcccttccctcctggggaccttacacacagagatttttcagccttagtctggcaggcaagttcttcctcctggtgtgggggacggagggcacagctgcagtggcctgggagggctctgtctccttttacagaaatcgaggctgtggtgaggtcactggaggtcagggcaggagcaccaggctccgggcagactgtctagactggcgtgcctacccactttcttcaataaataaggaaggtgaggtgggggtagggcagctccagctctggtggagcatggtcatgagactgggatttcattccacctctctgtgacctgggtcacctttccctgagcctcatcttccccttagctgtaaaactgggatgagtctgctcacctcaaagggcagctgtgggcattcaggagtgcctgatggtggaagctgactctgtagccgacttatctgtgactgtctcactcttctcccagagactgtatgctccttgaagatggaagctgtgttgtgtggggcggggtggggaagcatgatgccaaaagccaactccttattcccagcccagacactcactgcctggttaagaaaacagccagagaggccgggctcggtggctcacgactgtaaccccagcaatttgggaggccaaggtgggcagatcacctgaggtcaggagttcaagaccagcctggccgacatggtgaaaccccgtctttactaaaaataccaagcagttagccaggcgtggtggcttgcgcctgtagtcccagcactagggaggctgaggcgggagaatcgcttgaacctgggaggcggaggttgcagtgagctgagatcgtgagtctgaactccagcttgggcaacagagtgaggctccatctcaaaaagaagaaaagaaaagcaaataaaggaaaacacacccagagcagtgagagaagtctgtatacaagacccatttgtgc

SEQ ID NO: 375 - DNA, 1029 bp, Homo sapiens
cctcagcctcccgagtagctaggactacaagcgcccgccaccacgcctgtctaattttttgtatttttagtagagacggggtttcaccgtggtctcgatctcctgacctcatgatccgcccgcctcggcctcccaaagtgctgggattacaggcgtgagccaccgcgcccggccagaagaaatttctaataacactcaaggacgccagctctggagtctgactaacttggttcagatcttggccttctcttccaatcttgagtgagatacttcacctttctgagcctcagttttcttctctgtagagtgggatcattgtggccagcttgtagtgaaacgctccagaatattagccaaacacaactaaggagatgttgactgggtttgttccatccatgataacagattttttggttaatgccccatgacaccaacacttcatatagcccttatgtgtctgactccattccgggctgtgctcatggcagcccagccatcagcaccaactgtgctgacataattgtttcctgctttttctcctgacttcttattgtgagtacttttcatgctaatacagtctccctcccaggcacagcagactgctacagattattctgatgaactgatgagatgtttgccttggcatacagctgtctatctaaaacaagggtgcctctttttttggtggagggacagagtttcactcttgttgcccaggctggagtgcaatggtgcaaactcggcttaccacaacctccacttcctgggttcaagcgattctcctgcctcagcctcccgagtagctgggattacagcacgcgtcaccacgcctggctaattttgtatttttagtagagatggggttcctccacgttggtcaggctggtctcgaactcctgacctcaggtgatccacccgccttggcctcccaatctgctgggattacaggcgtgagccaccgtgcccggccacaaagatgcctcttatatcccacatccctaccccatctaactttgcctgcctgacatc

SEQ ID NO: 376 - DNA, 1048 bp, Homo sapiens
gaatatcaggcagatggtaagttccacgtaaatgatacccgtaatgactgtgggaatctgagcaaggcacttgtattctcttgatctcagtttccttttctataaaatagggataagagtccctacttagcctctcaagggcttttataatggaggagaattaaactcggggcagagagaagccatgtgtgtctgtctgtcactgaccgtggctttccctttgcctgcagaacgactcctggtccccaagtgtgtgatgctgaaatccaggggaagccggggccacgtgagattccaggatgccttttgtggtgcctatttcacctttgccatctcccatgagggccacgtgtacggcttcggcctctccaactaccatcagcttggtgagccccgagcccagcttcaggcatgacccagtggcctgcgttcctgtcctggctctgccactcattcattgtgcatcctttgcggggtcgtctaacccctccaagccagttttgtcatctgtaaagtgagaatgtccatatcctgatgggaggtggcctcactgtgggaggagattgagaagggcagctctcagaacaccttcacccctgatggctccggcctttcccccaggaactccgggcacagaatcttgcttcataccccagaacctaacatccttcaagaattccaccaagtcctgggtgggcttctctggtggccagcaccatacagtctgcatggattcggaaggtagggcctttacgtccttctctagtttgggggtggagtgttccctggcctaggcctagccagattcctgagaccatggtccttggagcctgggtctgttccatgggttgtaccatacatgggtccatgagagtcactctcatcctcctagagtcctggtgttcttccaagtgtgagttcaatgggggcccatgtagattctcctaggcctcctccaaaactgggaagagacactgcagatctccttctgatcgctctgggagcagggacacactcccatggacaggtggactcacctagcctgcca

SEQ ID NO: 377 - DNA, 1016 bp, Homo sapiens
gccctgagcactgtgtcagttcctgccttttctcatcagcagaacagaatccttttcctcttttccttcctcctctttggaattttcctgggacctacagaataaagggggggatggacagggggttttcaaaaggaacatggctcactcagagctatatggttagacgtttctccccttttccctaccttccatggtcctggttggccctggctttgcctactagaaaaccaaaacttcccccctggggttttgtgcccactctctgagaagttggggctccatcaagccccattctagtcatgtgcccctttcctgtccctaacagtccacaggcaaacaaatggtacagtcataagagccatctgtcacggacccacgcccagaggaacgtgcagaaaaaagcagagctacatggctgtgggcaactataagccaaatatttggctcagaacaggtgtccatgggacaaaaaagaacgatcctccacttgaccaagaaaaaagtgattctcccagaagcacaaagcatactcttgcccctcaggtgttgcttgtgtacatcgtacccatccattcggcttcacctgcagccaacggcctggaatcgcaaagagacaccactctgggcagagcagagcagggtatggggtggggagagagggtggagggttttataaacaaacttaacagcaatattgaaaggaggtgggggattgagggagggacagagtgttggagggccagagactagtcctgagatggaaacagcaacttgtacagtggctgagaaaataggatatagttttgatttttttaattgtaaaatattttggagggagaacaaaatcttttaacattttgaataaatttagagttttataaaataggccacttgttttctacacattccctgctttttaagggagcacatattatgtgccaggcactgctgggaaagacagaataaactataaacctggtgttgaggctacaacttaagtgatgtcaagatgt

SEQ ID NO: 378 - DNA, 1035 bp, Homo sapiens
gcgaaaagtacttgtatgtccgctactccagccccaaaaaaatcctttggaattatatttattggagttttcccactcagcaatataatatagcagggtgaaagtacctcttttttttttttttttttttgagacagtgtcttactctgttacccaggctggagtgcagtggcatgatcaccactcactgcagccttgacttcctcaggttcaggtgatcctcccacctcagcctcccaagtagctgggaccataggcatgtgtcactacacttggctaatttttgtatttgtttgtagctacagggttttgccacgatgtacaggctggtgtcgaactcctggactcaagtgatctgcctgcctcagcctcccaaaatgttgggattacaggcgtgagccactacacctacaaaagtacttcgttattggtcaggtgcggtggtcacacctgtgtagggaccagccctacagggcctgtgggttttactccacgtgtgtggagaccagagattgtagaaataaagacacaagacaaagagatagaagaaaagatagctgggctgggcgcggtggctcacgcctgtaatcccagcactttggcaagccaaggtgggcggatcacaaggtcaggagatcatagccatcctggctaacacggtgaaaccccgactctactaaaagtacaaaaagaaattagtcggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagtttgcagtgagccgagattgcgccactgcagtccgcagtccggcctgggcgacagagcgagactccgtctcaaaaaaaaaaaaaaaaagaaattagtcgggcgtggtggcgggtgcc

SEQ ID NO: 379 - DNA, 1075 bp, Homo sapiens
ttcagtgatccacctgccttggcctcccaaactgttgggattatatgcgtgagccatcacgcctggcctcatcttgagccattttatctttaaccattttctttctctatttgctttttttccaggatcccagctggctactgctttgtagaatttgcagatttggccacagctgagaagtgtttgcataaaattaatgggaaaccccttccaggagccacacctgtaaggacatttagataatgatgatgttgccattattattgtcattgcttactaccatctattgaatccctactgtatacttattttatttaatcctaaaacaaccctttacagtaggcattgttatctttgtaggcccaggaaactgaagctcagggaattgaaataacttgtccaaggcaacacaggtagtaaatggcagagccaggattcagactgaagattggttgcctcccaaatccatgcctttccattctgcattgctgcctcccataaccgaagacttgaaactctagacctcttgcctgattgggaaactagaataggctggcagcagcaaggacacatttcaagagagttgcattctgctcttcccacagttacttagcttacagctgcaccagctggcacacctgggctcatagaaccatggagctggcagtgcccttagcggtcatccgtgcaaccccctcattttatacaggagaaaaagctgaggcttagagagggggagatgttttggccaaggtaatttatttcagttttcttcaaatattgttcaactcttgaaacacctttctctgttttagtttgtttgtttttcaacttccaggcgaaacgttttaaactgaactatgccacttacgggaaacaaccagataacaggtaggtacaaagtcatgtctagacagacataagatgtgtcactgtgcctgtcactgccatataggaggaggggagccggtttggctgcacttggttccctcctgaaggacgacgctcttctcccttccttgctggtggaccttcctggtgtgcttcatgcaagaccctggcttttctgtatttg

SEQ ID NO: 380 - DNA, 1050 bp, Homo sapiens
agtgatactccatttcaacaaaaagaaaaaaaaaataacaaaggtttgtgtgttcgtttatttttttaatagaattgacctcctataataggagttggtaaactttggcctgatttgtatcacccacaagctcgcagtggtttaagaggttgggtatggtagctcacacctgtaatcccagcactttgggaggctgaggcaggtggatcatttgaggtcaggaatttgagaccagcgtggccaacttggcgaaaccccgtctctgctaaaaatacaaaagattagctgggcgtggtggtgcgcacctgttatcccagctggtcggcaggctaaggtgtgagaatcacttgaacctgggagacagaagttgaagtgaccccagatcacaccactgcactccagcctgggcaacgagcaaaactccatctcagaaaaaaagattggggatttaattttcgctaggctttacgtccttagaagataagatctagttcttttttttctgtcttttaacatttatgtttaaaatatacaaggaatgcagaatgcattattatgctgtttttatgcagttttatcttttgagtgccttagatgcacttctgaccccatccacacatctgcactcatgtaatacttgaagtcagacaagttctgtggagtgggtgagggatttggggcagggactatttccctaactcttctgccaggactgctctgatgaaacaaagtaggggctggttaagtagacccatcaaatgttttccttaaggggcctgggagaggtttacctggaatatgcaaaagagcttttcagagcagaggttttggtctttgcctctgaatcttcttgttctctctcctcagccctgagtattccctctttgtgggggacctgaccccggacgtggatgatggcatgctgtatgaattcttcgtcaaagtctacccctcctgtcggggaggcaaggtggttttggaccagacaggcgtgtctaagtaaggccttacttgttactgatgcttaactgtgttagtttcagcctttct

SEQ ID NO: 381 - DNA, 1050 bp, Homo sapiens
tgctctcagctagagggaagacaagataaattctgctctggaagaacttacattctggttagagagccagacaaatatgtaattatggtaagatgtgtcgggtgttacccagaggtgtaagtgtagatcccagagagcctgggacaggcagctccaggagagcccatcacccccttgacatgtggcattctatcctggtatgtgggcctctaacgataatactgttaccctttttttgtgtgtgtgtgtggtggagtttcactcttgttggccaggctggagtgcaatggcatgatctcagttcaccgcaacctccacctgccaggttcaagcaattctcctgcctcagcctcccgagtagctgggattacgggcatgcaccaccatgcccagctaattattttgtatttttagtagagacagggtttctccatgttggcttggccggtctcaaactctcagccttaggtgatccgcccgcctcagcctcccaaagtgctgggattacaggcatgagccactgtgcctggccgataatactgttaccttttatttgtttgactgtttgtaaaattcattttttatttattttattttttttctgtttttcaatatattttaaaagacatattttcctgatttttaagtcatcgttaggatggaaaatttggaaaatatagtaaagtatgggccaggcatggtggctcacgcctctaatcccagcactttgggaggccgaggcaggtggattgtgaggtcaggaaatcgagaccatcctggctaacacggtgaaaccccgtctctactaaaaaatagaaaaaattagccgggtgtggtgatgggcgcctgtagtcccagctactcgggaggctgaggcaggagaatggcgtgaacccgggaggcagagcttgcagtgagccgagatcgcaccaatgggctccagcctgggagacagagcgagactccgtctcaaaaaaaaagaaaaagaaaatatagtaaagtataatgaaactgaaaatcaccccatatcctattacaacatagtaatag

SEQ ID NO: 382 - DNA, 1131 bp, Homo sapiens
cctgcctgggctgctccaaggtggtggctaggggtggcacaagttacacattttcaatttggataggttgtgattcttgtcttccccagtcagatacctacagccgctgagagccggtattccaacgccatgagacgccttctgtcgtgagcagttgacaagaaagacccagcacttactgcaaccggaaggagcggttcctccctcgctcgcgcagccgctcttccccgccactccctcggtgcccgccagcacattcccagcaagccctgagtatatttgcatatcaactcactacatttttttcttctaactaaaaaatcgaaaggacaaattccagattctccttgtgaagtcttcctttcagttcagaagaaatggaattcgctcttcaacttcaggaagttgaaataaagagttgcttggattttgtgttcacctttaccaaaaaatggatttggtaacactgccaccctgctttggtgacagagaaagcaaaaagggcttctgtcgtgagtggcacacgtagggcaactcgattgctctgcgtgcggaatcgacatcaagagatttcggaagcataattttttggtatttgggcagctggtgatcgttggtcccggcgccctttctttactgttatatgttaggcgaaatattacgcgtttggagtaagtggtgctttttgtaactgaaaagagattctgtgtgtgtttttttttttttttagaggctgcatagttatttgtatgaaccgcaggtgacctaattagcaaggtaattcagacctgtatcctagcacttaagaagtggaagtgggataaccctgcgtgttctcgtgtgggaggctagcttaagcaacaaagcaggaaggccccaccaacaaaagaatttaaaaattatacgtgcgtggtggcgcgcgtatgaggaaattatttggcaactgtgttacagtatagcagcaaatggaatagacctagtccctgactttaggagacctgcctcagccccccgaatggctgggactacaggcgtgcgcctccgcgcccagctaatttttgcatttttggtagagacgggttcaccatgttggccaggatggtctccatctcttcatctggtgatccgccc

SEQ ID NO: 383 - DNA, 1081 bp, Homo sapiens
ttggagaccagcctagccaacatggtgaaaccccgtcgctcctaaaaatacaaaaattagccaggcctggtgtcaggcgcttgtaatcccagctacttgggaggctgaggcaggagaattgcttgcaccgggaggcggtgttgctgtgagccgagatcgtgctactgcactccagcctgggcaacagagtgagactctgtctcaaaaaaaaaaaaaaaaaaatagccgggcatggtggctcccagcactttgggaggctgaggtgggcagatcatgaggtcagaaggtcaggaccaacctggacaatatggtgaaaccctgtctctactaaaaatacaaaaaatttagccgggcatggtggtgcatgcctgtaatcccagctactcgggaggctgaggcaggagaatcgcttgcatccaggaggcagaggttgcagtgagccgagatagcgtcattgcactccagcctggacaagagcgaaactccgtctcagaaaaaaaaaaaaaagaaagaaagaaaacccttgtacatcaaaggacactatcaacagagtggaaagacaatccacagaatcagagaacatatttgtaaataatatatctgataagggattaatatccataatacataaggaactcataactcaacaacaacaacacaaacccagcccagttcaataatgggcaaaaggacctgtatagacatttctccaaagatggccaataagcacatgaaaagatgctcagcatcactaatcattaggaaaatgcaagtcaaaaccataatgagatggcacttcacacccattaggatagctattattaaaaaatatatatcgggagtctctctgagtctactctggcccaagaggctgccagacaataattcaaaataacaataataataataataataaagaccattgctatggctcacacctgtaatcccagcactatgggaagccaaggtgagaggatcccttgatgccaggagttcaagacctaaagatatctctacaaataatttataaaattagctaggtgtgggccagtcatggtggctcatgcctataatcccagca

SEQ ID NO: 384 - DNA, 1057 bp, Homo sapiens
gccaaggtggatggatcacctgaggtcgggagttcgaggccagcctgaccaacatggagaaaccccgtctctactaaaaatacaaaattagcctggtgtgctagtgcatgcctgtaatcccagctactcggaggctgagacaggagaagcacttgaacctgggaggtggaggttgcagtgagctgatatcacgccattgcactccagcctgggcaacaagaacgaaactctgttctcagaaaaaaaataaaaataaaaaaataaaaaaagaaaagacatagccaccaccctcagagagcttatagccccatctatccaactgttttgttttgttttcttaagtataggactagagagagtatatcttaattaatatttcatttctttactatttaacttttatgatattaaatatctcgtttttaaattaaattaaaattaaataatatgtaatgttaaatatgtttaatgtttaatatttttattggaggaaaatgactattctttgtagtgagaactatgacaaattgagagaatgacaaattgaggcaatcatcccaagcacctatgctgctgaaggggcgacataattgggtgcccactcagggaagcatctagtattccaaagcttattcccttttttcaggaatggcccaataagaaatcattttgagttaaaataattttgaatttaacgttgtagagatttgcctaagtatctaggtagtgtctcttttttaccctctgtcttatccttcttgtgccagaggacactttgatgttctggaaaggaatagctgatgtagggctgatggaagaggttgtctgcaatatacagaaggaaatagaggagctactcaggggagttcagcagcggctcatccaggctcccttccaagtcacaggtaagtgcactaatcctaacagtagcagtgatttattgaatactcacctccgtaggcaggtcctgtaagccttgcaaaaaccctgatgtataggtattattatcttaattttacagataaggaaactaaggctcatataagttaagtcactt

SEQ ID NO: 385 - DNA, 1028 bp, Homo sapiens
tgctggaattacaggcgtgagccactgtgcccggcctgtttttattttatttttttgagacagtctggctctgttgcctgggctagagtgcagtggtgccatctgggctcactgcaacctcggcctcttggattcaagtaattctaccgcctcagcctcctgagtagctgggcctacaagtgtgtgccaccatgcctagctaattttttgtctttttagtagagactgggttttatcatgttggccaggctggtctcgaactgacctcaagtcatccacccctctgtctcccaaagttctgggattacaggcgggagccactgcgcctggccatatttctcattttacatcctccagaaaccactgtgcatttccttttcaggttataactgagtagtgggatctattgatattcccagatagtttgccaagaggctagcactataaactggtagtgaaccttgctttttggtttatgattgaggaacggctgtacagacatttgggctagaacttgaaatttccatttctttttgttattcttgttttattatcacctggtttgtataggaagttgataaaaggattatctcaacactcaggacttaaacagtttgtgaaatgctaagttttctctttacttagttgtagtgctaaagctaaggcccatattcactgtatcagcttaactttaaatgtttaaacatttcagttattacaccaaaatttcttatgatataaaaaatgcccttgtgtttataggaaatcatctgatgtgctgcacactttttttttttttcctggagatggagtttcactcttgttgcccacaggctggagtgcagtggtgcgatctaagctcactgcaacctccgcctcctgggttcaagtgattctcctgcctcaggcctcccaagtagacagggtttcatcgtgttggccaggttggtctcgagctcctgacctcaggtgatccacccgcctccacctcccaaagtgtagggattacaggtgtgagccaccgcgtc

SEQ ID NO: 386 - DNA, 1035 bp, Homo sapiens
tggaggttgcagtgagcagagattttaccactgcactccagcctgggtgacagagcgagactgtctcaaaaaaaattcaagtttctgtgatataaaagaggaaaacatcctcacttgagctaaatatattaaatccttaggaagtaaataaccatgtgatactgttggctcccatttagtatcttaccaccccaccactgttttattgactcttcagatctagtgagtgggcatcctgttttaaaccaggatgacaaacatgagcattttttgtaaaatcctaaggccatctatgtctatttttgtcttgcagataaatatacttgtttatctgccaaaagggttaaggaaattttatttgtattactcatcaccttccttgctttgtgaatagataaaacgcctctttctgcagcctccttaaaggaggactagaagagaatagataacattgaatttgtatctctgaaccatgccccttgtatctatctttcaacaaacgtttgtgttaattgctgggatggaacagagaaacaaggcaccatctttgccttagaagcagagggttttaggaggacagcaaaatggataaaatatgggataagagctgtaatagaggaatgaatacatttttggcattctggagaagtgattaattacttgggggaaattaagaattcatggaggcaataacattggaaccctgccaaataagtaataatagaatgataagcactcaaatggcagcacagtgcttggcacatagtacacacagaagcttagctatcttatctaacactgtaattctcatatttcagataaaggaagaggctcagaggttatttatccaaagtctcatagctagtaagtgttggagttggtctttaacagaagtctctccagcgatgtgttggagctggctagttggagccagctgtttagctttcaagaatacctttctgtacattaaattacattataattaccatcgtattaggtaatattcaaattccttactcttgaggttatttacag

SEQ ID NO: 387 - DNA, 1258 bp, Homo sapiens
agacaaaaatctcgctttgtcccccaggctggagtgcaatggcgcgatcttggctcgctgcagcctccccctcccaggttcaagcgattctcctgcctcagcctcccgagtagctgggattacaggtgcctgtcaccacgcccagctaatttttgtatttttagtggtgacagggtttcatcatgttggctaggctggtctcaaactcctgacctcaggtgatctgcctgccttggcctcccaaagtgctgggatcacaggtgtgagccactgcgctcggcctaggattttattctttacctgtgttttagtttggttgtaagggagggtagttaattagggaataacagtttggaggatgggaaggatgaaacacttactgagcattgaccttgttaagcaccatgctaggtactttcatagccttactttaatccccataccaacctgggaggcagtatcctgtatttatagatcaacaaatggaagcttaggaaagcaacttatcaaaacatctatgaggctgggtgagttggctcacgcctctaattccagcactttgggaggccaaggttggcaggtcatttgaggccatgagtttgataccagcctggccaacatggcgaaacactgtctctactaaaaatacaaaaaaattagccgggcgtggtgacgggcgcctgtagtcccagctactcaggaggctgaggcaggagaatggtgtgaacactggaggcggagtttgcagtgagctgagatagcgctactgcactccagcctgggcgaaagagcgagactgtgtctcaaaaaaaaaattggccgggcgcggtggctcatgcctgtaatcccagcactttgggaggctgaggtgggtagttcgcaaggtcaggagttcaagaccagcctggcaacatggtgaaaccccatctctactaaaaaattagctgggcgtggtggtgggtgcctgtattcagggggctggggcaggagaatcacttgaaaccagaaggcggcagttgcagtgagccgagattgctccactgcactccagcctgggcaatgagagcaaaacttcgtctcaaacaaacaaaaaaattagccaagagtggtggtgtgtgcctatagtcctatagtcccagctactcagggagctgagggatgagaatcacttgaacctgggaggcagaggttacagtgagccgagatcgcaacactgcattccagcctgggtgacagctcaaaaaaaaaaaaaaaaaaa

SEQ ID NO: 388 - DNA, 1029 bp, Homo sapiens
gaaggactgttcttatagttccttaggagtttatgcagaggagaaaaaaaagctctgttctttgaattagggcaaacgttctcttcctgcttttttacattcatcattgaaatcctgtaagtctgcacaatgagcaaggaaaaagtggcagctcagatcgttgcttctttctcctacacaaagcaggtaacagtttaaatatgcatgctgctgccacctcctggaccaaattctagttccagtgggcccaattagtagtaccctaatgcttttcattccttgcggaataaacaaatagtccctcgttgaactgatttaactccagttagccattgggaaaagatatcaaggaattacgatgtatcaaatgaaacattctagggcagcatatattaaagtactaattgacagtgtgagaccaagtatagaaaaatagcaaaatcagttagagctagagttaccaagaaacttttatggaagacttaatttgaattgggtctaaaaggatgggtaggaaaagacagaaagatgaagaaaatggccaatcccctgtgtgaactgttggatatagagtgggaagggacaggggctggcagttgttctactttccaactcatttgcacttggtattgcaatttctgttggttctcaagagatgttcagtgtgcctactgcttatgtcagaattccgattttgcctatatcacttggtgtactacatgaagccattttaagaagatagacttaaaagctcttcatgtgagttttttttgagtaatgtggatagcatatagaacttaagcgtttgcatgtaaaaatcttgcaatgtgcaaactataaatatttgcaagttttgcatttgtttttattataaaatgtaaccaaattataaaaagcgtagaaaacaaaagaaatcacctgtaattcctgtactacaacaaaactactcatcttggcattttttcttttctttacctatgtaatttatacagttataatcatcttgtatatagtgttcatttcatcctc

SEQ ID NO: 389 - DNA, 1013 bp, Homo sapiens
gctgggattacaggcgtgagccatcgtgcccggccccaattttttatttttagtagagatggggttttgccatgttggccatgctggtcttgaactcctgacctcgtgatccacccacctcggcctcccaaagtgctgggattacaggcgtgggccatcgtgcctggcctcaattttttatttttagtagagatggggttttgccatgttggccatgctggtctcgaactcctgacctcaggtgatcccaccttcctcggcctcctagagtgctaggattactcgggtgatccaccgtgccaggccttaatgtttttttgttttttgttttttgttttttttttaagatgaggtctcgctatgttctctaggctgaagtgcagtgactattcacagctgtgatcatagttcattacagactcaaattcctgggctcagatgatcctcttgcttcagcctcccaagtagctaggactgaacaaggtgtaaggccctctgttcctggtttaaatttatcttcacctgttacccaggctggagtgcagtggtgcaatctcggctcactgcatcctcctgccttcagcctccccagcagctgggactataggtgtgtgccagcatgctggctaatatttgtattttttttgtagagacggggttttgccaccttgcccaggctggtctcgaactctggccttaagtgatccacctgcctcggcctcaaagtactgagattacagacatgagccaccacacccagcctgtaattatataaacattaaagtgttattaagtgttaaatataacttagtgcacctaacttttttgcagaagaaataaattcatttcttcccttccccccagttttatgttttgaaatacatttttaaaaaaagttttgagagacagggcctctgtcacccaggctgccaggctagaatgtagcggtggcatcatagctcactgtaacctctaactcctgggttcaagctgtcctcccacctcagccttcc

SEQ ID NO: 390 - DNA, 1029 bp, Homo sapiens
ttaagtattggaatttcacaaaagacataggacttaactggaaaatgaaaaaaaaaagaaaaagaaaaaactaaacaaaaaatccctctaggtagtttaggtgaaaaatgtcccttttattttggctttggttgtgatttcagagcataatgctatgtttttttgtctttttactatgtttttcggatttttaagtccgtaagtgcatacagttttctctaatttttaaaccctttcctcctcccattttgacatttgcacttggagaacacttgagttgtgaaggttttgggcatccaccccagaaagtgggaatttgattttatccttccgaactggaagaacatttttatgaagaatttttgtctaggagaatataacagtgttacccaaggttgtgtctttaagggtggttcattttctctgaccttttgttactcaaagtaaagtactaggagtcctaagaaatgttctgttcttgtacattatactgattaagtcaggattaatttgatttcaaagctgagaacagtggtaaaaactcgtttacagaaatgcattttggaagagaaaaatactgtaaaacgtgtcgtgaatgtttcttcagtttcttgttcagccaatgaggaaagggcattgcctttctttttaccattaatcacttctcaataaacgtgagatcctgttgagcatcacttctagtaccatttagtattatttgagtctgctgtgttttaaatatttggagtataagggggtataacaggtgagacggcaactaattttacagagtttgtgctaagagtaaacacttcaggcttgctttgtacccagggctggttaaccatgacctctgcaaaagcaaggtgggctgatattcataatgctttatatctggatactttgcagagaatgtagagtcattgctaaatcatttgttcaacagatattaagactattgggtgcctggcactatgcttaactccatggaatctggccagctatcttagatgcagaggaagtagagcc

SEQ ID NO: 391 - DNA, 1023 bp, Homo sapiens
agccttgtaaatagagaccccaaaacgttagaagtcctacctagaatgtttgaagtcctggttcccacaccttggagctttctctaccagtgagaaagtaaatgctcttgtaataaaagttttcggccgggggcaatggctcacgcctgtaatcccaacactttgggaggccaaggcaggtggatcacctgaggccaagagttcgagaccagcctggccgatatggtgaaaccccgtctctactaatgtctactaataatacaaaaattagccgggtgtggtggtgcacgcctgtaatcccagctactcgggaggctgaagcaggagaattgcttgaacccaggaggaggtggaggttgcagtgagccgagatcatgccattgcagtccagcctgggcgacaagagtgaaactccgtctcaaaacatactaaaaaaattaagttttcgtttttcattatggagctaacattgcacttgatgttaccacttatttgacttttatttgaaagttgacttgtggcctgcgtgtcatgaatgttttgaaaatgagagtggaagtaaaggtgtccctaggattcagatctgtaagtccacttgcaatcaattttttctgctttaggaagcaatgccactttgtcatgagcatcgctcatcgctagtggtttctgggcagctggtgcacctccttactactgagaagcctttggaactgtgatgtttaattacagctgccgggtttgcacgtgggaagctgacatggtgtggtgaaagccagcggtcttcagctagtggagggaattacagaaggtcccacgccctttagggcccttggctccgggtttccgggacaggctctggagctccgcctgcgggggccgggcttggcggctggacggcgcgtgcgccgtgcctgcggatggaggagggccaccttctgcccggctgtagccaggttccctccatgcttccccaccccgtcgcagcctggtttttgtacgccttctctctgacggcggttgtgc

SEQ ID NO: 392 - DNA, 1069 bp, Homo sapiens
gagaggcccgggggtaggggtggaaatgctgagagagggcactctgtgattttaggatcctaccataagcagggcctaccaattaaacacactgggtgctgattttttggtcacatgatacaatgcaaaggtctttggggcagactgggctggaatagaatcctttttctgttgcatacaggtgggtgattctttgcatctcagtttcacgtctgcaaaataagaatatgaatacttatgggacacaagtatatttgttcttttattcatgtaagccccacaagggcagggatttttgttcatctgttcaccaggtgctgtatcttcagcgcctagggtatagtagcacgtagtaggtgctcactgaatgtttccaaaggaatgaagatatttattgactgtttatggtatacctatcaatgtgctttgtattggattaaatggctaatggatataaagggcccagcatgataggggctcagtgaatgtgaattccctatttgctcaatagactgtgactttcttggggatcagggctctggtaaagtgagctctgggtcttctgaacttagtaaggggccaagtaccaagcatgtatcaatcagcacagagaggggcctggcaactggacttcctggagagggagtgacagagcctctagttttcatcagaagagagaggcagctgggaagatctggggcagaaatgggagggatggggagggactctgccttctagtactgccacttttccttgtccaggtgtgaccctggacaaggcatgctcttccctgagtcttggagacctcatctgtgatgtacatatcacaacactttccccgcataggtgtgggaaggagttgatgagaagagcccacacagggccccatttggtaacttcccagccctgggctcattctgggattctgggaggggactatgtgttcctctttctggcttttttctcctacttttaactgctcacccagctgggactggaatccaaggagcccctgaacttcccagcagactggccagggccctgggataagggctgggctctgcctggt

SEQ ID NO: 393 - DNA, 1041 bp, Homo sapiens
ggagaggaggggagaggaggggagaggaggggagaggaggggaggggacaggagggaagggaagaaaggaagggaaggaaaggaaggaaagaaagaaggcactcccatcactccctctctcttgccctccttttccttgccttgaaagtgagaataagaaaacctgttttgcttgcctcgaagattcagtgataaaatacaactacagacagtaaacatttattgagagctgatgggctaggttctgggggcacaaaggtgactcactcagtgttcctgctccttaaggacgaactgccatgtgcagagtgagcccaggggagcaggtggttaactcaggggcatcaaggggaaaagagctaggttgggctttgaaggatgagtaagagctctctaggtaggcaatggcaggaacaactttctaggtacagggaatggcatgtacaaaggctcaagactgcatactgtgctcaggatagatgagcactgtcgttggtgtggctggagcacaaagggaaaggctggcagtgacaggagatgaggctggtcagggaagtagggcccacgtcaggcagacctttggggatgtcactggctcccctctccttcctgcaccctcacaactgcctgttctgctcagagagacaaccaggaccttcccatgctgctcctccccttgagttcccaccttctcccctcatcttcaccaccccagccagatcaagtggctgcctctctcaggagtcaataacctggctgccctgccagccctgccactgaaaagccatgtggcctccagtcactcacataccctgtctatctcagtttccacctcagtgaagtgggaacagcaggctttcctcccagagaagggcggaggcttcaatgagataatctccacaaatggcctggcccagtgtctgtatatattgggcacccataaacaggagctaattaagccatcattatttagactcctcaatctccttggccccacccactgcttcccctttacctctcctggcagcccgttctagccaa

SEQ ID NO: 394 - DNA, 1033 bp, Homo sapiens
ttattgtcttaaagtaaataaaatagcaagtgattttgcagtttaatgaattcgtgaatttacatatatttttgcttttatacattttggagaagcgcatattgtgttcctctttttgattgaaacagagaactgatgaattcaccccaattctgggttctttttacctgtgaaaaaaaattttcagtaaggaagcatggagttttttgttgttcgtgttgggtatctgttctaatatcattatatttggacttcctcaaaagccaaaacataagaccgcatttttctacttggctctatggtctttgttcctaaggaagggaattaacacatactgaatgctagctatgtatcagatactactctctgtgtatgctaattaatttaaatatttctgtgttttacatccaatctacaaggagtttttattgctttgatgaaatccctccctcccccttctttcctctcatctctccctttctccttctcctcttaaatgattctctggctgaacaattttctattaatagtatatttgggaggcagtatgatgtaacagccagtaaggatatgggatttggagtcagacctggatttacagtaaggttttgtttttgatagggaaaaactgctttctatctcaataaataaaagccagggtcccacagaactggctttagaaggagattctgcacatggggtggagtaattggagctcacagcaaggacttttgttcctgaagattcactttcccctggggaatcccttgctgacctcagaggtgctgctttcttttaattttctgccccagaggagagtcttctcttaatactcctgcagaacacagctgagaccaggctgtaacatctggtatgttactaaaggctcagagatgaaaaagggaaataagtacagagttactattatgcttctgtaatatctggctcacgagataaaacacacacctctgtaatttgtggtattctattgggatacctcccttacttgacccacaacacatatgttttctag

SEQ ID NO: 395 - DNA, 1050 bp, Homo sapiens
aagaaatatgagtagttagtgaccgaagaactaaagcttttttccaggattttcttgttttacaaagacacgtatagacattttgttagatttttaaatacctcagttgacaatttaaatgttgagagcccaatactgttagtattgtgaatatatttgagttgaatatatttggtatatttagtttgtatatttaattttttgaaaaagttttgtctttatgtatttttttctttaacatttgagcttgaatcaataaagggcagcaacagaaaagcattttggatcaaacatatttgccgtgttcactatattttgatgataaatagatggcaacatttgtctttgagtctgtcttgttctgctcaaaaagcagaaaagataggaagagagaaataagtaagatttactgcactttgcttaatattcttacagcaataacacaccttagctggtggtattttccttttatgaatcataaagtcagactgggagaggtaacttatctaaggtcatgaagctagtaactgagggtgctaagactcaatgtttagctgacttcaaaactgatgtgcagcactgtgattggatttggaactctcttctattgtggttagggtagtggtaaactttcatcctattcagattttcacaagtcataatttattgtcacctaggatgaccaggattcaatctaggctatcacattgcatttagtggttatgtcttccttagtctcctccaatctgtgatagtatctccttgcatttcatagcattgatgcgttcatagagtatcggccaggtgttttacaaaatgccagtcggggtttgtctgatttttttccacgattagatagtagatttttgggaagaatacagaggtgatgtgtcctcagtatgtcatgttgggcaaagcaagacctagtctaaaaaaaccacacacacggttttagatttacagatttattgtgaagatagtacagagtccctatataccccacactgcagtttcctctattattaatatattagtatagtatatttttaa

SEQ ID NO: 396 - DNA, 1858 bp, Homo sapiens
aaatttggaggtaatactttaccatctaaaattgttcttactaataatgatataaactgaattatgctataattgcccttattccagtgaagtctctgttgttacttgtttaattatctggtggtgaaaattacatacagataatatgtgttcctgaagagaaatgcacctctgacataattctcctccttttatttggaggggtgggtgttatatcgataaagacggtgtatattctctttattgatgtccttgtcacataaaggagttcagttaatgtttgttaataataactacttggtatctgtagttgagaggttttaaatagataatttttaaaatgagctatatcaccaaccccaaatagtgttaaatgtaacttttatactgcaaccatagcatcaccctaagggaaaaaaaggagtttcataactctaaaggaaggaaggtattgtggagcagtgaatatattaagtataagtgtttaatattctgttttaaaattttctttaaattaggaaatgggccaaagttaatggattgatgtggattgtgaggctaacgtcagaatactgtatattagccactgaatatttatttctcttgtgtattttggtgggattccttacataggtttggcaacaaaactagaaaataaatttcctttcagtgatacaaaattctgttgggctagctgaattagattgacattagtcaagatttgccagaaacattgtagtagtgctggttaatatagcctggttttgcaaggtggcctcagactgctgttatacttgtgaactagccagagtatcccaactgtgataggaaagtagacattgtatgatgtatgggaaattcatctttgaaaaaagtgagtttatgcctttcagatccatactgtgaatgaatgaatataagagtgaaaacgctgctgacaaagatttggatatttgataacgtatacaattttattcttttactaaatgtttattcctttttactaaaaaaaaaatacttttgtgattgagaagaaccttaacattgtctacttcaacttcttttttttttttgagatgaattctcgctctttcgcccagcctggagtgcaatggcgcaatttcggctcactgcaaccttcaccttgcagtgctaaaggggtttcaccgtgttggccaggatggtcttgatctcctgacctcgtgatccacctgccttggcctcccaaagtgctgggattacaggcgtgagccactgcacctggccaactctttttcaaaaaaagaatctcctgctataacacctatcatcagttggattggaactgtgcaaaatgtggatgtaaacaatttaggattaactagacataatgtgacaattttggatattttatattttagattccactttttattttggtctactgatttccagtagaaaaaattttaggatttctgtaacacgtaaataattgcaacttcaataacatatgattacttgaaatagcgactctatttttcatttcattgaagtagtaactgcattttgtttcatacctatactcctccctgcttcaatatttagcatgtcactttgaccaataaagataaaattatgaagaagatagctgactggtttaaatatcaaagggctgccctagggttcactggtctggttcatgctgtttgatgtattaaagacattcataagggcaaacaaggtattagcaaatatgtcagatgttttatgtttttaatgtgggatgaaataaactcatacacaaggagagagggagagaaacctacattatgactgaaagaaaatatcctgtgcatagagctaaatatgcagagcatgg

SEQ ID NO: 397 - DNA, 1421 bp, Homo sapiens
ctgtctctatcaaaaatacaaaaattagctgggtgtggcggcacatcctgtaatctcaactactcgggaggctgaggcatgagaatcacttgaacccaggagtcggaggttgcagtgagctaagattgcactccagtctgggcaacagagtgagactgtctcaacaaacaaacagcagttattctagatataccgcagaatagtttagccactttaatgtttattataggaattttatattagttcttgctaaccagcgaaattctttcagttatgttagtctactgactagaatgcattttggtttgctacaaattgaaatgggtgttttttttttcatgttctttttaaacattcccctcattctgtataaaacatacttgtggacattgtctacttaagcctttatactatttatactgtagaagttatatctaatatatctcaaatcatttggggattttgttttttcaagaaaagtttgaaacatactcaaacaacagttcttagaaagctgcttaggatggtactgaatttacttgtgctaagtggcgagaatggattattgaaagtgaagcaggctgggcgtggtgactcacgcctgtaatcgcagcactttgggaggccgaggcgggcggatcacgaggtaaggagatcgagaccacggtgaaaccccgtctctactaaaaatacaaaaaacaaaaaaattagccaggcgcggtggcgggcccttgtagtcccagctactcgggaggctgaggcaggagaatggcatgaacccgagaggcagagcttgcagtgagccgagatcgcgccagtgcactccagcctgggcgacaggagactccgtatcaaaaaaaaaaaaaaaaaaagaaagaaagaaagtgaagcagcaactattggaggatagcaagaatggagtgtcctttttaagtgatgtaaatctgtgcttagtatccttttacgctatttttatatgcttgtgtgatatttgattcattaaaaagaatttatgagccggacgctgtgacttaacgcctgtaatcctagcactttgggaggccaaggcgggcagatcacaaggtcaggagttcaagaccagcctggccaatatggtgaaaccctgtctctactaaaaatacaaaaattagctgggcatggtggtgcgtgcctgtagtcccagctactcgggaggctaaggcagaagaatcgcttgaacccagaaggctgaggttgcagtgagccaagatcacgccaactgcactccagcctgggtgacggagcgagactccatctcaaaaaaagaatctatgaaacataaaatgtagtttaggaagtgtaatattaaagtagcacctataaacctaccatccaacttaagaactagaactatactagtactgttgaatctaccagtgctc

SEQ ID NO: 398 - DNA, 1061 bp, Homo sapiens
aggttatcaattatgtgtataatatatattatggaagataagtatttccagacaagggctattatctaggagtttttctccatttttgcccattgcttctttttgtaaatttcttgcgtaaatttagatgaagctagagatttaacttgtcttttcctggaaacaacgtgagagattaagcgctcaccaccacgcccagctaatttttgtattttagtagagatggggtttcaccatgttggccaagctggtctcgaactcctgacctcaagtgatgcgcctgcctcggcctcccaaagtgccgggattacaggcatgagccactgcgcccggcccaaatatctatttagtgttcaaatttctagttgtctcaaatggaattttttttttttggtaatttcatttgaattagaattgaaacaaggtctacatattgcaagtgattgatatgtctcttaagtttctttcagtccataggtatactcttatctctctctctctttttcttataatgtgtttgttgaagaaactggatcatttatcctgtagaatttctactcagtctggattttgttgatttcagttccatggtagagtttaataggtttcttggttttttttttgtatttcctgtaaattatttgaatttacacataattgaatcttaaaattgagaaggaaaaccatgcgggccttttgctgtctcaagggttgcagttaatcagctgacttgagaaatccctgctgcccagggaccagatgaaacatagacaagatggcatgttaactttggatttcttgcctaatctggacacatttgtgtttaaaaaggaagcctggattatgccactgcactccagtctggctgacagggcaagacccggtctctgaatgaatgtatgaatgcatacatgcatgcatgcctgatccaagaacctgatgaattgaaccgttttccaatgaaggtgacattagactaatttaatgataagacaaaactaaactttttttagtgagaaaaacatgctttcaatttatttgtattagttagatctcatttt

SEQ ID NO: 399 - DNA, 1075 bp, Homo sapiens
attggtcccaagcatttctcttagaattaaaattaatttaaaatttagaatatgtaacaagtcacatcttattttgcagtttgtaaggctacattgctaaaattgaggagcatgggcagagacaataacgtttttgttaaactttaataataccgtgtaatggcttggtcaggaagaatatataatgctgagagcaatggattggtatcctccggtttacctgagaccttcatttattgatttgatgggattctacctgagaagttttaataacaaagtctttagggcatttgggggatcatactattttttatagaaaaatatttaatattaatgtcacctatatttgttttagttcatgcttttattggtaagattattataggtaaaagcatatacagcatgttttgtgaaatgtgtttattactgacttggcgatgtcatggatatgtagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggaggtgagtatgttttcatttccaacaatcagaactcttacaggtggtttcatctagagttgcgtaagtggtgattttgcccacgataagactcactgtagtgattatttcttttttctttttttttttttttttgagacagagttttgctctgtcacccaggctggagtgcagtggcatgatcttggctcactgtagcccccaactcccatgttcaagtgattctcctgtctcagcctcccgagtagctgggattacagccatgtgccaccatgccaggctaattttttgtatttttagtagagacagatttcaccatattggtcaggctggtcttgaagtccgggcctcaagtgatctgcccacctcggcctcccaaattgctgggattacaggcatgagccactgcgc

SEQ ID NO: 400 - DNA, 1044 bp, Homo sapiens
cttctgtgtccttattttttctctctctccctttctgtttctccccttttctcctttttctctctttatattttgttgttgttgttgctgacataacatttttctcttttggctgtagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtgaatatgtctccagggtttgttcggtgtttgttttggcgattagtttaaacacaacatggtattggttcattgtttgcctaagagggatcatggtgccatagaaagagtcagtttcctccactgtttgactttgggcaggttacttaacctctcttaatctaagctttctcatcagagtaataggcattgcattgtagggtgaaaactaaatgaggtaatatatgtaaagcacttagcacagtggctggctcagtgctcagcaaatggcagctattattatttttgtttccttaccttttattttttatcagatttaaagctaattatgctgcattaggtaccttgagatccttagagcaggggtttttaatttgagatctttatacatggatagatttcagagggcccgtgaaactcttggaagtatttttaaaagtctttattaaatttactgactatactgcttttatacatgaaaatgattggtaatgctgggagttatcaagtgatcaagaacaagagtttacagtcagtctgagctgggttgaaatcttgacgttggttccaaccttgtgaccttaggtctttcaattataatgtctctgagcctcaggtttcttatatttctgatggagattatcacctcagagaaactagggggactgctaggtttagaaaaggtattgtgggctgaccacaatggc

SEQ ID NO: 401 - DNA, 1050 bp, Homo sapiens
ctcctgaccttgtgatccgcccgcctcggcctcccaaagtgctgggattacaggcatgagccaccgcgcccggccccaactattatttttttaaatgatcttataaaacacaccagtatgattgatcctctgctttttaaaataattttactcatctagaaggaatctccacattgctttttaagactaagctctgctattgtgattaaaataaaattttattttctaagatggatgtatgcacatttccaaagaactggtattacataaagcgcatctgtgtggttgctcaaatcttaagtacctttacaaaaaggagaagattcattatgtaggagaggttgtactgctgagttgcctatggttctgagttaattgcacccacagtcactgcactgtgttgaaaaatcaccaatttaattagcagatttcctagacagtgactagactgaccttttatatgttaagctttgtaaacacatttaagccgtgatggaatcgaagtgctagctcagatttattgaaataaatatagctcttgctgttggcaacaggaattatgagaagcagtcttcataagaagaattacatttttatatgtctgttaagaaattaaaaaaaatttttttaaccataagatcttagtaagtgttctcgctttggcagatggattaaccttgttcttttggagccagatcaatatctagtttatctctagagcagtggacagtctaactatgttttgattatattaaaaaaaaaaaaaaaaaaaaaaaaactgttaggccaggtgtggaggctctcacctgtaatcctagcactttgggagagcaaggcgggcggatcccttgagcccaggagttcaagaccagctttggcaaaatggtgaaaccccatgtctacaaaaaataaaaaaactagctgggtatggtgacgcacatctgtagtcccagctccttgggggactgagacagaaggatagcttgaacctgagaggttgaagaggcttcagtgcaccgagatcgcccactgcacttcagcctgggtgac

SEQ ID NO: 402 - DNA, 1080 bp, Homo sapiens
aaaaaaaaagggccgggcgcggtggctcacgcctgtaatcccagcactttgggaggccgaggcaggcggatcacaaggtcaggagattgagaccatcctggccaacatggtgaaaccccgtctactaaaaatacaaaaaattagccaggcgtggtggcaggcgcgtgtagtctcagctactcgggaggccgaggcaggagaatggcgtgaacccgggaggcggagcttgcagtgagccgagatcgcgccgctgcactccagcctgggtgacagaacgagactccgtctcaaaaaaaaaaaaaacaaaaaacaacaaaacaaaacaaaacaaaacaaaaaaaaaactatggcatttacttgaagccatatttattatataaagcaatagtagtgataaagtagccttgtaactgtaaatttcattatctgacattagtttggtgccagatagagatagctttttgttggcattttaatgagatatattctgccagtatacctgtaggtgctgtctcccccatgtatattatctcatttaatgttctgtgtaggggcatacacagaactactgttgctacttggcctcaattcttttttttgagacggagtcttgctctgtcacccaggctggagtgcaatggtgcgatctcagctcactgcaacctccgcctctcaggttcaagcgattctccttcctcagcctcctgagtagctgggattacaggtgcccgccaccatgcccagctaatttttgtatttttggtagagacaaggtttcaccatgttggccgggattgtctcgaactcctgatctcaggtgatccgcccacctcggcctcccaaagtgctgagattacaggcgtgagccaccgtacccggctggcctcaattcttaaactgaagtagaggctctcagttttctgctattggattgataaagatccaaagcaaaaagaagtcattattcacttgaacaaggaatttaagctttgtaaaataatttaacactattgtttgctaaatgtacaattctgggaagacatcatctccattttgtccataagaagtttaagctctgag

SEQ ID NO: 403 - DNA, 1629 bp, Homo sapiens
cttggcctcccaaagtgctggggttacaggcgtgagccactgcgcctggcctttgttttttttttttttttttttttttttgaggcgggtctcacagtgttacccaggctggagtgcagtggctcaatcactgcttactgcactctcagcctcctgggctcaagcaatcctcccatctcaatctcctgaatagctggggctatgggtgcatgccacaatgcccagctaatttttaaatttttggtagagacaggatctcagtatgttgcccaggctggtcttaaactcctggactcaagtgatccttctgccttagcctcccaaagtaccggggttacaggcatgagccactggacccaacctaaactttaaaaactagatagacctctggcttaatatatagcctctaataattatttaaacctcatcttattccttgtcaatacctgtattttgagtacttgttatgtataaagtctctgagaaaaaaatatgcccagccttcattaaacatgtattgcgtggtgggtgaaataccaagtgctttacatatctttgtctcatttaacatgaagtttttcgaggctggaccctcagatatttcaaacttggcaactggatctctttgttttagcccatatctgaaaccagacctgagtagttccatcttcagagactaggaagaatagtgaaggtcagttgatttcctttatttggcagtgtaacatcttgaaattctaaacatgcatatttcctgactagttcgtcttcagtgcttcctcttaactggaacctgcagtaccaatcatatatttgtcatttgttccatgaggtgtgttatggcttctgagactcacaaagtccctgtgtgtgatgtgtttttccctcagcatttcattgacagccctgagaggggatttctaaataagtgtgtttggaaattaaaaccactaactgccttttgagaacattttatatttaatgaagtgtttggtttgattgctgctaaaattatgaagtgataggcatcaaaaagtgtctaacctgaacacagccaaagtaatttggccatcattctttagaagttttttcccctgtaaggaagttctctcaagttatctgtcactccagcaggtttttttttttttaagcatccctcctcccccttctcctaccccgcccccactaatgctttgttctggcacaaataaggtcgagttcatttttagatctaccgcctcctcctccatctcccagagagaacctgtagcaagttgtctatgacaaattctatttggaacaggtccctttgagatcttaattttactctgtgcccccacaggttttcaacaaagccagctaagaaggatggagaaagctccctcagaagctactggttttaccaaaacatttattttcccaggttccaagccaatccgaagctaggcaagaagagtagcaaattacaagtctcttacattaagaggttaactaagagagttatcattttacatagcatctcttgcttatttttgttttgctctattcacacctttaaccctcccaaatgtattaggttgttcttggcccaaacagattttaatttccagtgaggagctgggtcacagg

SEQ ID NO: 404 - DNA, 1038 bp, Homo sapiens
gtgcccagtctctgacgggttgcccttgattatgttctttgtcctgattgtgtattgttttgcatctttgtcctttcaactgtaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggagtgagtactttgtccacatgaccaattgtgaaaatggagggaataaatgtttttatgtattaatattctgtatctgagagaaagcttagagctgaaatttggatttggtgcctcactatattcattgctgctttaaggcatttgtaatcaaatatttatttttttttaagtcaggtaggctacccagtgcaattataggagctatttggagccaccagtagatgattagcctctgagaactgtctctgcagctacatgcttctggctaatgtatgtttataaactgaccataagccagtagaggtttatttgtattcaaactgtgccttcagggactagaaagtttactaaatttaggaaggtcaaaataggaaagacattagtctttttaaaaagctttatttgaacatttgcacaacttagaaatatctggactggttccccacaattatatagtaaaccaaggaggcccctaagccagagaattcagaattccaaatattaatgattgtatttcaattttagaaaaactatgggctgggcaccatggctcatgcctgtaatcccagcactttgggaggccaagacaggcagatcacttgagtccagtagtttaagaccagcctgggcaacatggcaaaaccccatctctacaaaaattagtcaggtatagtggtgtacacctgtgtagtccagctactcagggggctgaaacaggaggattgcttgagccaggagaccaaggctgcagtgagccatgattgcaccactgcact

SEQ ID NO: 405 - DNA, 1031 bp, Homo sapiens
gttaataactcttcagtattgccactctaatcttactgaaaagtgaagaatggtgtgggtgtgggtatgtgggtgtgaggagagcttgttcctgtaatgtgaaatcgacagaaggtatatcactttatctcttacttcaccttgggtaaaccttctcttaactctcacagctctagattttattatattattcaggtgattatttcaaactaatgcttcggctgggcactgtggctcacgcctgtaatcccagtactttgggaggccgaactgggtggatcgcctgaggtcgggagtttgagaccagtctgaccaacatcgagaaaccctgtctctactaaaaatacaaaattagccaggtgtggtggcacatgccggtaatcccagctactcgggaggctcaggcaggagaattgcttgaacctggaaggcggaggttgcagtaagctgagatcacaccattgcactccagcctgggcaacaagagcgaaactctgtctcaaaaaaaaaaaaaaaaacctaacacttcacattttagagtggtctatttactagctcaaagtatgtaccttgtgatctaagtaaaataactttgtagtatttctccaaagccatgtttcttttatgagtttgttgaaaatgctaacacagaaagccattttcactattatacgatttctcaagaagataaaacatagctagttaatattcaataataattttctataataatagctgtctgttgcattggttctgtagaatcaaggtaactatttcttgggttttttgtttgttttgtttcgtttttgagacggagtctcactctgtcaccccggctggagtgcagtggtgtgatctcggctcactgcaacctccgcctcccgagttcaagctgttcttgtgcctcagcctcctgagtagctgggattacagacacccgccaccacgcctggctaattttgtatttttagtagagatggggtttcaccaggttggtcaggctggtctcgaactcctgacctgaagtgatc

SEQ ID NO: 406 - DNA, 1048 bp, Homo sapiens
ttcttctctgataacttaacaaaactccagctgtcagtatgaagctggttaagtgtgttcatcttttccttgctcaagtgtgggctatggaaagaggtgaattgcggtgacttctgtggtgaggaggcttcagtgttctgagaccatgcttaaaaaattcaaatactcttaattaaaggggcaactcatcttcttatgagatttcaggccccaaataatttatgtactgcagccacattgtgcagcccaccactcccactgaccccacccacaagagcattcaggatcataggcactgatttcctatgctaaggtggttggccacttaaccttattacaatcaaatggtagtttcagtgtgatttatactcctggggaaggtgagcagatggacaagaaggcctttggtattccactaatgttcattcttctgaaattctgggattaatcaccaggtggtggtagaactgattgtttttttctttccagttttccaaatactgtctcttctcaataactccaaagtgaatctctgacattgatttgaaagaagttaatgaattcgagggtaatgcattccattgccactgctgtttcatgtaccattcgtacttagtggaggaaatgtggctgattttcttaattataatggtacagacacaaggacaaatcaaagtgattgctatttggcaaatcgttttatattcaaattctgaaggtcagtctgaagtgttttatatcaccaatcataactgtctgctcttacagctttccattaagcttatgaaagtgattacagtaatgctgctttttaatatccctcatgatttgacaccttgtcagggttactttggaatactgtcgaagtcttaggcagggtaaacacctttgtagattgagctagctctgtacttaattaaagctaacactttgatcagatcagtgtcagaagattacttctccattgccttcagaaatactctagtaactctttccttactgcttcacagcctcccctggtgaagacacaaactgtcaccatctcaga

SEQ ID NO: 407 - DNA, 1584 bp, Homo sapiens
atccccattgtcactgatggccacaggaacttggcaatgggactaggaagctttttcctttgcaggattttaaattttgcttctttgttttctctaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttc

SEQ ID NO: 408 - DNA, 1031 bp, Homo sapiens
gccgagacacgtgctggagcggagccgcttcctcacggtcgccagccgcagacaactgacctccccggcatcgcgttcgcggccctgctgctggctccggtgtctcgggccggaactcctgtggctccagcgttcgcgccggccactggccagcgcttgggcctcgccctgcagctccggggccatagggcacagctttagctttgacctccccgttcccgaaaggacgcccaaggcgacctcccaccccatcctccccaacttctcccccatgtcctgcggcaactttgcctccctctcccaccgtgaaatcaaacccgcggggttctgtatgcgccccatccccgctcctaccaccatcgctttgatttcaagaacactcacaagccccaagccctgccagcaggaggactgtcaggaactgaagtttgggagtgaggcctagagcaggttactcccattcttgatgcctcagtttcctcttctgcctcatagccatcatgataatggtgtatggcacttttggtagataccaagtaccttgtaaagtaaggctctgtctgtgagtgccagggaacaaaaaatggatttgagagttgttgcaaagccccagacagaggctgtgatttaaagctggggtattaggtgtcaaattctgcctctgctacttgctattcatgtgatgtctggcaaatcacctcacttgtaaagttcctggccccctttgttattcttagagatgaactcagaagcccaagtagaatagatgtgataccccttgtccccagtctggacagagtcagcccagctccctgaatggctccggagcttccgggtaggggcggtgtgtgatgccttctcagccttgcaaacctggtagttatttattctgctgtgttcttgctattttgtccttttggtcgcaggagttgtggacggcaggaatgagggagtggctgcccagtggtttcaggttgggcaataaaggcttgtctgggcatccctcccttttccctggggctaggggaggg

SEQ ID NO: 409 - DNA, 1029 bp, Homo sapiens
tagagcgcggctccaggaacctatgtccgcgcggtgtagtagggacggctaaatggggcccgggtcagagcgagatcgggacccctcgctccgaggcgcccctgaccccctcactctcttccctgcagcggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaagggtcagctggtggacgccggggagcgccgggacctcaccctcgaggggcggggccggcgacgggggcgggctctgcccgggggcgtggccgtggggggtggggccggcagggtgtcgctggggcgctatctgaagatgggcctgtggaaatggcagtggcccagccgggatgagatctgatctaggggtcggggctggcttcgagggggacggacagggtcaaggtgagagcctaaagaggggtggggttctggctgtgtgacttctgtgttgatcctagctggcctgcggtccgctccaggaggcgaggatgtgggggattaggaggggcctgagagaggggttgtgggctgatgggcgagggcggggtcagcctttggagccaggtgccccttagggcccgggatttagtgggggtaggagagcgggtctggttgagggcttggtagcagcgtgagaggccctaggaggacggagagggatttgggtgtggtggaactcagagttgggtgctggggtctcacagcagcatcggtccgcctcgcctctcccccatctcctcgcagagcccccaactcccatcgcgcccccacagctgctgcgtgctggccccacctacctcatcatccagctcaacaccaactccatcattggcgacgggccgatcgtgcgcaaggagattgagtaccgcatggcgcgcgggccctgggctgaggtgcacgccgtc

SEQ ID NO: 410 - DNA, 1064 bp, Homo sapiens
tgaatatgtgtgaattcggttatatgtaggggtcctagaaccaatccctggcatataccgagggaggactttatggcctgtcagatggtgataagtgccgtgaagaagaaaagcagggagtggggcctggagggttgttatttttaaaagtctcaagggaaggtgacatttgagcagagatctgaaggaggtgagggactgagccgtgcagagagctgggggcttgctgggggaagcaagcaccagcccgactgagcagccagcacaaaggcctggaggctggagaatgcttggcacgtgcaaggggcatccaggagaccagtgtcactgtgttagtgactgagtgggagatggcaggagaagaggctgaagttgagctgcagatgtgggacttagagccgttgtacacagagagagctggggagccactgaagagtttagagagcaggagtgagcatcatctacttttgtttaaaaggatcactctggcccttttgtggagaatgttctccaggagggcaaaggtgccgcagagaccagggaggaggctactgcaatgatctgcttaagaggtggtgatggctgggagccgagtggaagtggtggtggtggggagaagtggtcagattctgggtttattttaaaggcagagctaactgcatttgctgatggattgaatatgggatgagagaaagggaaatagaagtcaaggatggctccaaggtgttttgctagagcagcaggaatgatggagctgtcatttcctggagcggactgtggtggcagctgatttgacgtgggtgtcatagatcaggagttctgtgttggaaatgttgacttcgagatccctattagacattcaagtggagatattcatcagcagatggatacatgagtgtggagttcagggaaggggttcgggctgcagatagaaatttgaaagtcatcagtgtggagatggtatagatggcatttaaagccctgaggttggatgagatcttttacgctaatggttctcaactaggggcaattttgtctcctaggagacatttgacagtgactga

SEQ ID NO: 411 - DNA, 1028 bp, Homo sapiens
cccaggctggtctcgaactcctgggctcaagtgatccacccaccttggcctccaaaagtgctgggattacaggcatgagccacttcatttgccaatattcttttattatatttatttaatgtccataggctctatagtgatatcatctttttcatttctgatattggtaatttctgttttcttttttcttgtttacccttgtgaagactgtataaattaatctttccaaagaaccaactgttggcttacttgattttctttattttctattttttatttcctttgttatactttctttggagttgatttgctgttctgtttgccttttgagatagaagtttcttagatcattaatactgagcccttcttcatttctaatatacgtgtttaaagctacacattttcctctaagtcctgctttagctgtgtcccacaagttttgatatttcctatcttcattatcattcagttcaatttgttgtctatacaattgaactgttatttctgttataatttctgctttgacctaagagttacttagaattatgttgcttaatttctaagcaattgggacttttcttttttgtttgtttttgagacacagtttcactctgtcacccaggctggagtgcagtggcacaatctcggctcactgcaaactccgccttctgggttcaagtgattctcatgcctcagcctcctgagtagctgggatttcaggtgcccgccaccacgcctggctaatttttgtatttttagtagagacagggtttcatcatgttggccaggctggtctcgaactcctgacctcaggtgatctgcccaccttggccctgcaaagtgcggagattataggcatgagccactgcacctggccagcaattgggacttttctaattgtctttttattattgatttctaggttaattccactgtagtcagagtatatactctaaattttattttgtgaaatttcatctttactttatggcccaacatattgttaaattttggtaaatgttccagtg

SEQ ID NO: 412 - DNA, 1029 bp, Homo sapiens
gcagggctgcccaaggctacccggagagccagaggcagagccagctccacccttccccacctgggctctggcttctatagcccctactgctgccaggctgggcatacatggatgagttggttgtatctctgggctgccaggagcggataataggatccaggaagatgagagagagagctggctggggccaccttgcctgaggccagacaccagcaagagagagagagtctaggggtggagtgtgcagcggagtggaggagatgggggggatggcccagccagggcgatacactctgatttttcccctcgttgttcctgcacagctttaagagagactattttaaagtatcatttaatgagggattactatgtgccaggagcttcacacacatcatccatgagtacattagttattggacatctactgtgtaccaggcactgttctgcactcagcatgcgtcagagaacatttccttcttggatcttgactgactcccttttttttggatgaagaaactgtaatgaaagcaccttgcccaggccacttggctgatgagcagtagggcctgacttcaactcaggctcgcctacaaatgtgaaggcctcactgagtctggtgcataggcagtgcccccagaatggcaagcccctgactttcccccagcagggggcctgagaagtgactttaagtagggctggggctggagagggctatagtggagggggcagatttcagtttcaggtggtatttgaggtcctagaaatctaccctcaaggagaagaggattggcagagtgaggggtgtcaaagagagccctgcaaagagagcactgggcccaggacaggctggatcagaaatgttgtcagggcctcactgggaaaccttccattatgtatttgctaccccataaacccaagttatcccagatgcctccaggaacccctcatcccccatcactctggacctccttacttcctctaaaagccattcagtctcactgtgtagtacccactgcatgcccctggatc

SEQ ID NO: 413 - DNA, 1594 bp, Homo sapiens
ttctttcctctgctctgtccttcccctctgcatcttcctcctcaagtcgtggtcatgagtgctggttctgcccctaagaggcatgggttcagagctggccctgctgagtcacccccagcaagtccctgagcctcaatgtccccttcaccaccagagcagccccttacgtctactgttcctcgtggttagaagtatgtcctgacctccaaccaaatccacgttcaggacacgctctggagcccacgtccatgtgcatgtgtgtgcttgtgtgcatgtgggtggggcctacctgttctgagactggcagcttctcccacagcacaggcaactctcaggcccctacaagtcccttctccagccaggcagccccagctctgcagacccaccatttcctgggagcctcctctgggccaagccctgtgctcagttcttgacagagtcctcacaacagctctgagaaataggagcttttatcactcccactttactgatgaggaaactgaggctcagagagaccaagggagttgtgggaggttgcaaaatgcactggaactgggatacaacccaggcccctgctgactccacagcctgccgatgctactctgtcttctctctctgtcttctactctgcaagccttctggaacattcctcctgcccctgtgctggttttccctccctcgaagtgcaggcccagagggcgccaggccagccctgaggacagtgggtctctcacctcctcctccctggacagctccttaccttagtgtttcctgacacgagcttttccaacaactcaacacccagcgactcgcgctgagcccccagctcggctcctgcaggggctgtggacaggcagctctccctgctgcttgcgcagttagttttcaaaaccagatgcagaacttctcaaagaatctgtattaaattccatctgcttaatctcacattgagctcagctggatgccaacagcattaggtgtccctcccgggttccatcttctggggatcgggttggtttgtttctgtagctcttcttccaggtaggccaggaatcctgggctgggaacagagcctgtggcacacccctggagaccaccctctaggccagcatctgctcagtgacgggtcctctctgggctccatgttcagccaggctggctggctgtcctctgtccatggccctatctccccacctccttttctccctcccactttcctccaagttccttcgaagtcacaaactgccatcctcatccgtgaagctgggcctggagggagaggaggtctctctttctcttccctgctgctctgagcagcaggacggactggtgggcagtggtgggaatctggaccttctgtgggtctctttacaagtctgtggtggtctatgctgggaccatcctaggtgctactgggagtagggagaagccaagggtggagttcattctgtgcgtgggggaagcccccgagctctggctgagcacaagctagactctctgcggggaaggaggggtgtagtccctccttcctgcaggagaaggaggagtctggagagtggtccctgtttaacacggggaggagagaggtggggac

SEQ ID NO: 414 - DNA, 1050 bp, Homo sapiens
tgccatgtttcccagaatcccttgctgcctcccccactcatcctgtcccttggttggagtcagggccaggcccagcctggaagacttgggcagctttggtgacagcgggcctctccttggtcttgccaaggtcccagttggctcctcttgggccctggcagggacatgccactccccactctgtggctcagcccagcccggcctgcccgtctccgctctgcctgccctgctcacatcgcccattctggccactcctgtgctccgtccacctccatctgcccctggcctaatatctgtctcttttgctttgtactgtttcctcactggaatcattaagattcggataaaccgagaagtaagtatctctctccccttctcctcctcctcctcttcctcctgtctgtctgactggctgtatctcagactctctcacggtctctggctgtctgtctctctgtctctgtccttcctttctacttatgtgcccagcaccaaccgtccatttcagcagcctggccaggggctgcccagggctgaagattcgagagtgttcctattgtaagcagttccctcccatcctccactgccttgagcaggggcagcagtgttgggggtgcttcccctgcccattctgcactggtcacaacagtctgtcaccttccttccctggctccgccattcccaaggagtcctccctagcctccctagctgcaccttctacaggaccctttggagggtgcaggggaagctgccctggagggccctgtttctgctgcttaagggtcaagatcttggacagccccaggtcagcctcctaaaactactttccctagtgttcaaataccttcatgatcagtttgcctgaaactcaaccccgaccattttaccctcaatttagccttaatttgaatgttttttggtggaagcagtttggatagtctgtttttaaatattatgcttttttttttttttttttttttttttttgaggtggagtttcgctcttgttgcccaggctggagcgcagtggcacgatctcggctcactgcaa

SEQ ID NO: 415 - DNA, 1014 bp, Homo sapiens
gagtggatgctgggctatcttgctcccccttccactgtgggcagggcctttcgcttgtcccatgggcgggtggtgggccaaggaggagcttagcaagtctgcagcccagccccacctccatagggtcctgcaggcctgtgctgagaggcctggtgctgcctggcagagtgacaaaggctcaggacggctggctctgggggactcaggccaagccccttggcaccatcctggcttttggcagggatgagtgaggccctgcagagagcatcccaggccaaggttcccactcagcctgccccctctgcatgtgggtagaggatgtactgggacttggcatttaggattccatctggcccagcccctgaaggtcctggggaagcaggtctcaattctgaatagccagtggggcacactgactgtcctccccaggggaactgcagcgccctcctccccactgccccctgcagcccctgagatattttgctcactatccctccccacttgcttccctgatatgtgctctgagcttccctgaaccaggatctgcctattactgctgtgccccatggggggctccttccctgcctgacccactgttgcagaatgaagtcacctcgcccccctcttcctttaatcttcaggcctcactggcctgtcctgctcagcttgggccagtgacaatctgcaaggctgaacaacagcccctggggttgaggcccctgtggctcctggtcaggctgcccgttgtggggaggggcagtgttagagcagggctggtcataccctctggagttcagaggaagaggtaggaccagtgcttttttgtttcttttgttatttttggttgggtgggtgggaaggtctctttaaaatggggcaggccacacccccattccgtgcctcaatttccccatctgtaaactgtagatatgactactgacctacctcgcagggggctgtggggaggcataagctgatgtttgtaaagcgctttgtaaataaacgtgctctctg

SEQ ID NO: 416 - DNA, 1020 bp, Homo sapiens
gcagagtacggcagatgagagaactagacaggatgacaacactggagatttgcagagagcctgatcaagtcttcagctgagtacctattaccacatgtgtgtgagaaaacttcaaccttaaggctgaaacacagccaaaaggatttgagggaacaatcctgcaactcaaacagttcttactcccaccagtcagaatgggaaaacaaatcagtcatgaggcatcagatagattattcaggaggatctgcgttagctgtgggggaatgttggccctagactaaatggagctttgcttatttttaacaagcttaagagcaatacttgaaaggcatatatctatgttacttaactatacccccaaagcaaaatttaatagtatttatgagaatacaaagctatcaagtgccccaaaaggcaaaattcacaatgtcttgcattcaatcagaaatttccaagccagaaagcaggaaaataagacctatagtaagtataagaagcaataaaaaccaacttagaactgacacaaattacatatttagcagacatggacaataagaacagttataacattatttcacatgttcagaaatataggagaaagactgaaaataataaggagggccaaggaagatatacaaaagaccaaaactgaacttctagagatgaaaattacaatgtgtgagatgaaaactacacttctacactagatagctgaaatagcagattagacactgcggaaaaaagattgctaacttgaggaagtagaaatacagattatccaaaatgaaacacacagagaaaaataataatataaaaaatgaacacagcgtcagtgaactataggaaaacttcaaggtgcatgtaattggagtatttgaaaatgagtggggatcagaaaaatatttgaagaaataaaaggccaaatttcttccaaatgtgattactactataaatccatagatccaagaagctcaacaaacttcaagcacaagagacatgaagaaaagtatactgagggac

SEQ ID NO: 417 - DNA, 1049 bp, Homo sapiens
cacctgggagagacagagagatgagggctgagtatggtcaagaatgacctgcaattccaacctggggtcatgggacccaaacccccacctctggcaaaatgatgatgataatgactggcaggtcttggatatttgctatgtgctagacattgcctgcatgagataggtgcagttcccagccctgtagtggacatatttgcctttgcctattcagcatcaagtcccccttattttgaaaacagtgcaccattttccttgggaaaacattctcagtccatataccttcagaagaactggtcccatccctcagatccagcgaggtggctggacttggccactcaaagtagaattccatccccctggctatagtccttggtttggggataggcacgtggcccaagttggtccaatcagacatactcctgggaccttctttttctgttgggatttctgagagggtgggatatctgcctaggggttttggcagcctttttgccaccacaagggatgggcttccggaaaatgaagccaacatcaaggaaagtagagtcaagagttggagaggacgagatcatatcctgatgtcaggactcagccaggcccaagccagacctacatttggctgctaagttctgtgagctagtaaattcctgaagtcagattgagttgggtttctgccacttgcaaccaaaagtgtcttagctaatacaatctccaccttacaggtgaggaaagtaagttaccaggaatttaaaccgtcactttccaataagctgcttctaagcacacctcatcctctcttcccggaaagcctccttctgctttcccagctatctcatatccattgaccctccaagaccagttaactgtcacctcctccaggaaggcttccctgatacctgagaagaggccaggtccttcctctgtgcttattgtccctgtgcttcacaccaagttgtaattgtatctatgtgtctgaactgtacactcctctaaggcagaggtggcatcttagttttctctgcgcctcctggaatcgatatgagact

SEQ ID NO: 418 - DNA, 1080 bp, Homo sapiens
ttgttgtttctaaattttcctgtcttaaaaatacattgaatattttgatgtaaatcacttttcctgaagcatatagtttttcctatgtataaagttattttcttaggacaggttcccagaagcaattaggggtcaaataaagtattagaactcttggttgcaaggggcagaaacttaattgggaaacattttggccaatcttgtcaggggcttccaggataactctcagttatgtttctcagttatgtttctgccccttgtctctttcctctattgctgggacttcagcctttgctgtattgggtgctcagtttatactcccagggctttgcttcttgtttaccagtgctcttctttgcttttctctggcagactcttgccatctggtggtaaagattggctttggcaattttttgtagtttacaatcctgatttgtatatgtaaaatgtaataagcaaggtggttctcccaaggaaaggattttggacagacaggaaaaggatgtttgctataagtgttttattaaatgttattaaaatattatttgatttatttttgagacaaagtctcgctctgtcacctaggctggagtgcagtggtgccatcacagcttactgtagccttgacttcctgggctcaagccatcctcccacctcagcctcctgagtatctaggactacaagcatgcaccaccacatcctattaatttttctgtaatttttctagagatggggtctcactgtattgcccaggctagtcttgaatacctgggctcaagcagtcctcccaaagtgctgggattacaggcctgagcttccatgcccagcaattatttcattttaaattatttttattaaatgtgtaatagtttattagtattttatcattcttgatagccattgatagtgacttccaaaagtttattctagccttagtaatagttcttattttactatcctttcaccacattgaatattattttctaaatactttgctaatttaatggattaaaaatagtagcttgtttatatttccttttttaacttaacgtctatcataaatattttttgtaattaatt

SEQ ID NO: 419 - DNA, 1019 bp, Homo sapiens
acaggcatgtaccactatgctcggctaatttttgtttttttagtagagacggggtttctccatgttggtcaggttggtcttgaactcctaacttcgggtgatcttcctgtctcggcctcccaaagtgctaggattacagatgtgagccaccatgcctggcctaatttttaaattttttgtagagatgacgtcttgctgtgttgcccaggctgatcttgaactcctggtctcaagtgatactcccaccttggccttccaaagtgctgagagattataggtgtgagccacaactgctggtccatagggtagtctttagaaaaagcacatatgacttaactctgttaaaatttttcatttgtatgtctccctccattgccagactattagttctttccagaaaagaatcatgttttgttcgttttggtatacataattattactatcactagtattagcactggcgttatccacttactagctgtactgaaaaaatgagattaatctcagaatctgtgctgggatggattggaggaagaaaactggaggcagggagaccagtgagggagttattactctagatgaaacatgatgggagcctaaactagaatgatggcaatgaggacaaaaagagagacgtgggtgactgacacatttgttgaattgagtgttaagtgggaagtatgatttggtttgtagtctggtagaagccacagagtattggaattgattgtcatgggggttgcttaagctgcaactcacagccacttgaaactcatctctacaaatagataggtgaaagcaaaaaccatgtttgtgagttccttgagttatgtcctcaagtttctgcctttgttatgggtttttttttgttgtttgtttgttttggagacagggtcttgctctgtcacccaggctggagtacagtggtgcagtccgctcactgcaacctcaatcttgcaggcttaagtgatcctcctgcctcagcctctcgagttgctgggactacaaacacaagccac

SEQ ID NO: 420 - DNA, 1075 bp, Homo sapiens
tttgtgaaggaacatgcctttagcagtccatgctcctgagttggacagtggagagtaggaatgcctggcgtgtggaagggcatatatgatagtaactcatgtaagttcagttaatgcatttctaacagttaaaaaagtaactcatgaaataaagatcatatggtacctacactcaagcggctaatcatataaggagaaagataagcagccaagctatgtatggtggtaaaggatagaaacacattccaaggaggttatttgattttatggacatccaaggacaggaaatgcagtgtagtcaggccacctaggactagaactggaaagtctcattaggttctcatctccgtttcttcacaagtctgtttcattacctcactttttatagtctagtggaagacaatgcaaagcctctaagaagacagaaaatggtagacctgttgaggaaccaccagaaatagcccaggataaggaaaggatgtcaccttttacaaataatgcctggtacttaataggaatacatgcactaactacctgtgaatagatagacttcataatctgtgctctctgtcattccttgggtgtcttcactcagtgaaacctgccctcagattgcagagtaataggtattgactcctgctgctggcagtgggcgataatgaaaggagcaggggcaggagtaagaataacagatcttcctaaccttgagccttcccacgtcttttcattaaaacatacatgtattgaatgccttttcccacaagtccaggatgcattgatttagttgtgtgcatctggcaccatgaacaatttttgtcccagtgactgaatgttataaataatttttgttgggcataattagaataaaaggaaactgtgtgttgcaattggaaatgggctatgaagtggttggtaaaataggaatggaggttttgtagtgaatccctggataatcttctgatgaacttgtggtctgtgctttactggcctctttcattaatcatatgccatcgtaggtctttctgaatcggtgttatgttatgaagaagtaagtgccttggggaccaagctgccc

SEQ ID NO: 421 - DNA, 1003 bp, Homo sapiens
ttgattcagtagtgaaatagattagaaatgagagtctttgttctgtaggttagcgctcttttcctcatcagcactggccaatcacctagtcgctctgatttttccctaaagctgtctgactttcgcttctagttaaaatattattttaatattttttatgatacctaaattttactaagcaagtaaaaattcacatccttcaacactgaatgagtagttggactctttggcaaggttaatataatggacagttcattatgaaaatattatctccctccctttgttctctgtctcccaacactgtaaggtaagggatctttaccagtgtggtgttcatcttttatgctttcttaagataactgtcaaaaactgttgatccttaaaagttacttttaattttcagtctcccctcactgcttaactaagagagtgctctttatttttaacttgggctttctggatgtattttttttaaacccaactgaaattggagaaatgtgattgaggttactgttggtttgggatgtatgaattctttctagcatggataagtgttaatatatgttgagcctggcttttaaggtatttctgaattatcttgcaaggggattgcagtgaagtcacaacccattgtgcggaagtgagactttgagaagatagaatagtagtatttaagctctggtaagatcacatggaaggggcaggcgcggtggctcacgcctgtaatcccagcactttgggaggccgagacgggctgatcgcgaggtcaggagttggagaccagcctgatcaacatggtgaaaccccgtctctactaaaaatacaaaattagcttcgcgtggtggcgcacgcctgtgatcccagctactttggaagctgaggcaggaaaatcacttgaacctgggaagcgaaggttgcagggagcccagattgcgccattacactccagcctgggcaacaagagctaaactccatctcaaaaaaggaaaaaaaaaaaaaaaag

SEQ ID NO: 422 - DNA, 1053 bp, Homo sapiens
cactccagcttgggcaacagtgagatcctgtctcaaaaaaaaaacgtgcttaccgtatcgttcaacagttgcattcttgggtatttatttcagggaaattaaaactcaacacaaaacctgtacatgaatgttcacagcagctttattcatagtagccaaaaactggaaacaaaccaaatgcctccaataaactggcacacccatacagtggaacagtactgtgcaataaaaaaaaaaaaaaaaaggaactgttaataaatgcagcaacttgcttgatcacaagagaattaagctgagtgaagaaagccaatctcaaaaggttacatactatatgatttcattaatataacattcttgaagaaacagaatagtggagatgaagactatattagtggttgccagtggtgagagatgagggaaaacggtgactggctatcaaagggtaaggatcctcatgatggaactgttctgtatcttgactgaggtggtggtcacatgagtctgattaaattgcatagaactaagcaaacaagtacatgtaaaggtggtgaaatcctaataaagtcaattgttaattttttttccatgaaacctgtacaacaaattttcttattttaatgttaattttctgattgtgatacagatatgcaaaatgttatggggaaaactaaagtatacaggatctctgttatttcttagaactgcatataaatctaaaattgccttaaaattaaaaaaaaaaattttcaaagttgcaaagctctaaattgtgcactaaggaaaagatttgggagaccatagtcaatatgacagagttttctactgtcctggaatgtaaaaattgagcccatatgaaagggcttgtaacaggcctttgggggatttttttttaaccaatacccagcctttctatacccatagccaatattgtatataatatattatgagtttatatttttttctgggttgctaatcagtagcttccatcaaattctcagagggacccatgattccaaaaaaaataaagaacctattggctttgtgctcttgctt

SEQ ID NO: 423 - DNA, 1032 bp, Homo sapiens
gcacaaagcgacatagataaaatgaagtatctaatttgttccacattcttttttgttgttgtgatggagtcttgccctatcgcccaagctggagtgcagtggcgcaatctgagctcactgcagcctctgcctcccgggttccagcgattctcctccctcagcctcctcggtagctgggattacaggtgcacaccaccacgcctggctaatttttatatttttagtagagacggggtttccccatgttgaccaagctggtctcgaatttttgacctcaggtgatccgcccacctcagcctcccaaactgctgggattacaggcgtgagccaacgcgcccggtctatgtatatatttttttagtagagatggagtttcaccacgttggccaggctggtctcgaactcctgacctcaggtgatttgcccaccttggcctcccaacgtgctgggattacaggcatgagccacctctcctggcctgttccacattattaaaagctccttggtgatgttctcagatcagaattatggcatctttgttcttctaggactttgaggattgaataactaagttttccagtctgagaacttagaaagtggtgtagtcaggtacagtaggctcaaaaagattgatcagaaaaagtatattagcagtaggggaaaagaagtagaggtcaggatctgccaccaaacagtaagggttagggttaggattaccctcacaagtagactgttgaatgaagcattactctgttaactgtaaggtcaaatttgttttctattccaagcactgaaacaggattgtgaagagcactgtcatttacagttcttctcataggagtaaaggtttttaattaaggatatttacaattcatcagcaattttaattgtcagaaaaccaggaagtatgtgtctattagttcatggtatagtatagcatctgaaattaggctttttaacaaacaagcattcagtctgaaattctaaattctctaaggcatgtcagagtcaaagttatttttcttcgtctat

SEQ ID NO: 424 - DNA, 1071 bp, Homo sapiens
gtgagtagcagagtaagaataaggtctttcagactcttaaggactagtatctagagtactaatgtcaccgtggaactttaatggaactatccattgtatatttagattatttacttttgtttttttcaaggtaagattatactttgtcttgatgcagattttgatttttttgtttgtttctttattctcctttcccccatctcacccaattaattttgttaaattgatttaagaaacatttaaatgtctctgttgtcatggcttcaggtgagggtggaagagtacacttcttttattagaagcaggctttgggctttctagtcaacttcatatagctttagtgctttcagctagtttctttctgaaattggcacatttgtgtgaactatttggtttcactatatggtattccatgttattgctttaagcagacttcaaaatttgcatttatttaccagggcaaaaataaattgtttttcctattcagaaattgagaagattcagaaaggagactcaaaaaaggatgatgaggagaattacttggatttattttctcataagaacatgaaactgaaagagcgagtgctgatacctgtcaagcagtatcccaaggtaaggcaaaaagtgctttggatctttgagttatctttatagttatgagagagtcatgggctataataaagactcctggggattgtgatgctttagaaacttaagcctgtgaagcttctctttcatgcttgtagtacctgttactgagagttgaaatatctaagttcttaactaataacatagctatagccaggaaggaaatataatcatctttttattatcaaaaagtttctttctcaaatgattgctcaggctacaagttcaaagaaaaaaaaattaaaacctgaagagttgctctttgtcaaaagactaacctgaaatctaaataaaaggaaatataatatgaatcctcaattggttgaagttaattttattttcttactaaaagtttacttttaagtaaatgctttttttcttcctttttttttttttaggaaagcatttagttacatttagttt

SEQ ID NO: 425 - DNA, 1072 bp, Homo sapiens
tctgcactcaagaagttcatgctgtagagagtagagactagcagcaagaagcttatagcatctagtgttattgggttaaattctgacctgagcacactcagggatttctttcctggaggagtttgctgaggacgagtttagtttggaagaggttgactattgatgtttaacagataggtgagcagcttttttcagactattactgaggactagatagagatgggacaggccagtttatctatcttgcttgttaccacctttgaatacttggttggaatattactttgaataaataggaaatggtactatttttgccttttagcaaggcctggtggttgtcagagttaacatactactgttgaatatttaataacaaggatgaatctggagacttatgaaggatttggaatattattaagtagaattgagtaagcgtcatgtgttcatcagaaaactaggaggaggtaagatacagtccttggttttcttgaatgttaaatgagggaattagaactaaatgtggtgtcagatgatgtgaaaattgatagggcaaaaatttataggcagtgtgggccaggcacggtggctcacgcctgtaatcccagcaatttgggaggccgaggagggcagatcacctgaggtcgggagttcgagaccagcctgaccaacatggagaaaccctgtctattaaaaatacaaaattagccgggcgtggtggcacatgcctgtaatcccagctactagggaggctgaggcgggagaatcacttgaacccaggaggcagaggttgcggtaagctgagattgcaccattggactccagcctgggcaacaagagtgaaactccatctccaaaaaaaataaataaataagtttttaggcattgtgtacccataatgctgaactccaaggattccaacagtctcaaatgtcttagcagctgctttgctttcaagtacctcatcttcattagaatgttcaacatgaggcagggcgcggtggctcacacctgtaatcccagcattttggaaggccgaggcgggtggatcacgaggtcaggagatcaaggccat

SEQ ID NO: 426 - DNA, 1034 bp, Homo sapiens
agaatggaagtgatccggagagctaggcagagaccacattatgaataatgaggggtctaccatcaagacttttctcaaagaggtgacagatagggtgccatttgacttcagagaaggaatgacctgagacctcatctgggctctcaagagctcttcttagaattcaagtctcccgtggaccagatgatttctcagtagaaagtgtagataccacacaatactccttgtatctttcgttcccaggatatgatggatgatatctgtcaggagcaatttctagagctgtcctacttgaatggagtacctgaaccctctcgtggacgtggggtgccagtgagaggccggggagctgcacctcctccaccacctgttcccaggtaaaaataatggagacacccagaaataggatgtgaatttgactactagtgtcatctcttttagtggtgctcttatgtctagcttaggaagggtctcaggatttgtatgttgcataaagaacagaattctacaaccatactctcacacctgtaatcccagcactttaggaggctaaggcaggcggatcaactgacatttggagtttgagaccagcctggccaacatggtgaaaccctgtctctactaaaaatacaaaaattatccaggtgtggtggcatacaccacactactcaggaggctggggcaagagaattgcttgaacccaggagacggaagttgcagtgagccgagatcatgccactgcacttcagcctgggagatagagcaagactccatttcaaaaaaaaaaaaaaatagagttctagatcttgggcactttgaccatagccaagtgctgcagtctagctgaaacttttggtcttctaattttggacagtcttagcatttgttaatggtctgactttaaaattctaccttttgtgactgacctttatagagtattcagactctccagacctacccaaggcagtgcagtgatgaattggtcctctataggacctgggggatcttgcagtgtgggtcctttaccctgtaca

SEQ ID NO: 427 - DNA, 1036 bp, Homo sapiens
tgtgtccatatatatagcttacctgtgaattgattgaaaaagagttccagaattctacagcagtgataaaacagttcttttttccttctggtgagccctatgaatacatgtatatatatgctatattaaaagggtcaatttaggattgtgctttttcactttatattctgtggtatccatttttctttgcaatagttgtcaattattttataagtacatagtctatacatattttggaaatactttacggtttagggatggggcagaatgagtattttcctgtattaatacacttagtaaaatgactgacttatggaagtatttgagagaaagttgaaacatagttactctgtagcttcctaacactctgcctttggctttcagggactcagaatattatgactatggacatggggaggttcaagattcttatgaagcttatggtatgtctttatctctgtggtggggcagaatgtacaagtaagtgcctgggagaatgctggtgactaaagtattgagagtcagacaaacacacctacggataaacctttagaaggccaagattttgctagatgtgacagtaagagttctgctcttgcttaaattttgcggtacatggtagaaagagggactgctaaagtgaggtggggtatcgttactcttggaagggtagtgtttgtcttaaacaagggctcaagaccagcttggccctggttggagcagcagacttataagctaatgttattttttttctactttaggcagggaaatagctagacctgggttgtatttctgggcctttgctgccgatatctaggccactttggtagataacaagaacttaatcgtacacaactgtactcatctaccccatttcattaaaaaaaaaatttagatctcattgaaaagaatgtcattgtaaaggaaatgtcagctgaaagggacctagatggcaagcagctagccagaccaggttgcggggcaagaatagtgcctattagggccgggcgtggtggctcatgcctgtaatcccaac

SEQ ID NO: 428 - DNA, 1524 bp, Homo sapiens
tcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatcaaaatccactttgtacataagttaaagtcctaattggatttgtaccgtcctcccattttgttctcggaagattaaatgctacatgtgtaagtctgcctaaataggtagcttaaacttatgtcaaaatgtctgcagcagtttgtcaataaagtttagtccttttttaatcaaagtaaatgtgatgaattgtcatttttttgggtggaccataaaatagttttctctttcaaataaacttaaattaactctaaagttaatgggcttgttaaaagttggaaacattcttaaaagtggtgggggggattttattttaagtttaccaaaaaaaagttgatggagttgttaagttttagtttaaaaataaccaaagctttttcaccccctggaagttgttggaagctgttgtatccaatcctatcaaaaattctaatttatggagagttttcaactcaactgagctgaaac

SEQ ID NO: 429 - DNA, 1059 bp, Homo sapiens
tactgttctctcacttaaagtgtataattcagtggtttttagtatatacagagttgttcagtcatcactagggcccatttaaaatgtctttatcattccaaaaagaaaccccatgccttttatctgtcttccaccaatctatttattccctccagccgtaggctactactctgctttctgtctctaaagatgacaagggtttagcctccagaaggctaagtccaagggtttagccagtcacagaagaccactttctgtatgatttcatacaaatgaaattatacaataagtggtcttctgtgactggcttcctttttgttttttttttgtttttttggtttttttttgagacggggtgttgctctgtcgctcaggttggagtgcagtggtgcgatctcagctcactgcaactgcaacctccgcctcccaggttcaagcgattctcctgccttcctgagtagctgggattataggcacgcgcctccatgcctggctaatttttgtatttttggtagaggtggggtttcaccgtgttggccaggctggtctcgaactcgtgacttcaggtgatccgcctaccttggccttccaaagtttgggattacagacgtgagccatcacgctcagctgactggcctcctttcacttcggatgttttcaaggttcatccatgttgtagcatgtatccctactttgttcttttttttttttttactgttaaatgcgatttcactgtatgcatatactacgtttcatttattcattgatccattgacaggcatttggattatttctactttttggctattatgaataatactgctttgaatatttgtatataagtttttgtgtggacatgttttcagtttcttgggtatatacctagaagaatttctgggttctgggtcatacggtgactctgtttatttttttattttttatttttttttttttgagacagagtctcactctgtcgcccaggctggagtgcagtggcacgatctcagctcactgcaacctccgcctcctgggttcaagtgattctcctgcctcagcctc

SEQ ID NO: 430 - DNA, 1050 bp, Homo sapiens
taaagctagcaagcatctgatgaatatttaatagcattgagcagacaggctggaaacagctgtctgagacagcagctgcttagtgggagaggaggaagtgcacaacactgccttaactacccgttcttttgtttcctggcctagaaaataggtctggctcttcaaggccccttaggagcacaagcctatgggggcactgcaccctagtcctattgtagcctgattgctgctctcggctcctaaggaggctgcattcaagcaggagactcaaccctttttgggaagtaatggggaagaatgttcacggacctctagaatccattttccagtcccaggactggaggtcttccactctattgtctattctggctctgaagctgaggatgcagtctcatctagtgttctgcaaactgtagcactctctgtttttttgtttgtttcgaatgtactttctgctttcgtatacagctctcttctaaaaggagagagacatgtatctggaagggatgtgaatttcatagccgtgctgctaaggtttagcttcttagcattccttgatcacagattcactagcctctcaccagtgactgtacctctcattcctagccggtactgtggtgattgtctttgcatctcaggcagggaatgggccgataggagttctcatgtacacaagctaaccccatccttagaccttggggagcttcttgcttcaaggaggccttgtcactttcagggcaaattgggggtgggggcgggggttgtccagggactccttaaaaaagacagcttagttgagatgtttctagatagagtgtgaggcacagccagtctatcagcccagattaatcagctaaatagggcaccttgccagaaatttgggtactatttctgatcttaatattgcattaagatgcctgaattggctgttcccctgtcaacctctggtgcccacctcagggtatccagtctctttcttctaggcactgtgatgtgtgtgaaaacttgagatagaagagtttgggttcagatacagagctaattattccc

SEQ ID NO: 431 - DNA, 1095 bp, Homo sapiens
gaatcgcctgaacccggaaggcagaggttgcagtgagccgagatcgtgccattgcactccagcctgggcaacaagagcaaaagtccatctcaaaaaaaaaaaaaaatgctgatttataggacagatttgggccaggtgtggtggctccattttgtaaacccagtgatttgggaagcccaggcaggaggatcatttgggcccaggagttgaagaccagcctgggtaacatagtgagaccctgtctctacaaaaaaaaaaaaaaaaaaaaaaaaaattttttttcttttgagatggagtcttgcactgtcgcccaggctggatggagtgcaatggtgcaatcttagctcgctgaaacctccacctcccagcttcaggcaattctcctgcctcagcctcccaagcagctgggatacaggtgcacaccgccatgccaggctaatttttttttttttttgtacttttagtagagacggggtttcactatgttggccaggctggtgtcgaacttgtgatctgcccacctcggcctcccaaagtgctaggattacaggcctgagccaccgcgcctggccagttttttttttttttaattagccaggcacagtggtgtgcacctgtagtcctaactactcgggaggcttacgtaggaggataacttgagcccaagagttggaggctgaagtgagctatgattgcaccactacattctagcctgggtgacaaagtgaggctgtgtctctaaaaaacaggacagattgccagcttttggccacagtcccaaaataacatgaccaaagaagagatctcagcttccagtacccagtgacaggactggcttagagccagtggcatttcctcaaaaacttaagactcctcgaagggccaatagatagcaagtttatcaggaaatgaaggctcagggaggggaagtgagggtttcaaagttacgaaacagctgagacttgtggccacaggtctggaagacaaggtcctagccaaaatcctgccgtcttactattttctccagagattggtaatgatcgtatgtgggatataaaaatattttttacaaaagaaaagataaatattttttcc

SEQ ID NO: 432 - DNA, 1050 bp, Homo sapiens
ggggaaatgtggttctagtgttgttgatttcgcatcctttccacaattcctctccctcttgaagctggaaatctggaatttttttttttttttttttgagatggggtcttgcactgtcgcccaggctagagtgcagtggcacgatctcagctcactataacctccgcctcccgggttcaagcaattctcctgcctcagcctcccaagtagctggcattacaggcgctcaccactgcacctggctaatttttgtaattttagtagacttcaccatattggccaggctggtctcaaacttctgacctcgtgattcacctgcctcagcctcccaaagtgctgggattacaggtgtgagccaccacgcccggcctggatttttaaataatacttactgctttgtaaaggttacaagctaactttcaaaatctgaaaacattaacaaaagatatttgaggccaaatatagcctgagaattgtctgtcttatttgtaaatgttacttcaattaatattctgtgtatcttatgaaatattacgtagtctctgtattttacaaaattatatgtatttttttaaatgttaatttttttttttttttgagatggagtctcgctctgccgcacaggctggagtgcagtggtgtgattttggctcactgcaagccctgcctccttggttcaagcgattctcctgcctcagcctcccaagtagctgggattacaggcatggaccaccatgcctccctaactttttttgtatttttagtagaggcggggtttcaccatgttggccaggctggtctcgaactcctgacctcaggccatctgcccgcctcagcctcccaaagtgctgagattatgggcttaagccactgcacccagccaattaatttttttaattaattaattaattatttttttgagatggagtatagctctgtcacccaggctggagtgcagtggcgtgatctcagctcactgcaacctccgccgcctgggttcaagagattctcctgcctcagcctcccaagtagctgggattacaggcgcct

SEQ ID NO: 433 - DNA, 1059 bp, Homo sapiens
tatgtttttcaaaaattaaacaaacattaaacagttggctgtatataaaatccacatttctagcttctctcttttttttttttgagatggagtttcactcttgttgcccaggctggagtgcaagggcgtgatcttggctcactgaaacctcctgggttcaagtgattctcctgcctcagcctcccaagtagctgggattataagtgcctgccaccacacatggctaattttttttgtatttttagtagagacagggttttaccatgttgaccaggctggtctcaaactcctgaactgaggtgatctgtccgccttggactcccaaagtgctgggattacagatgtgagccctgcctttagcttctcttgaaaatctgatctagcaaatctaacaaatgggactcatgtaagttagtcatatgtaggtctcattcacaatgatggaaaccttagtaattagagctgtgtgaaatgaaatgggttgcttttgtaataatatattatcactggtagtactcagacataggttataggtcagggaaatagaacaatgattcagagtatcagaggagagatcagactaataatctaaatctattctgattcagcctatggattctgtttgataaagtgggaagttatatggaataagcagaatgagattctctacgcatttattcctccccaattcattacatttggagtgaagatatggttagaagagacatcatacactattactgccagcgtttctggttttcaaatcaaagcctaaagggcagaccctaaagccttaggtattattcgttcttgaagccaagtttcagaaatacgttgctttccttcttgaatgagtagtagaggagaaaacaaaaataaaacaattaaaaaagaattactttgctttccaaatatacttgagtgttctcttcaaggacaatgaaaattatgtaagtgctcattttactttattttggatgacgggtagctgacatgccaaaatgccactctgttttaataattaagtggttctttgggttctgtttactgcattcatct

SEQ ID NO: 434 - DNA, 1060 bp, Homo sapiens
aacacataacaatatgccagcatcatcacttttgcactttggggccattattaggtaaaataaggatgacttgaccacaaacactgcaatatctgctactaactggcagtgtatacagtgtggatatactggacaaagggatgattcatgtcccaggtggaatagatggttagcgcgatatttcatcatgttacttggaatagtatgaaatttaaaacttatgaattgtttttatctggaaatttccatttaatattttcagaccactgttgtccatgggtaactgacactctgcaaagcaaaactgaataagggagaaatcgtataaaagtagaattgctggattatatagtaattctttttaatttttttaggaactactattctgttttccacagtggctgcaccattttccattcttatcagcaatccaccaggttccagatcttagccagcgtgtgcttttattattcttactccatcctagtaggtgtggagtagtatgtcactgtggtttttaaaacttttttttttttgagatggagtctcgctctgtcgcccagggtggaatgcagtggcacaatctcgcctcactgtaacctccaccttccaggtacaagcagttctcctgcgtcagcctcccgagtagctgggattgcaaggatgtgccaccatgcccagctaattttgtatttttagtagagatgggatttctccatgttggccaggctggagggtcccacccttagataatctccccacctcagcctcccaaagtgttggaattacaggcgtaagccaccgcgcctggcctaaaacttttttttttttttttcttgagatggaatctcacactgtcgcccaggctgaagtgcagtggcgcgatctcggctcactgcaaactccgcctcccaggttcatgccattcttctgcctcagcctcccatgtagctgggactacaggggcccgccaccacacccagctaatttttttgttgttgtatttttagtagaggcggggtttcactgggttagccaggatagtctcaatctcctgacc

SEQ ID NO: 435 - DNA, 1099 bp, Homo sapiens
ctggtaaaggttctcaggaacaaaagagggcacaaataagacaatattaaggatgaagaaagtacacagtcacagataactgatttaaaagaacgtgaacaggccaggcgcagtggctcatgcctgtaatcccagcactttgggaggccgaggcaggcagttcacctgaggtcaggagttcgagatcagcctggccaacatggtgaaaccccgtctctactaaaaatacaaaaattagccgtattaggcgtggtggcaggcacctgtagtcccagctactcaggagggtgaggcaggagaatcatttgaatctgggtggcataggttgcagtgagtcaagatggtgccattgcactccagcctgggcaacaaaagtgaaactctgtctcaaaaaaaaaaaaaaaaaaagaagaaaaatatttaaaaatacagaaacaaacatttttcacagaaggggaaacatatagctaataacaacatgaaatctaacctcattagtaatctgggatatgcaaataatcatctctgtgaaatactttatgacacccagtagattgtcaaaagtattggtcaagatatttgtcagtggcagtactatggaagacaactttggcactagctggtcaagttaacatttatttacctacaactgagtaattcactgcttagaacagcagttcttggctggacgtggttgctcatgcctatagtcccagcactttgggaggccaaggcaggtggatcacctgaggtcaggagtttgagaccagcctggccaacatggtgagaccccgtctctactaaaaatataaaaattaaccagttgtggtggtgtgcgcctgtaatcccagctactcggaaggctgaggcaggagaatcacgtgagcccaggaggcagaggttgcagtgagtcgataccgtgccactgcactccagcctgggtgacagagtgagaccctgtctcaaaaaaaaaaaacagcatttctcaaagtatggtctgcagacccctgggattacgggtgggagccactgtgcctgatgtgttcctgttttattaaagattaaattctgaagcaataaaagttacaggagcttgtcc

SEQ ID NO: 436 - DNA, 1048 bp, Homo sapiens
taaaaggtataaggaagataagcacccttttggagtgatccagccaggggaaaattgctgatgcaagagaggaaatgagttgctagagtggtgttgtgagtagaggaggggagctgaggcctgcccaagaagggggcttggctgtggtaaccacatggctaggtctgtgtgactggaggagaggacggggcaggtggactggtagatgtgcagcttgtgcccctgattctctagtttcttctgtgttttgagatttgatgagaacgatgaaatagttgtctggaaggagaggagtgtgaatagcatatgcattgtattgggattgctggtcttcctgaaattggtggccatgaatttaaagtgagactcttcaagtagggttgttatagtactggtgtaaagcaggaaggtgctttactagggttgcagtactactggggaagggccaagagagttgagggtgtaagaaatccaagccaggtaatgtagttattttaaaggagagtggaaggatggttgagtcaatggattggaggtcctatagggtaagagactttctgaggatcacagatactgattggaatgagctaaaaagataggtgatggtagtcctggactgggatgctggaaattgagatagtgggtgtgctctctggtagtgacaaagtctagatctgcgctgtccaagataaattcgtctctagctaattgacatgtggccagtttgaatttgaacatgctataaatgtaagatacacatcagcttttgaagacttaagcaaaaacaaagaatataaaacatctttttgtgagagagtgtctcagtcacccaggctggagtgcagtggcgtgatgtcctgcttccaggttcaaacgattctcctgcctcacagcctcctgagtaactgagattacaggcgcatgccaccaaactggctacttttttgtattttttttttagtagaaacggtttcaccatgttggccaggctggtcttgaactcctgacctcaagtgatctgcctgcctcagcctcccaaagtgctggg

SEQ ID NO: 437 - DNA, 1632 bp, Homo sapiens
gtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgccttacttgtttctctcctgacctgtgtattcctttgtttctggatctgatccattcagccccttccatcatcactgacttgttcaggtctgctgcagagcgcccatggtggttccctggtatcttacatattccacagtgtctttgagcagtcgccacagcctcaggatgctggcatattcacttgagctgcctgagtggagcccttggcaaagttggcaagacccttgcctcagagaggatcacacacacacaaaaaagttttccctgacctgggggctcacaggctagtgaagggaaaaggtacttttagctatagacaggtcaatggtgctgagagcagagaggaggcccctgcccccttcagcaaggtgagggggtgatacctggaatggccttctgaaccacagggcaggtagaagatgaacgtcatttagtgattaaatggtacagctgggaagcaggtccatgggactgggagagggggtgaggctgggcccagagtctgggtaccaggttaaggaatgtgggctagatccagagggcagggggggcaactgaaggtgtttcaataggaaattgataggctccagcagtaaggcaaaaggcatggagccaggcataggccatttgaggcccaggttaagaggggtggacactcatcactgctatttgggtctgagctgtgggtaggctcctatagccctggcctgccc

SEQ ID NO: 438 - DNA, 1023 bp, Homo sapiens
ccccacttccctccttcgctctcttcgcctcggctgcgactggcggctaaggcaggcccagggaagctagggagatgaatccaggagtccggcctctggggttgtagcaggggtcggggttagagggtggatgtggagcaggaaatgaattcgaggcgagggtcgggaaatccatggaagggcggggccggctacctacccagagacgccgccatggcaacgccgctgtcttctacttccgggaacgaaggggcggagacccataatccggaagtgacctcgaaaccttttccggtcttactcacgttgcggccttcctcgcgtcacagccgggatggtgagtttcagagttaggggtattgcagtgggggtcctgggctgaggctggggcccaattccgagcactgacgttactgtcttgtccccacagaagccgatcctactgcagggccatgagcggtccattacgcagattaagtataaccgcgaaggagacctcctctttactgtggccaaggaccctgtgagtgttggctggagggggtccgggaggggcgggatccttctgccaggacgatgggtggacacgccagttttgccgttagcggggaaccaaagagcagcccattgtgagaagtagggagaggccatgccgggggtaggttggcgaaagtattctaccgggaaaggtggggaagaactctattggccgagtgcggtggctcacgcctgtaatcccagcactttgagaggccgaggtgggagggtcgcttgagcccaggagttggagaccagcctgagcaacgtagtaagacccatctctacacacaaaaaaattagcctgacatggtggcctcgcgcctgtggtctcagctacttcggagtctgaaacgagaggatcgcttgagcgcggtgagctgagatcgtgccactgcactccaagaaaagcaagagaccactgtggaaaggggataaagatgagggtcagcttgcccagagaacgggatgcgacctttagggata

SEQ ID NO: 439 - DNA, 1026 bp, Homo sapiens
ctcggcctcccaaagtgctaggattacaggcatgagtcaccacacccggcctggccattttcaagatgagaaaactgaagttcagaggagagaagcactgtatttgagatcatatagtgagacagtggcagagcaggcaccagaacccagacttccttactaccagctgctcccacttggataagacatcagagatactgtttttctggactggagctcaacttggccttttattctttggagccgttgggagtcccaggagagctggagctaacaaatgaggatgcctttacaagccgcctgactcctctgttgcttcccttcaggaagggaggagaatccaggagttggtctttttaccagctccctgctgtttcccaagaaataaacagaagagggcagaatcagccttgctacaggctgctgagggttcctggggcaaaataggaagccattgctcttactgggatgtgtactatcctgtggtttgacttttccagatcgtcaatgtatggtactctgtgaatggtgagaggctgggcacctacatgggccataccggagctgtgtggtgtgtggacgctgactgtatccttattttgggtctgagtccgtgttgctagggtctgtcagcgatggagaggctgagttgggagttgggagttgggggtgctgttgagggcctagagaacgatacctcctactccctggtctcttcactgactgaggaaacattcaggacaaattccagttctggataaggaggtaagaggggtagaaaggctctttggggctgaacagggagatgattcacttggcatcccaagaggacaagggctcgggtgaacttcgtcatatttcttaacaactcttcaggggacaccaagcatgtcctcactggctcagctgacaacagctgtcgtctctgggactgtgaaacaggtaagctgggttcattcacctttttagcaaatattgaggacctacagtgtacctgtttgagtaaacaggtcctaggaaaataga

SEQ ID NO: 440 - DNA, 1050 bp, Homo sapiens
tgttatctggtagcacagtcctcccactttgttcttctgaaaaagtgatttggctatttgccctttcacttttttttctttttctttttctttttttttttttttgagacagagttttgctcttgttgcccaggctggagtgcaatggcgcgatcttggctcactgcaatctccgcctccctagtagctgggattacaggcatgcgccaccacggccagctaattttgtatttttggtagagatggggtttctccacgttggtcaggctggtctcgaactcccaacctcaggtgatccgcccgccttggcctcgcaaagtcctgggattacatgtgtgagccatggcgcccggcctctttttctctcttttagagacagggttttactctgttgcctgggctagagtgcagtggcacagtcatagctcattgcagcctcaagctcctggactcaagtaatcctccctcctcagcctcctgagtagcacttctttttaatttaattacgattttgatatacatttcactaattcaccaaggtctatgtagatctgattctgttgtttgttgttgtttctgtaggatcctggactgtgtttcctgtgtattttgtgatttttgactgtgggataatgcagtaggccactcttatctgaggggggatactttctagtatgcccagtagattcctgaaaccatggatagtactgtatcctatatatgttatattttttctaatacatacatacctctgataaagcttaatttataaattaggtacagtaagaaattaacaataataaactaggacaattatagcaataagccgtttacagtttcatgcatagaagattcattcctggccgggcgtggtggctcatgtctgtaatcccagcactttgggaggccaaagccggtggatcatctgaggtcaggagttcgagaccaccttgattaacatggtgaaaccccatctctactaaaaatacaaaattagccagacgtggtggtgcatacctgtagtcccagctactcaggaggctgagacag

SEQ ID NO: 441 - DNA, 1028 bp, Homo sapiens
ggttaagaaggaggctagtataccagttaggagattgttgccagaatccaagtcaaaaaaagtggtagcccaggatggaagtggacagatttgacagataatacattggtggtagtttcaagagaagttgaatgtagcggatgaaaaaagaagaatcaaagatgattcttgcctggtgtggtgtggtggctcatgcctgtaaccctggcgctttgggaagccaaggccagcagatcacctgaggtcaggagtttgagactagcctggccaacatggtgaaaccctatctctactaaaaatacaaaaattagccgggcgtggtcgcgggtgcctgtaatcccagctactcaggagtctgagacgggagaatcgctgaacttgggcagcagaagttgcaatgagccgagatcgtgccattacactccagcctgggtgacagagtgagactctgtctcgaaaaaaaaacaaagatgataccctggcttcgatcttgaacaactaggtggttggtgctgagaataggaaacccgggaaagaaggacataggaaaaatagggtagtagatgcaatcaatattatggaggcataatgagagagattggcaatggattgaaacaggaaggcaaaaaaggacagagtttaaaatgacacttaggttttcagcctgagtggatgttggtatcattaacaaaaataatgaaagagaacttttggaagttaagtggaatttgagtgcttctaggctctcaacaacaaattgttgagtccagttgaatttgaagtgcctttagggtttgtgggtggagcagactgagaagctatttgaactgtgaatctggagctcagaactaagatcaaaatggagtttgtgcagtcatctgtgtagaagggatagccagaccaaagttttgatgacattaggaagagagtaaagggcttagtatagtaaaaaaacaacttggtatttggagctaagtcttttttctttcactgtgggtgttttggtttgcctttttagaaacagggtc

SEQ ID NO: 442 - DNA, 1053 bp, Homo sapiens
tgggtttacaggcgcccgccaccacactcagctaattttttatatttttagtagagatggggttttaccatgttagccagactggtctcgaactcctgacttcaagtgatctgccccgctcagcctctcaaagtgctgggattacaggcgtgagccactgtgcctggctatgaacttttttttgtttgtttgcttgttttttgagacagagtctcgctctgtcgcccaggctggagtgcagtggcacaatctgggctcactgcaacctctgcctcctaagttcaagtgattctcatgctgcagcctcctgagtagctgggattacaggagcctgccaccacgcccagctaatttttgtattttttgcagagatgggatttcgccatgttggccagactggtttgaaactcctggcctcaagcaatcctcccacctcggcctcccaaaatgctgggattataggcgtgagccaccgcacctggccatgaactttaaaaggtgtttttttgttttgttttgtttttcagagatggggtcttaggaatctgaacacattctggcctggagagattgcccaataacttattttattttatttatttatttatttatttatttatttgagatggagtctcgctttgttgcccaggctggaacgcagtggcatgatctcagctcaatgcagcctctgcctccgagttcaagcaattctcctgcctcagcctcctgagtagctgggattccaggcacctgccatgacgcccggctaatttttgtatttttattggagatggggtttcgctgtgttggccagggtggtcttgaactcctggcctcaggtgagccacccacctcggcctcccaaagtgctgggattacaggtgtgagccactgcgcctggccccgataattattttaaaaaagagaaaaagacagggtctcactatgttgtccaggctagccttgaagtcctaggctcaagcgatcctccagggcttagatctttaaaaggttgttgtaagaatcatatgagatagcgtttaaagtgcctga

SEQ ID NO: 443 - DNA, 1815 bp, Homo sapiens
ttccccaaaactgaaaagcccttgatctgtttaaccctctctttttgcagaagaggaaactgaggttcacaatcgggcagtgaaaagccaaaagtaaaacctaggctttctacaactctgcctgctcctacaaaaggtgagacaacccttctgtgtgtccttgtccagctcagcatggggttcagggctcagagcccaggctgggccctgctcctccctgacccctggggatcctaaggaacatgctggcccagctccccttcccacactgccagtttgggctatttcccccccagtgactcacactggctgccggagagagtgggcagctgttctgagcccccagagcccagtacaggccctgacttgccccccaagttctgcagccatatttgggaatttaatgtttttcctccttggggactctccttcccttaatcccttccttttttccctgtcttcaaccatttttccttatcttcagcctcaccctccctgatggcttcttccataggcagacaaacaggctctagtctttcatatctttgaaaaaaagaaagccctccctcaactccacatccttcgccagctcccctctgcagccagcattcttgaaggagttgtatacacacgttgtttctacttcctcactcagcccctgcaatctggcttcctcccccaccattccacaggaacagcctgccaaggtcactgctgacctccttgttgctaaatccaagggatgcttaaaagtctttatctgccttgaccccttagcagtggccagctttgacacaaatactccttcctctttcagatacttttaggcccttgtatttctggacactgtgcacttttgattttcttgctatcttatgggttgctgccacatggcaaatttcttatcctttgctcactgcctaatcatggttgttcccaggcctgctacagtctgtccccagggagtctcatcagctcccatgccttcagcatccagcccatgtcagaaactcatgtctctttctcagtccagccctctccccaaccccacacctgcctcctggacccctcctgctggatgtcccacctctcaggaaacaggctgcatacctgccctccctccatgttccccagcttagccatctcccagttgtctgaacctgaaatctggacttggttctagattctgccctctctcgcctttttttttttttttttttgagacagagtcttgctgtgtcgcccaggctggagtgcagtggtgcaatctcggctctctgcaacctctgcctcccgggttcaagcaattctcctgcctcagcttcctgagtaactgggactataggcgtgcaccaccatgcccggctaatttttatatttttagtagagatggggtttcaccatgttggccatgctggtcttgaactcctgacctcatgatccaccctcctcggcctcccagtgctgggattacaggtgtgagccactgtgcccagcttctctcacccttttcatcctcaagcagctatgaaaacctgtcctttcaggacgtacctaaaatcccatagcttctctccacttccgccaccaacacttgagccaagggcccatcacctttcacctcctgcagcagcctcctgacctgtctccctgctgccactctcaatcccctgtgtggtctgttcctatagggcagctgggtgtgtctttccaacataggaatatgtctccctgcaccatgtctttagcatcaagttcacccaacccatgcccctgccaaccccagtattggggcattcctcagtctttgcctgg

SEQ ID NO: 444 - DNA, 1111 bp, Homo sapiens
gggactacaggcgtaagccaccacatttggctaattttttgtattttttgtagagacagggtttcactatgttgcccaggctggtctcgaactcctgggctcaagtgatctgcccatctcagcctcccaaagtgctgggattacaggcaaaagccaccacacccagctaaaactttttttttttttttttttttttaatataagaatttaaaactatacattttcctggccgggcgcagtggctcatgcctgtaatcccagcactttgggaggccgagacaggcggatcacctgaggtcgggagttcgagactaacctgaccaacatggtgaaaccccatctctactaaaaatccaaaaaattagccgggtgtggcagcgcgtgcctgtaatcccagctattcgggaggctgaggcaggagaatcgcttgaacccgggaggcggaggttgcagtgagctgagatcgcaccattgcattccagcctgggcaacaagagcgaaaactctgtctcaaaaaataaaaaataataaataaaataataaatgaactatacgttttcctctaaactgcttgaactgcaaacaacacattttgatttgtgtagagtattctataaatgtctatttatttagaagtttaatgtttaatttccaagtatttcaggattttcatgtgctattgacttctagtttgattgtatatggtcaaagaacatactctgtgtgattttaatcctttaaatatactaaaaacttaggccaggtgcggtggcttacgcctgtaatccctgaggctgaggcaggaggataacttgaggccaggagtttgagaccagcctgggcaatgtaggcagacccctgactctacaaaaaacttaaaaattagccaggtgtggtggcatgcacctgtggtcctagttacttgggaagatgaggctggaggattgcatgagcccagaagtttgaggttatagtgagctatgattgcagccctgcactccagactgaaagacagagcaagaccctgtctctaaaattaaaaaataaaaattttttaaaaaattataacatgttttatggctcagggtatggtctatcttgattaatgttt

SEQ ID NO: 445 - DNA, 1057 bp, Homo sapiens
ttgttgcccaggctggagtgcaatggcaagaccttggctcactgcaacctccatcccccaggttcaagcgattcttctgcctcagcctcccaagtagctgggattacaggcgcacgccaacatgtctggctaatttttgtatttttagtagagatggggtttcgccacgttggccaggctggtctcaaactcctgacctcaggtgatccacccgcctcggcctcccaaagtgctaggattacaggcgtgagccaccgtccccagcctgcaaaagtatttgttgcagcattgtattagtttgttctcacactgatacgaagaaatacctgagactgggtaattcataaaagaaagaggtttgattgactcagttctgcattgctggggagacctcaggaaacttacaatcatggcagaaggtgaaggagaagcaggcatctttacagggcggcaggatggagtgagtgccagcagaggaaatgccagatgcttacaacaccatcagatctcgtgagactcactcactgtaatgagaatagcatgggcggagctgctcctatcattcagttacctccacctggtcctacccatgaggattacaattcaagatgagattttgggtggggacacagccaaaccatattaagcattatttatcatatcaaaaaaatgtagtcatgacccaactaccttgtttcaaagagaacagaggaattattatattttaactgagaggatatgctagtacaggttgagtatccctaacccaaaaattcaaaatctgaaatgctccaaaatctaaaactttttgagtactaacttgatgctcaaaggaaatgctcactggagcattttggattttggattttccaattagggatgctgaacctaagtataatggaaatatcccaaaatccaaaaaaatataaaattcaaaatgcttctggtcccaagcattttggataaaggatactcaacctggctgggtgcagtggcttacccatgtaatcccagcactttgggaggccaaggtgggcggatcacctgaggtcaggag

SEQ ID NO: 446 - DNA, 1052 bp, Homo sapiens
aatatggttgtccatctctctaaagaaaagcaggctgggcgctgtggctcatgcctataatcccaatactttgggaggccgaggcaggcggatcacaaggtcaggagtttgaaaccagcctggccaacatggtgaaacctcgtctctactaaaaaatacaaaattagccgggcatggtggcgggtgcctataatcccagctactcgggaggctgaggcaggagaatcgattgaacctggaaggcagaagttgcagtgagccgagatcacaccattgcactccagcctgggcaacaagagcgaaactccgtctcaaaaaaaaaaggaaaacaaactaggaggttcttaccatatgtgagtgatttctaacgtttatgtagtgctatattatttataaagtactctctcatgtattttctcagtgaggtggatactatctccgatttacaaatgaggaaattaaggtcagaaagtctgagagagaaaactgatgattggacaggatctgattttaaacaatcctctttcagccttctctccctgtatgtctcctgaaatggcaaagaatagaagtcaaacctcaccagttggcagtcattataaaaataagccaatcagaattagaaagtatgaaaggaggaattgaatcattttcaacaacatacaatatcttgatctagagattttcaaataatgctaagtaatgtccctacagtacctattggtatgtttttatgtcacgttatttatatgtaaatttaaagtataaaactatttgaacaaattattcacttaaatatgttgaacatttttgcttctcttgtttatataatattttcaaaacaaacttttctcctagtatacaaagtttaaacttctcccctttgggctgggcccagtggctcacgcctgtaatcccagcactttgggaggctgaggcaggtggatcaccgaggtcgggagtttgagaccagcctgaccaacatggagaaaccccgtctctactaaaaatacaaaattagccgggcgtggtggtgcatgcctgtaatccca

SEQ ID NO: 447 - DNA, 1030 bp, Homo sapiens
ctagaaaacacctgaaggtggaatggctttcttataaggggtttgggcatagtgagggctaaaagattaatcctatgtttcttacgtgtaggtagcttatctctagtagaggggataaaatagcttgcatttattggggctgtatttggtgctacatatcggggatccaaattagttataattagcataaaagtggtacagataaaattatcagaggaaggaaaatttgcctcaatttgcctcatttcttaggaagaaatgacaatgcaaaaaacaaagaggagggtaaatttagatgatattaacatagttttaacaagaccattgtgccatttggaataatggattttctggtacaaaagtaagttttctgaattacattcaaaagcgattgtatgctaagtaaattccttcaaaacttggatctttaaaagttaagataattgcaaaatgttattagactatgatgtagctcaacaaatgatagaaatttggcagaaattatactagtaacttaagaatgaggctgctacctttacagtggcataaggaaaaatagggaaatgtgtcctagggatgttacacaaaaccatagtaaaaacctagaaattgggagttagaagctgctttgtgtgttttttgttttctggttttttttttttttttttttttgtttttgtttttttttttgagacggagtctcctctcttgcccaggctggagtgcagtcacgtgatctccgctgactgcaagctccgcctcccgggttcacgccattttcctgcctcagcttcccaagtagctgggactacaggtgccggccactacccctggctaattttttgtatttttagtagagccggggtttcaccgtgttagccaggatggtctcaatctcctgacctcatgatccacccgcctcggccttccaaagtgctgggattacaggcgtgagccaccgcgcccggcctagaagcttctttatcatgaccaggagttcccacatgcaattgatcatcagaattgcttg

SEQ ID NO: 448 - DNA, 1237 bp, Homo sapiens
cttactgcaagctctgcctcccaggttcacgccattctcctgcctcaggctcccgagtagctgggactacaggcgcctgccaccatgcccagctaattttctgtatttttagtagtgacggggtttcacggtgttagccaggatggtctcaatctcctgacctcgtgatccgcctgcctcggcctctcaaagtgctgcgattacaggcttgagccaccacgcctggccttgaaatgttttttaaatgcaattttccatttctttttttaacctgtcaattttttttttttcttttttgagatggagtctcgctctgttgcccaggctggtatgcagtggcgcgatctcggcccactgcaagctccgcctcctgggttcatgccattctcctgcctcagcctcccaagtagctgggactacaggcgcccgccaccacgcccggctaattttttttgtatttttattagagacggggttttaccgtgttagccagcatagtcttgatctcctgaaccctgtcaaatttaacagtgagggatgtgtgcaactttgataacactgatgttaataagttctgataacccagtaacattgggccggcccaattttcaattttgaatacgctaagttcttactactgtggttttctttatggtttaggaggcctacgtttaatatctactcaatactgaaataaccaatgttatgtagtggttaccccttgctctgtgggctctgtgccaactgtggcttctcctcctttgttattggtgcctcttttctggcagctatgcttctttttttgtttgtttgtttgttttttgagacagagtctcactctgtcgcccagactggagtgtagtcgtgcaatcttggttcagtgcaacctctgcctcccgggttcaagcaattctcttgcctcagtctcctgagcagctgggactacaggcacgtgccaccatgcccagctaatttttgtatttttagtagagatgaggtttcaccatattggccatgctgatctcaaactcctgaccttgtgatccacccgtctcggcctcccaaagtgctgggattacaggtgtgagccaccgtgcccagccacttttttgggggtggtggtcattggcctttgcagttgtatatgtgcatatctcagagatatgatgggggttcagttcccaatcactgcagtaaagcaaatatataaagcaaaccacacaaattttttgtatgt

SEQ ID NO: 449 - DNA, 1289 bp, Homo sapiens
ttactcccaggtgtgattttaagacttgtctatacattatcattttcagctgcctgctcttgactgtatttggtcataccactggtattttaaactctgctaaacaaaactgaccctctctcccacttctccttttccctctcctccttctttctttctttttgtatgactccaacattttcctagctaaccagacttgaaaactcaagaattttccatgtctgtttacttctagttctagttcacttccagatttcataccatctatctgcggtgtttctcccatcttatcatcttacaagtacaaatttacatacccaaaggaggtatatcatatcacagcatcaaatactactatttctccatgaaagctgtctagatttcaaaaatgttccctatctctatctcaaagaatgtgaacaccctccttaaattttctctttttttttttttgagatggtctctcactttttcacccaggctggagtgcaatggtgcaatctcggctcactgcaacttccacctcccaggttcgatcgattctcctgcctcagccttctgagtagctgggactataggtgcgtaccaccatgcctggctaatttttttgtattttcagtagagacggtttcactatgttggccaggctggtctcaaactcctgaccttgtgatccgcccacctcgacctcccggagtgctgggattgcaggcatgagccaccgcgcctggcctcttaaattttcaaagcacttcaatttaataaaaataactgtggtgtctcatacattaatatttttaaaatagttatattcggccgagcacgttggctcacgcctgtaatcccagtactctgggaggccgaggcgggtggatcacgaggtcaggagatcgagaccatcctggctaacacagtgaaaccccatctgtactaaaaatacaaaaaaaaattagccgggcgtggtggcgggcgcctgtagtcccagctcctcaggaggctgaggcaggaaaatggcgtgaacacgggaggcggagcttgcattgagccaagattgcgtcactgcactctggcctgggcgacagagcgagactccgtctcaattaaaatatatatatgtatatattccggagataggtggtggttatggttaatgcagtgtgagtgtacttaatgccactgaactgtacacttaaaatggctaagctgataaattttatgttgtatggagtttgcgacaatttggaggtggaagacagtttcttgctctgttgttcaggctacagtgcagt

SEQ ID NO: 450 - DNA, 1029 bp, Homo sapiens
ccagttcttggcacagagctctccaaaaacactcggagtttgcagagtgctaggagtgtctttgtcgttcctagtgatccactttggaccacacctgagtttgttctactgtgaggtgattttggtggggcccctagatagcctcatagttggtttagtcagaaaggccaatcacttgatttgagggttaaaacttgtcggcccacttgccaaccttggggttgcagggccagagattgaactctataaaaactcctaatttgatgtgcttctggattggtgaacaactcgacatactgggtgggtagcatgcccagagacttgatggaaactctgcagcccctccccaccttgccgtatgcatctcttccatgtggttcctcagttgtatcctttatttaaaaaaaaaaacaaaacaaaaaacaaacaaaaaacagtaatagtaaaaagctttcttgggttctgtgagtcattccatcaaattatcagacctgaggaggcagtagtgggaaccctgaaatttgtagtcaagtgggatagaagtgtgcaggtagcctgggaccagggaattgcaactggcttctgaagtaaggacagtcttctccaaagctaacttcagatagtgtcagaataggattgagttgtacacccagttggtgtcctaagaaagggtaccccacatttggtgttagaagtaacgtcagaaagcatcacacaattgtatgtattcttttctctggggtcagatcacaagctctttgaaggtaagactatcctgtcctctgcagtacctatcatagtgatatgtgcatggtaggtgctaagagcagtaaattttgctcctgtgaaagtggttcctgtattttaagattatgccgttggatacaggtattctgtcaagcagtagaagtagagtttattctatacaagaacagtttttctcttcaatatatagagattcggaacatattgttttggaagttttaagtgtgcagttcagcagtcttcagtgtatttacagttgtgcaa

SEQ ID NO: 451 - DNA, 3058 bp, Homo sapiens
tctcaaactcatgacctcaagtgatctgtctgcctcagcctcccaagtgctgggattacaggtatgagccaccacacctggcctgactggcttttttatgccaaataatattccatcatatggattggatataccgtgtatccattttagtagttgatggatatttgggttgtttttactttttggctattattaataatgtctggttaggctgggcacaatggcttactcctataatcctagcactttgagaggccgaggtgggcagatcacctgagatcaggagttcgagaccagcctggccaacatggtgaaaccccatctctattaaaaatacaaaaattagccaggcgtagtggcatgtgcctgtaatcctagctactctggaggctgaggcaggagaattgcttgaacctgggaggcataggttgcagtgagccgagatggtgccactgcactccagcctgggagacagagcaaggctccatctcaaaaggaaagaaaaataataatgcctggttaaagaactcaagaatgttggctatcaagacaaatagtatccacactgcagttttgtgggaatgtcctaatcaggcgtctggggatcagctgcttatttttattggaacatgatcatgctaattaatatttcattacccattataggttgtctccggatactttcatccaagagttgaatagttgtaacacagattgtgtggcccaaaagctataaagtatttactctctggcttcctggcctaatctgttgttgaaaccttgagttttagaagaagtcttcatgtttaaattctttttcttgtttttgggcaggcagagaacatttataatgatgaagaccctgaaggaagcgtggatccagaaggacaagggtcctagatatgtctttacttgttgtgattttagactccccttttttcttctcaaccctgagagtgatttaacactggttttgagacagactttattcagctatccctctatataataggtaccaccgataatgctattagcccaaaccgtgggtgttttctaaatattaataggggggcttgattcaacaaagccacagacttaacgttgaaattttcttcaggaattttctagtaacccaggtctaaagtagctacagaaaggggaatattatgtgtgattatttttcttcttatgctatatccccaagtttttcagactcatttaagtaaaggctagagtgagtaaggaatagagccaaatgaggtaggtgtctgagccatgaagtataaatactgaaagatgtcacttttattcaggaaatagggggagattcaagtcatatagattcctactcgaaaatcttgacacctgactttccaggatgcacattttcatacgtagaccagtttcctcttggtttcttcagttaagtcaaaacaacacgttcctctttccccatatattcatatatttttgctcgttagtgtatttcttgagctgttttcatgttgtttatttcctgtctgtgaaatggtgtttttttttttgttgttggtttttttttttttttttttaacttgggaccaccaagttgtaaagatgtatgtttttacctgacagttataccacaggtagactgtcaagttgagaagagtgaatcaataacttgtatttgttttaaaaattaaattaatccttgataagagttgctttttttttttaggagttagtccttgaccactagtttgatgccatctccattttgggtgacctgtttcaccagcaggcctgttactctccatgactaactgtgtaagtgcttaaaatggaataaattgcttttctacataaccccatgctgatgggttttatttagtataaaacatccatcaaacaccagtctctggcttctagaagagtccttcagatgacagttgttgtccatggtctttgactatcaagagcagaattaaatgtaatagtcccagagctgtagaaaagaactttactccttcccagggaaagtgaaagacataaaacactgaatcagaggtggcacagattagtctttgataaggtaacgtttctttgaagtctatctgtagagaactacatggacttccaagagtgtcaaaggcagtgtggtagagagaatttaaggcaagatttaaatttggaaaaggtgcttgaaccttttctcagaggttttatttccccagtatgtttttcactggggcctttacttaggttagaaataataggctttgaaggcctctatcaccagatgcaataaccagataaaattcctgttttttcccaatcgcttagttttttgttgttgttgttttttaactgagtagatcattctgacccagaactactttcatgaggtaagatctttgggaaaatctgaatagcgttaaccattagattcaaatctcaaatggtttcttttcaagtctagttgttttagagtatagtgagaaataccttgacacaattttaagagtaaactatatgggtcagcatatccttgaacaaaaagtagactttgtaaaagtattcatttaaattctaacactcgtggcacaaaagaatggaaattgtaaacccatgtaatggaaattggctatctttttgaccccacatgtgcccctcaaaaatgtttttggtttgggtcaacacaaggcaagatacattctttaaaatactcccagatgtgtccatacattcatccttcactcagtgcatatgtgagggttgttgctggaagacaggaggctcatctttcctttccttggtgcattgagatcagtatcaacagcagatgaaatagaatccagcaaagagttgacatgttctgcctccggccaactctagaatctttttaagcaggtcagccagtatttgcaacttccacaggatgaattgcttgccaagtttctggcactcttgtctggttggaagagtacatccaaagggtacttagtgatcctttgctaagaagttttttgctgtttccgggttacagatttggccatatatttctaaacagcccctg

SEQ ID NO: 452 - DNA, 1217 bp, Homo sapiens
tcgaaggaatttgcaaaactgttacagataatttcagttctttttgattttttgtaaatgttgtgcctattttttatggagtgataaagcctgctgagtgcgtttcgtgctgtgtgcttcacatgtattgcatttgggaaaggttggaaatcaaaggccagggggaagtcttgtccactggaaataatctctgctcttggctgtacctgtcagaccctgcttggtaatggtcttgactttagagcttgaaagaggatgtgggcttgcatctggtgttgcagttttagtggcctcaataaagtaaggctttgtgctcgaaggcagtaggttttctgaggtgagataaaaatagaaagggaaccagtttctgaggttgcaaccaggaggttcgagaacagagagggggtggtaaactgaagtgtgaagaagggggtggacaggtgagagagatgtggaaggacagaatggggtcacagaaaggatggggtgtagaggaactaagaaatagaattagaagatcggaaaaatattcttcccttaaaaatgaagggatatggccagacatggtggctcacgcctgtaatcccagcacttggggaggccgaggccggaggattgcttgaggccaggagttcaagactagactggccaacatagcaaaaccccatctctactgtaaatacaaaaattagcctagcatggtggacgcctgtaatcccagctactgggaggctgtggcatgagaatcgcttgaaactgggaggcagaggttgcagtgagcccagatcacgccactgcatttcagcctgggtgattgagtgagaccctgtctcaaaaataaaaataaaataaaaaaataaaggggtccccatattttaagtggaggttaccagacaagtgctaagaaaggtggtagatggtagacagagaagtaagcaagccttcttttgacagagaagtaataagtaaggctgtctttggaatttcactgaagaacttcagttttatatgaggatttccccccttgcacattcattaaataccatgtttttttagtatagaacttttaggtttagagtactttcataaacatcctattttttctcatgataatctgtgtttgaagttaacagtatttaccccctttttagatgcatgttctcatctgtattgaagttcagagacttgaagtgaattgctgaggtccagtacctcta

SEQ ID NO: 453 - DNA, 1770 bp, Homo sapiens
gtggtgcgatctctgcccactgcaacctccgcctcctgggtttcagcgagtctcctgcctcagacttctgaatagctggggctacaggcccgcgtcaccatgcccagctaaattttctttgtagttttagtagaaatggggttccgccatgttggtcaggctggtctcgaactcctggcctcaagtgatccgcccaacttagcctccgaaagtgctgggattacaggcgtaagccatctcgcgtattgtttttttaataaagtaattgcagggggaaaagatctgaaatttttagattaaaatacacataagacattatcagccagtcacattgtatggaccttacttggatactgattattttttagccttaaaaaaaaatatgacataagataattggaaatctgaactgtatattttatgataaggaattcttgttatttacagatgaaatgatacaatgcctgggatttgcttcaaaacaatctggtaaaggtgggaagtggatggggcaagattagctatgagttgatagtcattggggttgagtgatgggtatgtggtggttcattatactattatgttacttatgtatatgttttactttctttataataagtacttttgaaaatgaggaaatggccgggcgcggtggctcacgcctgtaatcccagcactttgggaggccgaggcgggcggatcacctgaggtcaggagatcaagaccatcctggctaacactgtgaaaccccgtctctactaaaaatacaaaaattagccaggcgtggtggcgggcgcctgcagtcccagctactcgggaggctgagtgaagcaggagaatggtgtgaacccgggaggcagacagagcttgcagtgagccgagatcgcgccactgcactccagtctgggctacagagctagactccgtttcaaaaaaaaaaaaaaaaaaagaggaagtaacatcagacatcagaaagagaatggtttgtacaaattaaaattatctcctcctctctatatataccatatatatggtattgttttgtatacttttgttcccagatctattggaacataagaagctcagaaaagcccatttttttgcatctgaatgtcatgttgtgtaggaattgattattgcaatggttacgaaggatattggtcctattaaggtggcttaaaatattttttccaagagaccaaaagccctctttggtctttactcttgcacagtttgttatagattgtactgaatttagaaggcctgagtttggattctagctctgccatttgctgaccaatcctgtgcaagtctgtcacagatgtagtgggaaaaacattgcatttggaattagacctgggtttcgatccttgttctaacattattagctatgtatactcagttaagttacttcatgcttctgaactttagtttcccaagagggaaaaatctattgaactctccatttggccaaccaagggcttgaactagaccttttgtaaggagttagaatggggggcaatggcccagaaagggcatctaagaaatgtagctgcttaaccccagtgcctgtgataacctgtctgacaaccataaattttcttaagtcaaagaatgttttccatactaaacttttttttctaactgcttcctaaagaaatgaataactcagtcactaatgcagagaaattacttttcatagaggcagctgcttcaacacctagaactctcaacaattgctggaatatagtattggtaaaataaaataag

SEQ ID NO: 454 - DNA, 1043 bp, Homo sapiens
tccataccattttatattatctcatgttggtgtttaattttcagtgttgtttctctagcaagattatacattaagattatacattacgtattatacattatgagggcaggagctataccttgatttgttggaaatcataaagagacatatgcagcttgtggtgtgtgatgattgtagctcaaaaaatatcttctaaaagaatgcatgaactaggctgggtgcagtggctcacgcctataatcccagcactttgggaggccgaggcaggcggatcacaaggtcaggagatggagaccatcctggctaacacagtgaaaccccatctctactaaaaatacaacaaattagccgggcgtggtggcggtcacctgtagtcccagctactcgggaggctgaggcaggagaatggcgtgaacctgggaggcggagcttgcagtgagccaagatcgcaagatcgtgccactgcactctagcctgggcaacagagtgagactccgtctcaaaaaaaaaaaaaaaaggaatgcatgaactaaagttaaagctcagggtgtggtatggagggtcatggagtaggggaaattttatagttaacaaggctacaagtacttttccaaatttttgagttcagtatttaagcatttcttatacttctcagatatgtgaaatactagcattttatcacctttcccatctggaaaataattatagattaggtctgtcattagctgtttaaaaactaggttttaattatacaactaactaaatattcaagtagaaaagtaaaatgatacaaagtccaaccttgacctacctttatggtccctgcgagttataatagtcatcaatttttgtttgtatcttttttttttttcttttgagacagggtcttgctctgtcaccctggctggagtgcagcgatatgatgactgctctctgcagccttgacctcccatcctcaagtgatcctctcacctcagccccatgagtagctggaactataggcgtgtgccaccatgcgccgctgatttttctgtttttttgta

SEQ ID NO: 455 - DNA, 1052 bp, Homo sapiens
tttcttgggtctcactgtgttgccctgactggtctcaaattcctagcctcaagcagtcctcctgcctgatactcccagagtgctgggattacaggtgtgagccaccacacccagcttctcttctttttctcttgattccatactccattttagttttttttgtgtatgactaatactgtcctctgcctctcgatcataaagataattttgcctctgaaacttagttctaatcaatcagcagtatatcacttctctctacaaaacgctatattcctgtttctaatgggctgtttttcttttttctggtttgctttattcaaggactaatgttccgacgttttcacagtcaaatctagaacagcagaagcagctttatctcaggagtgtcattgctcatatagaagacccagaggacactaaccaaggtaacatggtacccagagaaaggcatataaaacatgtgatgtgactttctctttccggtgtaacagcttaaactgggagattgtttagaattttcttaaattcttgagaaagataacttccttacttaaaagattttcacttaaaaggattgcctaaccagataattctcgaagtggtttggttaaccagttttagagagggatctaagcacgtttacaacagtacatgaaaggtgcctccctcatggttgagggctttaacccagaccggtacatttttgctagggatttttttgtctgaaaaataacggaagtggatgaccaggtgctgcttactaatcagtggtttttaaaatttgaaatgttttatttctcctgttaccttcagcatttaaaagcaggcatttcaaacaccattctgcattttggcttctgaataaaagctcttgaaaggtttggctaccttccagatccttcaagttgtgttctccccacttcattagaagatattgcaaaccaaagtgactagattctttctccagctctcaagagagtacagtccatgttatcattcagcctgaactattggctgatgggaaagctcctaaaggggagacttacgggaag

SEQ ID NO: 456 - DNA, 1031 bp, Homo sapiens
tttcttagccctctgcttgtgagatccctttgctagaactattttaggtctgatagaagtagagaaacctctcctctccacctctccccccatcattggaggggcaaatttaaaagaaacctgtctatattcaagctctgtggaacaggcctagtcatgtcattgcttttccctctgtgagctgactcctttttttatatcctaggcagttgacactgatgatatccagttatgttttctctcatttggagcatttaaataaaatttcccaagaaaagcaaagagcagctgttcacactataacatcattttcaatcttttccccattcagcagttcctttcccagtattaccacaacaatctatatcccatgaagaatagctagaataactatagtgaataggcagcatactttagtggttgagagagtaaagtctagtctagagttaacatctgggttcacatcttggcaccactgcttactggctgggtgagccattaaatattgatttgtaaaattgggataatgacaaggcttaacttacatgaaaattatacgggtataaagcatagaacagtacctagctctagtaactaacatttattgaatagttgctgttaccagcaagaaaggatattttttcatactgaagtttttttttttaggtaaaatagcgttatatctagtgtttgtttttaaatcacagccaaaaaatactggaaacagctttgataaaatgttgataaatgaaggtgagtggtgagtacactttctacttttgtgtatatttgacaatttccataattaaaaagttgttttttaagcacgtcttttagggcattcatttttttcagcattacaaattactctaaaaatttcacagacctctggcacttccttctgccttccaggaacccagtataatatgaagtttttctatcacttcccattgcccagtattcctacatccaaaatcataagatttgtatataccttattgcaagggcgggggtggtatgttcttcacctt

SEQ ID NO: 457 - DNA, 1736 bp, Homo sapiens
gcctggtgtggtggcgggtgcctgtagtccagcctgggcaacaaaacaagactccatctcaaaaaaaaaaaaaaaaaaaaagaaatttgaagacattcagtattgctcttaagaagtctgaagtctgttataagtttaacttttatttctttgtatgtcatctgtctttttctctctggaagttctttttgtttgtttgtttgtttttgagacagtctcgccctgttgcccaggctggagtgcagtggcgtaatctgagctcactgcagcctccacctcccaggttcaagcagttctcctgcctcagcctcctagctgggattataggcaccggccacctgcctgtaatcccagctactcgggaggctgaggcaggagaatcacttgaacccgggaggtggaggttgcggtgagccgagatcgcgccattgcactccggcctgggcaacaaaagcaaaactccgtctcaaaaaaaaaaaaaaaaaagataataagcatattggactaaaaactttctttgtgcacctttgtaattcctcccttctgcctatctctgccccctctaatccccaggcaagattgaccactgatctagtgtctactgcagttagtttgcattttctaaagttttatgtgatggaatcatacactatgtactcttttgagtctggcttctttgtctcaagataattattttgaaattcatccatgttgcatgtttatttctttttattgctgagtagtattccattatatagatttatccctaagtgaatgtttacccattcacttagatgggcatttggcttatgttcaatttttggctatgacagataaaactgttaggaacattcatgcacaaatctttgtatatatatgcttttatttttcttaagtaaatatctagagtaaaatgactgggtcatacggtaggtgtgtgtttaactttttgagaaactgccagctgggtgcggtggctcacgcctgtaatcccagcacttttggaggccgaggcgggcggatcacgaggtcaggagatcgagaccatcctggctaacacggtgaaactccgtctctactaaaaatacaaaaaattagctgcgcgtggctcctgtagtctcagctactcgagaggctgaggcaggagaatggcatgaacccgggaggcggagctttcagtgagccgagatagcgccactgcagtccggcctgggcgaaagagcgagactctgtctcaaaaaaaaaaaaaaaaaaaagaaaagaaaagaaactgccaaactgttcccaagtagttgtaccgtttttcatttctattagcagttgtatgaattccggttgcccccagccttaccaacaattgggtatggtcactattttaaaatgtttcccccaactttttaattataaaatacacataatatacacataaccatctttttaaaacctctttataaaaacgttttggctgggtgcagtggctcacgcctgtaatcccagcactttgggaggctggggtgggcagatcacctgaggtcaggagttcaagaccagcctggccaacgtggtgaaaccccgtctctactaaaaatacaaaaattaaccaggcgtggtggcaggtgcctgcaatcccagctactctggaggctgaggcaggagaatcgctggaacccaggaggcagaggttgcagtgagctgagatcatgccattgcacttcagcctgggtgacaagagtgaa

SEQ ID NO: 458 - DNA, 1725 bp, Homo sapiens
accattgcactccagcctgggcaacaagagcaaaactctgtctcaaaaaaaaaaaaaaaaaaaaaaaattacggattatgctttcatgtggtatctaagaaatctttgcttaaaagaaaaggccacaaaaattttctcctatgtttttttctagaggttttatagctttagggattacatttagatctatgatccttttaaaatttattctgtatgtagtgcaagatatggattaaagcctgtaatcccagcactttgggaggctcaggtgggaagattgcttgagcccaagagtttgagaccagcctgggcaatgtggtgaaaccttgcctctaccaaaaaaaaattaaaaggttagccgggcatggtgacatacacctgtagtccttgctactcagaaggctaaggcaggaggattgcttaagcccagaagagggaggttgcattgatgcaccactgcactccagcctgggtgacagagtgtaagactgtctcaaaaaaaaaaaaaaaaaaaaaaacatatatatatatatatgtatatatatatatatacacacacacacacacacacacacacacacacacgtgggaatgtaaggcttattttcttggcacatggatattcaattgcttctttaccatttattgaaaagactgtccattctgcattgaattgcctttgtacctttgtcaaaaatcatttgtctctagaaaaatcaggtttccaggaaaaaaaagactaatgtgttccactagtgttcttatttttcagttgtgttggcttttgtagattctttgcatttccatataaattttagaattagcgtatcaatttcttaaggcttggtgggatttccattgggattgtattgagtctatataaataaataaaactgagagagaattaacattttattttatttttttgagatggagtctcactctgttgcctaggctgtcgtgcggtggtgcgatctcagctcactgcaacctctgcctccgagattcaagcaattctcctgcctcagtctcccaagtagctgggattacaaatgcctgccactacactcagcttaatttttttatttttaatacagacagggtttcaccaagttggccaggctgttctcgagctcttgacttcaagtgatcagccctcctcagcctcccaaagtgctgagattacgggtgtgagcccccgcgcctgactgagaattaacattttaatattgagtgttttgattaaagtcttctctaatttccttcataaatgttttgtagcttttgtacagtcttgcacatcttttatccaatttatcccggagtgtttcatattgtgatgcttttgtaaaatgatttagtttttaaaatttcagtatctgttcattgctattatatagaaatgtaattgatttttgtgtcttggtcttacattctataaccttcctaaattcttttattagttttagtaactttttaatagatttcatcaggttttccctgtaggttatcttattgtcagcaaataaagaaatttttacttgtttctttctgacttggatgccttttattttcttttctggtgctgcctagaacctccagttaagtacaaatgagatcttttctttttgtttgttgttgttgttgttgttgttgttgagacaagaatctcgctctgttgcccagactggagtgcagtggcgtgatctcagctcactgcaacct

SEQ ID NO: 459 - DNA, 1059 bp, Homo sapiens
tatgtttaaagtaaatgtcttatagagagcatataattggtagctgggtcttgctttttttttttttttccagtctcacaatctcagtctttaattggagcattaatccatttacatttaatgtacaatcccatatggctggatttaaatctgccatcgtgttacttgttttctatttgttttttgtttccacttccatctttccctgactcatttaatttttgtagtattttttagtattccattttatctccatacttactgcctatacctctttgttgtatttttattatcttattaaatttattattattattatggagatgggatctcactctgttgcctaggctagagtgcagtaacatgattatagctcactgtagtcttgacctcctggcctcaagcaagcctcccacctcatccttcaaagtgttgggattacaggcatgttatttttactttaaacagtaaattatctttcttttttttttttttgagacggagtttcactcttgtcgcccaggctgtagtgcagtggtgcgatctcagctcaccgcaacctccgcctccaggttcaagcgattctcctgcctcagcctccctagtagctaggattacaggcatgtgctaccacacctggctaattttgtatttttagtagagacggggtttctccatgttggtcaggctggtctcgaactcccaacctcaggtgatccgcccaccttggcctcccaaagtgctgggattacaggcatgagccaccgtgcctggccgtaacagtaaattatcttttaaagacatcatctaaataggaaaaatagccttttatatgcactcacatacttacatttccagtgcttttgattattttgtatagatccaagtttcgatgtgatattattttcctttttcctaatgaacaacttgtaatgtttgttgtagtgcacatctactgatgaagtctctctgcttttatttagaacctgtttattttgccttcatttaaaaaactttttattttgaaaaattatagacttataagaagtttcaagactc

SEQ ID NO: 460 - DNA, 1048 bp, Homo sapiens
caaatatatttttcattttgtcaattatgtttcatttggtcgtgcttttttaacagtagagaaacttttaatgaaatctataaatttttcctaaaaagtgttatggttagaaaaatatttgagtgccataaaatgtcatagtttatgtgtggatggatccatttaataaacgtttttccttaaaatttcacaggatttgcagagtctttgcaagctaacatagacctgaggtgctaacatcataatagctaccactcactgcacacacgctgtgtgccatagcaatgtgctaggtcttttacgttcaatattcctaaaactcagcttcaagctaaattgtattatctgcttttcatagatgagtagtgagccctgaagaagtgaaataatttgcccagggtcacagagctaattgatggattggaattttaactcaactctgcctaactccaaagtatacagtatactttctctacaaagctctactttttgaggcttcaaataaattacatttatcctaaaagtgacattacttttactagaacttgaaaatatgagtctgtagcctactgagactgcttttgattcccgaaagcacagtagataaggtaatgaaaaacatgtaaacgagctgaaaagtctccactgtctagggctttgattttcaaagtgtgcttctcagctgggcatagtaactcacgcctgtaatcccagcactttgagagagcaaggtgggtggatcacttgaggtcaggagttcaagaacagcctggccaacatggtgaaaccctgtctctactaaaaatacaaaaattagccaggcatggtggcaggcgcctgtaatcccagctacttaggaggctgaggcaggagaatcacttgaacccgggaggaggaggttgcggtgagccgagatcacaccactgcactccagcctgggtgacagagtgagactccatctcccaccccactacccacaaaaaaaagaaaaaaaaagtgtttcttagaccaccagcattagcatcacttgggaatttgcttgaaatgc

SEQ ID NO: 461 - DNA, 1050 bp, Homo sapiens
gattacaaggcagggtctcctgtctctcagaccagcatttctcccacaggcctgtggtagtctccaagtgaggtctcttggtctcaaagacctgcctgtgcctttccacagttgtgagaaaatgtccatggatctatgtgatggtggtgaaaggatcacatcccaagtctagctgtgtagggttcgactttgcaactacagtggattcagggaaggctcaattgttatacaattgggagtttagggaggtaattaaagggaatggagttttatctaagccaagagtgttacctccttttctctcataccctttatgatgtaccacaggcacagattaagttgaagactggaaacccccattagcagagctccctgagccccactgactatactatacctagtgctgatttgggggcttttccatcatttggcactagatgggtacagagggcctaggaagtacctctctgaggtttggcttagagtcggtgtgcaactcaagtttcctactttgctgtgcagcctctaaaccttctttccctctgctttcaaaacctacagcagtcaactctaagccctgctcaccggacattttctctccaagcttcttcctggctctggacaggaatgttcgaggtaccccatttactggtttttgctccttggctaatgtcatcattactctttcagcctactgttgggatcataatggtgttcctttaacagcctagaacagcacgctgtgaatactgagctgcagaaagcagcttttgctgttccccttcacttccttccttaccctggggagaaacaagaattgtattcctttggccaggaaaagcacccagccccatccagaggggaaaaccctttgttttaaaaactaagtaccagcctgcatacctatctagtgaggcagcccaagcttggtttgggggagcctcagtaataggatgatggagcagctattttcttctcctacacgtgcacccccatctgtttgagatttcccttccaactccagcttggctggcaggcatgtccctaaga

SEQ ID NO: 462 - DNA, 1068 bp, Homo sapiens
atctgttgaatgaattgtgaatggatgaatcaatcattcaataaactgtgagacccttgagggtctcacatctgttcatatctgtttccctagtacggaacttggcatacagtaggttcagtatatgttggaattaaatagatctttttttttttttttgagatggagtctcactctgtcacccaggctggagtgcagtgctacagtcttggctcactgcaacctctgcctcccgggttcaagtgattctgctgcctcagcttcccgagtagctgggattacaggcgcccgtcactatgcctggctaatttctgtatttttagtagagacggcatttcaccatgttggtcaggttggtcttgaactcctgacctcaagtgatctgcccgcctcggcctcccaaagtgctttgattacaggcatgagccactgtacccggccattgtttctttcatttctatgtctttgacaaggataaaccattttgtttttgtttattgttttatttattttgatgtcaatgtctttttatatcctctgttcacttaatttgggaggtcttgaagttttttcttgcacatagaaatgagcttgcatatgcatgtgtgcatgtatttaatatgatgtttgatacaaatattttttcactctattggtttattgttttagttttgtaattctttgttattctttcatagaagttttgacacactattttgttttaactaagtttgctgtaattaataggaaggaaatctgttactttcttttgtgctctgctgttatagattatctttattacatatatatatatatagtcttatagaaatagaatgtttattagaaaaaatttaacacaaatagtaaaataaaatgattcactaatcccaccattcagagatgactattgttaaatgtactttgatttctactttttttgggtttaatggctattttattttgttttattttatttaacacaaggtcacattctgtcaccctggccagagtgcagtggcacagtcatgctcactgtagcctccacctccgaggctcaagccatccttc

SEQ ID NO: 463 - DNA, 1105 bp, Homo sapiens
actgactctgggaggcagctggggggatagggtagggcctccttaagtgcactgcactttacagcttaccaataaattatgtgaaattggtatcctcatcttccatgtgggaaaactgagtcccagagagggtggtcatttttctaaagtcacacagtgatggagcctggatttgagctgaggtctgtgtggttcccgagaccaggctcttgccactgccccatgagctgcctgctgcctgctcccaagactaccaccacctctcctccaggtaaagactgacagccttccctggctggtaagtttttggacaggtttgtggtgtggcacttgccagcatgggatatgggaccccaggtaagtcttggcttctctctgaacctcaattttcctcctctgtaaaatgagcataataccatttacccagccgggctgctttgtggattagctatgctcatgtgtgtgcactgcctgggacagagctgggtgggcctgtgtgtttgtcaaaatgaatggaactggctactgacatctgtaactttaatttaatacaaattgatcataactcataaaatgggcaacattttaaataaaaatactgctggggtggcccagattctggtagttgaagggttggggtagggctgacaattccttttgcccaagggaggcccgggtggcgggggcagccattttaagaaccccctgtgtttagctcttccggctactttgggatggtgtgttgtgtcagagaccccaagtgcagaatctaggccccaggactagaaagaaaagtcaaggccggggagacatttaggctcagtcttgcagcccactcctccagttcccacctctgggcagggatagagccaaggggcaggacaaccctagatgtggactccaccctctcccgagttcttcacgattggatgctgtggcagaaaaacgcaggtggggcttgctccacccaccctaacttccttctagggaaatgacatttcccagactcccttgcagccaaggttctggatctgacttaagttcccccaaacagaatctcttgtaaaaatttagatttgggaactgagtgaagtgggagaggggc

SEQ ID NO: 464 - DNA, 1047 bp, Homo sapiens
tggagagccccctccccaacctggtggtcctcctgcccccagaggtggcagctggtggtaatgtcttccccgaccccaccctatgatgaacttttggttgggtgcaggcctgcggcccagtgggtcccgtctgagggaaggggcaggaaaggtagtctggtttgctagacctcctcggtgtgagcctcacccctgtagtatgctcttattcctttctgccactcctgccctacgcccgggaggtagaagcactttggacttcggttaagttcctgaagtatcttgctggacaggtcagggcctgctggctccgcaggctgccgagggggatctgaaggccaggcccacaaggtctggggtgactggtgctgtccaaggcactggggcagtgttgggcctagcctctcatgtgtcccctaccccagcatttcttggaggggagacccttctagtctcactcctggtttgtgtcctggctccactagacagagtgagctcccagaagccagagtcgggggttgaaagctggggttaggggttcagggctgtggaacatggcatgtcttggccagagggtaccaagccaggtggtttttagatggaggaactgaggtccagagagaggaagtgacttgcctgaagtcacgctaccaggtagaaggagactgagaccgggacctgggtgttcaggcttccactgctgggctccctccactgttctccatgacgggcctggacccctggaagatccgttttgaacagaactggactagaatgggacagcacgatcccttcaccccctcctacccccgccatcataatctttcctgagagaattgaacttcacagttttcacagtatggtgtggtgattatcacatcaggttctcccagaaactcagttagggttaaattgtcctaatggggattatgaacctcattataaggaaaccaagactcagagaggttgaacagtggcagaggaggcttaaattcaggcctgcaggctcctcgcctggccttttcccaggtggactttggtgctgtg

SEQ ID NO: 465 - DNA, 1053 bp, Homo sapiens
tatccaggctttgtgctagatgctgaggatagatgggaggaaaactgatgtatataggtccctgccctagcggaggtagacaggcactatataaaagatcacacaaatgatgatttttttttttttttgagatggagtctcgctctatcacccaggctggagtgcagtggcacaatcttggctcgctgcaacctccaccttccaggcttaagcaattctcctgcctcagcctccagagtagctgggattacaggcgtgtgccaccacacccggctaatctttgtatttttagtagagatggggttttgccatgttggtcaggctggtctcaaactcctgacctcaggtgatccacccactttggcctcccaaagtgctgggattacaggtgtgagccaccgtgcccagccacatgatgattaagattagagattttggtcactatgttgactgatgatgggggaggagcagagggaacagcctgggcagagacccggaggtgagaaattcagggacaaagagaaggtggtggcactgggacctagggaagttgcaggagatgaggcagcaggtgaggctgagtctggtggggcctgtagccggtcttccctggcctgttccccgcgagccatttgtccaccccacaccctccccactcctttctctgcccagcccagctcagccttccctttgctgctgtggcctgcttggggcctgctctgtctgctggcctgcaccccaggctggaggcctgtttggcctgccccacaggctgcctgccttggaggtcctgggatatagcagggaagcaggcttcactgcctgccaggggttccctgtccaggacccctgagacctgtctagaaagctcctgggggccgggccagagccagggtccagcagttggctttcctgtttttagttaatctcagacctggatctttgccagtcagaagaatggtccctgtgggtcctgaaggccacccagagctactgccaccccccaccccctagatggcattactggctggtcagatttccatgtgggtcttt

SEQ ID NO: 466 - DNA, 1047 bp, Homo sapiens
tactcctgatctactatccatatcacattttggcacgttctttcctacttatttttttgtgtgcatacatacgtagtttgcttaaacaaacataacctccttttcaatgggcagttcagtagaggcaattaattgctgtttaccgaatccttccctaatgttgcatatttcagttgcctctaaaattttgctgttataaataagacggcagtgaacttctttgtgcctcagtatttttctatagtttgaatttttccaaagtgcccctgttatctaactcaatttaatcttaaggtgtctaaggcatcttacacatgcacaaggtctcatttagttacccctgggtaataacttatgaacgttaaggggatgctcgcctgccaaaatcacatagctgggtgggcagctgagctggcctctgcagctccgctcacccctgcccccacccacctgtcttcgcaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgggggtcttggcgggatggggtccgagtgggcttggggctggggcttgagccagggctgctccaggagcccagcagcggggctgaaacaggacccttagggctgaggggcagggctagggtccagaggggcggggccttctggagagccccacccacatcccaagtcccagttcggggagggctgctggggaggggaatagaggcttggacccttaggtgtggtctgtggctggcagccacccccacag

SEQ ID NO: 467 - DNA, 1103 bp, Homo sapiens
cggagtcttgctctgtcacccaggtggagtgcagtggcacagtctcagctcactgcaacatccgcctcccaggttcaagcgattctcctgcctcagcctcccgagtagctgggaatacaggcatgtgccactatggccacctaatgtttttgtatctttagtagagacggggtttcaccatgttggccaggctggtctcgaattcctgaccgcaggtgatccgcccgcctcagtctcccaaagtgctgggattataggcatgagccaccgtgcccagcctacattattctttttagatcaagatccaaataagattcctgcatcgtagtagctcagtagatcttttaatctctaggtccccttacccccactttttttctttgttatttattcactgaagaatagtttcctagctaggaatttgcaggttgcttccctctggtattggatagcatgttgccgccacatttgagggcttcctctgctgggttctgagcatattgaggtctgaagtcaaggagtggcaggtgggagtaccgcctctgcttctggcaaaggcgattggaaggatgtggcttagtgtgagggcttctgggcctgcagtgagccctgggtcacaacctcacctacccagtcctggtgcctcaggtcagatccagcagagccagtggaggacatgatagtacccacctgtagtcccagctacttggagggctgaggtgggagaactgcttgagcccaggaggttgaggctgtggtgagctgtgattgtgccacagcattccagcctgggcgacacagtgagaccttaagaaaaggaaggaaaggaaatgtagagactggggcaggagtggacccttcaacccttactccatgctaagggcttgatctttgtcaccacagcaacctgttgaggttgttcctcccctatgcctgcttacagaggaggaaactgaggctcagagagacaagatgacttgtccaagttctcaccactaagaaagagcagagctaggctcagacccagtcctgctgcctcactgtcactgggatcaccagccagatgcaggcacagtgcttcacctggcagacagggctgaggt

SEQ ID NO: 468 - DNA, 1037 bp, Homo sapiens
cacgccctgctaatttttgtatttttagtagagatggggtttcatcatgttggccaggctggtctcaaactcctaacctcaagtgatctgtatgtctcagcctcccgaagtgctgggattacaggcatgagccactatgcccggcctgaatgtagtattttagtttagagtttagatataggtggtgaagcttcagtatgcgtaaaattatatctaagtttgtatgtaagagtgtatctggttatagtttatagaagcatgatcattaaccccaactgacattatcttatatggagatatatctagagtcacttatttttttagggaatatagtgactctggcaagggacgtggggagctgtgttgttttgacagctatatgctgtcacagttagggttttgtgaaattatgctggcaagggaaaggagcaaacatggcttcttatgtttgctactttgtctcgcagcacaggaataatttatcataatattactgaaatatgtacaaaccatgcttatgagcaggggaggtaaaagggcagagcgaatgacggggtgccccctgtgtttcttcctgtggctcctgcccagagacatcccgaggggccagccacgcctctccagccgctgacatcacagtgactcggaccctctgtgtccttgggcagttatgtttcctcttttgtatctcagtctcctcatttaaaaaaggggttgcaggtgggactaaaacatctccagagacaccagctgcattctgcaggctcaggggtgaaaggtctataggctgatagctcggggctctactgcagttgagcctcgctcactgctaagctaagggaaggggatttttctcttgaagtgaggagctccccaaaggcgaggagctctccctcctactcccactcccacggactggcgcacacgaagcgggtagggcttttgtatccagtatctctctgctctccagagcgccatcagcgtccagaagggccccgcccggtttcaggatctcttcctctagtgactcccactcc

SEQ ID NO: 469 - DNA, 1029 bp, Homo sapiens
catgtaagagctgtgtcagtatttgagccaaactggcaacttacgagattagagttaaatcagtggtcctgagcagtgattccaaactctcactgtgccttcacaccatccatgtgtaatccaccccatcagcagtggttctcctactttctcagtgggggcatatcctcaagggagaatgttgtgactctggtgagagaggagttggcctagagcaggccactgtgagctcagcacagagtaggaagaacagtgacatcattacaaaatcatcaatagcagcaatagctggtgtttattgagctgttgctctttggcaagctctgtgctaagaactttgtatacatcatctcatttaatcttcacaacggccccaggagataagtactaactttctccccatttcctagaggcttgggaaattaagtaactcgcactggtcacacatctgtaagtgggagaggcaggattcaacagatctgtctgtcttgagtctatcgtgctcttattgctatactgaattcccattcatgttaggtaacttaggggccagaatctccatgcactttgtagaccacatttcctgttatgaaatttccacattttgaattttttaaacaaatatggaaactgagaatccctaaggattaaaggacttgggatatccagaattggtgaagtgatttgagcaaggatgagctattatcaaaatacttgatgtgagtttccatcttcgcaataatatgggtgagagatataggtgggttgagattgggaaaaatatgcggcctaagtaatttttcttccaataagatactgctttggctaaggaaatgggatgtaagagttctctttttctcaggggacagtcctacttcttgccatgcttggctgatcataggttaaccctaacagaagcctggggtccctacatttttgtctgtctggcttttccttttggcaagcagaagctttgttcttggtccccatgccaagactgaggtgggaggtgctggtgtatatggtcat

SEQ ID NO: 470 - DNA, 1034 bp, Homo sapiens
ttgtctacctgacttcctttggaagaagcactctttcagggggcttcagtgttccaggcttgctgtctacccaagagcttgctgggcacccaggcgccctccagtaggtctgtgctgctcagataaactgacatctggttttacacaccctgagctttgctagcgtgattctgctcttgggaagtagattcactctgcagaatgggtggacagtttctcagccttcctggccacaggtcagaccctggttatggaaaaccaaaccagcaaatgctgccctgggagggtgttacatcatgtgagctgctaaaggcaggatcgtctccccagatggctgcctccccttgatttcttcaccctccacctcaagaagggcattggctcctctgaagggacaaaaaggtacctaaaggaccttaggcctcccattcctcagacccccagaggcagcagacccaaaggtaggggcagggaaaggaggggccaagactttttcagatactcggttttttctaaggccttgacctcagcagctgaactcatggtcatggctgccttggccttattgtccactgtagcctcctcccagaagccgagtaaagcagctagggtccctccatgctaaataatgtagtcaggcgctctgggtagtccgtcctgcctcatcttgttctggggcccccagtggggatagctctctgctttcgggctgcagaaaagaattgagtcactttctgtaggggagtaacaccctttggggacaggggtgcagttttgaagtaatgaaggcagtgatgtctggagtgggtgtgggtgttgcaggtgaacttgcctcacccaggctgttctgggtctttgtactccagagttctgtcctaggcttgcttcttcattcactctgtttccctttctcttctttttttcttttcctttctttctctcttttcttctgtgtagatgctaatgacttccagatctgtgtcctgctgtggcctctcctcttaggatcccagctgcctgccaaccagctgtgc

SEQ ID NO: 471 - DNA, 1047 bp, Homo sapiens
acctttgtggccgggtacagtggctcatgcctataatagcagcactttgggaggctgaggcgggcggaactcttgaggccaggggtttgagaccagcctggccaacatgaggaaaccctgtctctactaaaaatacaaaaattagctgggcatggtgggcacctgtaatcctagctactagggaggctgaggcaggggaatcacttgaaccccagaggcaggggttgcagtgagccaagatcgcaccactgcactgcagcctgggtggcagagcaagactctgcctcaggaaaaaaaaaaaaaattagccgggtatggtggtgtgcacttatagtcccagctgctcgggaggctgaagcaggagaatcacgtgaaccaggaagcgaaggttgcaatgagctgaggtcatgccactgcactccagcctgggtgacagagcaagactccatccaaaaaacaaacaaacaacaacaacaaaaaaaccctttgtgcttagtgcttattgtattctcttaagaaatattttcctaccaaatgaagaaaatttctagaagtgttattagtctttcacatttagttttataatccatctgtggttgggttatgtgtatagtgtaaggtaagtcagatttcaacctttccatgtgaattttgcatggattaagcactattttttaaaaagactgtccttttccccactgttctgcattgacacctttgtcatgtatcagttgtctatatatgtgtgggtttatttcaggactatgaaggctgttccttttgtttctccttgtggaaataccatactgtcttaatttctgtaatagctttataataaatcttagtatatgatagaaaaagtcctccctcctattatgtccttcaagattatcttggctttccttggtcctttgcatcttcatgtaaatttttgaatcagcttgtcagttgtgacaaaactttccttacaaattttagaatccattgggattttgtttagtattatactgaagtggtatgcctgttttggagaattggtatttgtta

SEQ ID NO: 472 - DNA, 1030 bp, Homo sapiens
aaccccgtctctactaaaagtacaaaaattagctgggcttggtggcaggcgcctgtaatctcagctactcaggaggctgaggcaggagaatcgcttgaaccgggaggcagaggttgcatttagtcgagatcgtgccactgcactccagagcgagaccccgtctcaaaaaaaaaaatgaaatgtttgctgaaccccaaaagcacagtttgaacgctgctgatttacaagattaattttaaggtatttggtatcagggaccttcctgacatgacccatgtctacttttcaaactttccagttccttctactagcactcttgcacttgtactttatctgcaacaacagtcccactccttctagttcccatatatttgtgcttctttttttttttttttttttggagactgggtctcgctctttggcccaggctgagtgcagtgacacgatcacggctcacaagcagcctcagccttccgagcttaagcgatcctcccacctcaggttccagagtagctggaacaacaggtgctccccactacgcccagctaatttttgtattttttgtagagacaggttatcttcatgttgcctaggctggtctcgaactcctgaatcgaagcaatccacctgcttgggcctctcaaagtgctgggattacaggcttgagccactgtgcccggctatttgtggttttgtacatgctgtctctataccaggaatatccgccatcattggttggtagacactttaaaacccagctcaaatttcacctcccagaagactgaccgtcttcttttttcatttcttctcagtaccttgtatatacttactggttgggacatcctactcatcagtgtaacccggtaccaaggcacttcggaaatgatggctcttcattgcctgcagaattaaccatggacattttagtttggtttgaaaaacatatagccttctgcctccagccttcccatcaggctagtaaaagaccttgcagaactcagttgaataaaataattttttttttttgaga

SEQ ID NO: 473 - DNA, 1047 bp, Homo sapiens
ttcaccatcttggccaggctgattttgaactcctgaccctgtgatccacccacctcagcctcccaaagtgctgggattacaggcatgagccaccgcacccagccttttttttttttttttttttttttttgagatggagtcttgctctgtcgtacccaggctggagtgcagtggcacgatctccactcacagcagcctccatctcccaggtcaagagattctcctgtctcagcctcccaagagctggaactacaggtgtgtgccaccacacctgactaattttttgaattttgagtagagatggggttttaccatgttggccaggctagtctcgaactcctgacttcaggtaatctgcctgcctcaggctcccaaagtgctgggattacagaggtgagccactgtgcccgcccaaaaattcattttttaacagtagtttgaaccatcagggttatataaatactattgtactaattttccaggaggaatctggatgatatcccctggaggtctatatgtgtatctggaaataactcttgaaacttgcattttcttttttttttttgagatggagtttcgctcttcttgcccaggctggagtgcaatggcgcagtctcagttcactgcaacctctgcctcctgggtgcaagtgattctcttgcctcagcctcccaaataactgggattacaggcatgccccaccacgctcggctaattttttgtatttttagtagagacagggtttctccatgttggtcaggctggtctcgaactcccaacctcaggtgatcagcccgcgttggcctcccaaagttctgggattacaggcgtgagccaccacgcctggcctcgaaacttgcagtttctttgtgatctcgtgttttactttaagaatgaatatgggccgagggcagtggctcatgcctgtaatcccagcactttgggaggctgaggccggtggatcatgaggtcagtagttcaagaccagcctggccaagatggtgaaacccgatctctactaaaaatacaaaacttagccaggcatgc

SEQ ID NO: 474 - DNA, 1069 bp, Homo sapiens
ttcctcactctcctcttacaaccgcccaccccccaaattaattcttctgtggtctgtgattttacagtgtcgtgttcataactcccaaaacattgatcacaaaatactaatgtttttaaatatttttagtagagacggggttggccaggctagtctcgaactcctgacctcaagtgatctgcccaccttggcctcccaagattaaaggtgtgagccaccgcgcctgctattaggtgtattgatattttctatagtggctgttctcaaactttctggtctcaggacttcttgtacccttaaaaattattgaacacccaaagagctttagttatgtagattatgaatattaactgtatcaaaaattaaatgacattttaaatgaaaaatacccatatttttaaaaattgataagtattgttttatcagttttgcaaatcactttacatctagctggatttttgtatctgtttctgccttcactttattgcaaagtgttgttttggttgaagtctgaagaaaacctggcctcataaataggtgattggaaaaggggggagtgttttagtagccttttagatcgttgtgggtgttctttgatactacaaccaaaaatcaagtggtagtttcttaaaggctagttgcaatgtgggatcaaactttttgtaccatgtggatcagtgaactttttgcactctgttatgttagaattcgttaatctatcttgtactttgaatggatcttttacccgtgaatgatttttgtaatatgctattgtagtttggaaaatactggttcactgagttctgcagatcttctagatgttctcattttattatgcagtattttaaaaatcaccactaatctcagaaaagtttttaagttttgggtatcgatcaagttgaagttggaagatacaagttttccaaaattctaattatcacttgaaagacaaaattttattgttggcgataaatactgtcgttttacttgaagtgacagtctcatttttttcattttcaagaaaatatctgcagatacccacttctggataatagtttgtctttattta

SEQ ID NO: 475 - DNA, 1527 bp, Homo sapiens
ctttgttcaacactatttgtatgtctggggaaatgttggcaaattttcgaaacatttataggctaagtcaaaacaaaacatgcaagaaacatatatcacaatcatgttggacagtccatgatcgtacattactatctgtgattgacagtcttccagagattattgaaacattggaagttatagcaagccattcttcaaatacaagtttcgccgatgaattgagtcatttgctgacattggtttccaaatttgaatttgtcttttgtttgaaattcctgtatcgagtgctgagtgttacaggaattctttccaaagagcttcaaaataaaaccatagacattttttctttgtcttcaaaaatagaagcaattttggaatgtttatcatctgaaagaaatgacgtatactttaaaacaatctgggatggaacagaggaaatatgtcaaaaaataacctgtaaaggttttaaagttgaaaaaccttctcttcagaaaagaagaaaaattcagaaatcagtagatcttggcaattcagataatatgttttttcctacttcaacagaagaacaatataaaattaatatctattaccaaggattagatactatattacaaaatttaaagttatgtttttcggagtttgattattgcaaaataaagcaaatttcagaactgttatttaaatggaatgaaccattaaatgaaacaacagcaaaacatgttcaggaattttataaacttgatgaggacattatcccagaacttagattttatcgacattatgcaaagcttaactttgtcatagatgatagttgcataaacttcgtcagtctcggctgtttgtttattcagcatggtcttcacagtaatattccttgtctctcaaagctattatatattgctttgtcttggccaattacttcagcaagtactgagaactcattttctaccctgcctcgtcttaagacatatttatgtaataccatgggacaagagaagcttactggcccagccctaatggctgttgagcaggagttggtaaataaactaatggagcctgaaagactcaatgaaattgtggaaaagtttatcagtcagatgaaagaaatataatacatgctcatttgaacttacctaaaagacttgtatttccattgggatgttttcatttcaaaattgttcaaaattcaaaagacacagaacgataaacagtgaagtctccttccctcctttagaactcattttctcttcccaaaaagtgttatcttttccttaaatatccctctagaggtatttttcctaagtggtattgtacggtgtatactgttcttcagcttgtcttctctgtgtaacatatttttgagattgtcccatgtcgttacatgaagagtttcttgattcttggtctataattgcagatgttattgtatgaatgtaccataatatatttgagcagtccctgctgacatttttttcctaaccttttgctattataaataatgattcattttataaccttttatatagg

SEQ ID NO: 476 - DNA, 1033 bp, Homo sapiens
ttctatgtgacttcccccacccatctgagttccagcttcctctgggctccaatctccagtccctggcggagtgactagggggctctggcccaggatccccaaccctggaaggcagctctaacgcaggaagagaattgggcgtcgggtgcgcacctggcagctcaggagtcggggctccactcaccccacacaagaagatgaaaatgcccaaagagctcaatgtattgattggtttggctggggacagccagagaaagaagcccaagcagtcaccgcctgcttcgccctgagcctcctgacttagactctgagtccagctccaaggaggaagaggaattcggtgtggttggaaatcgctctcgctttgccaagggaggctattgacgatgctgcaagatctgctatccgctctgtggttttgtcaccctctctgcctgtgttgtggcctgtgttggcttggtgtggatgcaggttgctctcaaggaggatctggatgccctcaaggaaaaatttcgaacaatggaatctaatcagaaaagctcattccaggaaatccccaaacttaatgaagaactattcagcaagcaaaaaaaacttgagaagattgaatctggagagatgagtttgaacaaagtctggataaacatcacggaaatgaataagcagtgcagggtcgggtcatgagtggccagagcctatcctggcagcgtagagtgcaaagcgggaaccaatcctggacaggaagccatcccatcgcagggcttactcatacacacgctcacactcagactgggaccatttacgcatgccaactaaccaaacatgcacagttttgtgatgtgggagtacctggagaaaacccacgccaacatggggagaacatgcaaacagacagtggcccggccaggagtcagatttttttctcctcaatgttataaccaaatgacgttgaacaaaacattattcaaggacctgctgtaaataggaaagtttacttctgtcctagggcttcatctatgaagctggaagagat

SEQ ID NO: 477 - DNA, 1012 bp, Homo sapiens
cagcactggggtgggatatctaggcccagggaggggaggtgtcagattcttaagtgcatctttagtgcatctttagtacatcagagtctggaagttaactggggagaggtcaggtgggggtggtggtggcgggaataagtcgtggaggggtctcaggagaaataaccggagggttcttcagtaacaccatcgcgaattcattttcctgcctcctttcccctccccccatagccgttatctagaccaaagtcggggtggtggtcttacctgtgaagaagtgggatcgttggcatgtcctgatttaggagaaagattttggctactatgaatgtcatgttctagcctagcctcttactcgcaattagggacttggaagaatacgacaagttttctcataacagggatgtacccaatcaacctgcagaggtgaagccaattctacataggagttgtttgaataccttttaaagtttgtctggaaactttccttatttaattctgagtggtttttttcagatggcgaacaatactgtactatcgattgagcaatatccctcacttttcttttacttcctccccgcttagcatgataagaagtaagtttccttttaggagtcttccttttgggaatggtttcagaaacgatcaattagcaaaagggcaaaaaattactactttatgaagaatgccctttcagcttagcgtaaaattagtaatctcgtaatgatgctacagctgatgttttgagtgcttactgtgtgcctggcactgagctaagacctttatgtgaagaatttaacttcatagtaactcctcctagaacctatttgcagatgaggaaatttaggtgttgagggcttaagtaatttacttagatcacacagctagttgcaaggttgaggtaggatttgaatccaggtttgtcccaactatagtgcctgtgtgggatgccacagaggagtttctttaatctgtgtttctctccttaaaagcttaaattgtaaatgaccaa

SEQ ID NO: 478 - DNA, 1029 bp, Homo sapiens
ttatttttggtgttcaatttgttgtatctttgatgattggcggtctcttaaattagtttcctaaggctgccaaaaaactgctacatacttggtagcttaaaacatcagaaattatctcacagttttggaggctagaagtccaaaatcaaggctctagggaagaatctttgcttgtctcttctatcttcttgtggcttggttggtattccttgacttgtggcggcaaaactcctgtctttgccttcatcttcccttggtcttctttctgcatcttcttttctgtctcttagggtctaccttattcctggatgttctcagctcaagatccttaccataattacctctccaaagatctagtctgctcacatactgtggttctgggtggacataacttttgggagccacagtttaatacactacagttctttttttgacccctaaaacttcatttacatcccatatgcaaaataaattcacctcatcccaacatcctcaaaagtctcgacctattacagcatgaactctgttttttttttttttttttagatggaatttcactctctcgcccaggctggagtgtagtggcagaatcttggctcactgcaacctctgcctcctgggttcaagccattttcctgcctcagtctcccaagtagctgggactacaggagcgtgccgccatgcctggctaattttttgtatttttagtggagacggggtttcactatgttaggatgggctccatctcctgacctcgtgatctgcccgcctcggcctcccaaagtgctgggattacaggcatgagccaccatgcccagctacagcatgaactcttaagtccaaaatctccaaatattataacctcaaaaagtttgaaatctcattgtcttaaatcatctaaattaggtaagagtatggactcggcatgattcatttgggataaaattctccatctgtggacctgtgaaactggaaaacaacttatctgcttccaaaatacaatgatgagaggatgagacagctgttaag

SEQ ID NO: 479 - DNA, 1251 bp, Homo sapiens
ttgtcagtctccttacatatcaagggggtccatatcattagacgagaggattcttcacagttccttactgataaccccatctccattcctcgtttctgttgagatgattgatgggatccatgagtcacactgctagtatcttcagcatatggttgtccagccacgtggcctgctctctagaacacacttttctaacagtgaatttcctaatttccgcatcctttgtattctgaataatctgagaacctcccagttaatcgttgtttccttttgcttaaagttccttcttcaatttatctctttcttcttgtattttactataaatatcaaggaggaaccaagctgtaccttcagcactttgcttggaaatctcctaggctaaatattcaagttcatggcttccagattctcctttctatcccacagtagaacatagttcagccactttataacatagctcacctttcttccagttcccagtcacatattctttatttacttctgagacagcaacagaagcatccttaaccaaaatattgatatgaaccaaaatgttcacaattctgtgtatgtattctctaagactacagaagctttctcttagttgctcatcacatccttctaaaccctaaccagaattgcctttgacatcagtatttctaccaccatgtctttaaggcagtctgtacttttctaaaatcatgcatctcaaaactctttcagcccattacccaatttcaaagccacctttacatttttttttctctctttctctttctttttgttactttcttttctttctttgtctctctctctctctttctttcttccttcctcccttcctcccttccccccttcccttcccttcccttcctttcttcccttcctttctcttcctttccctttctctttctttctctctttctttctctctttctctctctctctctctctccctctctctctcttctttctttgtttaaaagttttttaatagagatggtgttttaccatgttgcacaggctgatctcgaactcatgagctcaagcagtcctcacaccttggcctcccaaagtgttgggactacaggcataagccatcatgcctggcccaccttcacatttttagatattaaagcagcactccacttccatgtactaaaatctgaattagtttcctgggtttgccataagaaattaccacaaacttggtggtttaaaattaaagaaatttatcatctcacagttctg

SEQ ID NO: 480 - DNA, 1004 bp, Homo sapiens
tcagaccataacaacgacaaatgcgagagtttatttctagactttcagttctgttctatttgtctatatgcctgttcttgtgtcagtactacactgttttgattactgtagctttgtagtaggtttgaaattaggaagtaggagtcctcaagttttttttttcaagattgttttggctatttggggtgtgttgaaatttcacgtgaaatttaggatggttttttcctatttctgaaaaaagagttattaggattttgacagggatcaaaattgaatttgtaaatcaagggtagttactgtcatcttaacaatgttaagtcttccagtctgtgaacatggaatgtctttccatttattttggtcttcttttatttctttcagcaatgttttgtacaggtcttttagtgtacaagtcttgtgcttccttggttaaatttttctcaagtatcaatcagtataatctaccacattagtagaatgaagaaaaaaaagaactcactacagtctgtcctttgtatctatgagttccacatctgcagatcaaaaatatttggaaaaaaaaataaaaggtaatacaaatttattccttaatcaaggaccagaggaaaaaaaatacaacatttaaaaatagagtataacaactgtttgcatagtatttgcattgtattaggtgttataagtaatctagagatgatttaaattgtataggaggatgtgtgtaggttatatgcaaatactatatataagggacttgagcattcaaggattttggtatctttggggggtccagggtccagtcccccacagatactgaggaatgactaaatcatctcagttgatgcagagaaagtattaaagaaaagctaacatcctttcctttgtaaaagcactttaataaactaggaaaagaggggaatttcctcaacatgataaaggctacccatgaaaaatcattgcttacatcatattcagtggtgaaagactgagagattttatcctcagat

SEQ ID NO: 481 - DNA, 1088 bp, Homo sapiens
ttcacctttagccactggctgccactgtagtgttatctgtcgctatagttttgtgtttttgagaatgtcgtaagtgagaaggccaggcattgtggctcacgtctgtaatcccagcactttgggagactgaggcaggtggatcacctgaggtcaggagtttgaaaccagcctggacaacatggtgaaaccccgtctctactaaaaacacaaaaaaattagctaggcatggtggcatgcacctgtaatcccagctactcaagaggctgaggcatgagaatcgcttgaactcaggaggcggaggtttcagtgagccgatatcatgccattgcactccagcctcggcaacaagagcaaaactctgtctcaaaaaaaaaaaaaaaaaagtcataaatgaactactgtagtatataatgttttgggactggcttcatagaatcagtattttatcacttcagacctggcgtggtggctcattctgtaatcccagcactgagccatgagcgtaccactgtaccctagtctgggtgacagagggagactgtgtctcaaaaaaaaaagtcacttcaagtgagatctagacaatgaatttggagggctgttttactctcccttttatgttgtagtttccatatatgtatatattgaaaaccgtgtaatattttttacactccactgttaaacataggttaaagaagtgaaaaataaagcaatagtctatatatagaaatagttatatttattcagatatttattatttctgttgctcttcattctcaattttctacattttcttctgatattatttcacttttgtatgaagagcctttctttttctttttccttttttttcgagacgaggtctcactctgtcacccaggctggagtgcagtggtgatcctagctcactgcagcctcaaactttgggctcaagcgatcctcccatcttggcctcccaaagtgctggcattacagtcatgagccaccataccctgcctgtttttctttcttttggcatccatggtttctgatggaaagtctgtagttataagtaatgtgttgtttgtttctgactgttcaaagatttttgt

SEQ ID NO: 482 - DNA, 1158 bp, Homo sapiens
tttttgagatggagccttgctttgtcacccaggcttgagtgaagtggcgtgatctaggctcactgcaacctctgcctcacaggttcaagtgattctcctgtgtcagcctcctgagtcactgggactacaggcacacgtcaccactcctagctaattttttatatttttggtagagatggggttttaccatgttggccaggctgttctcgaactcctgacctcaagtgatccacctgccttggcctcccaaagtcctgggattacaggcgtgagccacagcgcccgggctttgtttctctcttcagtgctacagcaaaataacattgaatgaaatgttattagaggacctgctgtactataatttaactagcttcttttatacatgtgtaatttattttcaattttgcattattattaagaacattgaatatgtattcccatacacatctttgtatacttgttgaagcattctgtagaataaattccaagaatagaattgattaattatcaaaggatatttttgtgcttttttatgaaagacaaattttgtcaactagagttcttgaattaagggaatgtacttttttaaaaaaaatttacttctaccagtaggatctgtactttctttctctttgtaattagtttaatattttagaatgataatatttttagactaccgtctgactatgttatttgatattgagaggtaactatatctcctgatcttcagtggatttagttattgtgtgtcttttttgttttaggcaatcaaaaatagaatttagctagcttatccagaagaatcattttagatatatactaggatatttcataaaatataagataaaatgaatttcctgcagggtactcagcaaaaggagatcatgtctgttctctacaagtgctgccagaaagcagttatattcccacgatttttaatctttctgtatatccattctaaatttcaagttgtttggagaaagattatgattgggccagcttgaatctcatgttcatctttgaaccaattatctgtggtcagggaaaccaggccagatagtaaaacatacctcttggaaggcatgcctctgtcactactcactttcgccaaataatgtttgaatacctattttggatgatatgcctttgctcaagtgt

SEQ ID NO: 483 - DNA, 2999 bp, Homo sapiens
attttcaaatgaataaactgaactaaactgatttttgttttatctctgtattggtaaaaggtttatgtttttgccagtaacttacagcaatttcagcattgttatcaataaaattgtggtgtcagtcaggcgcagtggctcacgcctgtaatcccagcactttgggaggccgaggtgggtggattgcttgaggtcaggagttcgagaccatcctagccaacatggtgaaaccctgttgctactaaaaatacaaaaaattcactgggtgtggtggcgggcacctgtaatcccagctatctgggaggctgaggcaggagaatcacttgaaccctggaagtggaggttgcagtgagccaagatcgtgccaccatactctggcatcctgagaaacagaaaaagactccatctcaaaaatacataaataaataaataaataaataaataaataaataaataaaattgtggtatcaaggaaactctgacactaaaaaggagatataagttctatgtgaattttagtttaggttgatcagtaggataagagggtggtaaaagtatgttgtaaatgtttgaatataagatgattccaaatacagggttctgacccatttcccagtgaaaagataagagaaaaaaatagaattttgttatctagaatacatttactaatagccatgtgggtgaaatagatgtctattaatcatttattaaattatatacatatttaaaatctccttatgttaaatagtattgatttagaaaatactggttttcttatagttgttttgtgaattttatgcagactctagaaatttgacattgttaatcactagtgtcactttttaagtcagttaatgtagttttccagagccttctaaattatgtaagttatattctgaatttgcattctgattactggtatgtgctacttaacaaatcaccccataactaatggtgtaaaacacttttattaagctcaaggattcaatggctccggtgttcagaaagggtatactggggatgttttttttttttttttttctctccacaatgtctttggtcttgactgagaagatttggaggctgaagttgactgaatggcttgatgttggaataatctgaaagtttgttcactcatgtttggtgccttgcctaacaggactcaaagactgtgactgctgacttgagcacctgtacgtagtctgttaccttgccttcctcatagtgtggcagccttaaggtcttctcacttcttttatggtggctcagggatccaagcaaaatactaattcagtgaataaggcataagttatattattattattatttttctccagacaggctctcatcctgtcacccaggctgtagtgtagtgactatcataattcactctgacctcgaactcctgggctcaagtgatcctcctgcctcaacctcccaggtagctagaactataggcctgcacctctgcacttgcctgatttgtatattttttttgtagaaatgggtcttggctatgttgcccatgctggtgcatcatcttttctgacctagcttcaaaagttatttggcatcccttccaccaggcagttcacaagcttgcccagattcagaagctatagaccccacatcttaataggaggagggagggtgaaggtcacgttatagaaaagcacatggatggaagatactgttgcagccatttttgtaaaataaaatctgctgtcacagcatataaaataccctgttaaaaaatattctaagccataaaatagctttaaaaattttatcctagaggtttgtgtttggatcttcatggcattaactatttccagtaatacatatatgtaaattgcatgaatctgatcatacatgatttttttttttttttttttgagacagagtcttgctctgttgcccaggttggagtgcagtggtgcaatctaagctcactgtagcttccgcctcctgggctcaagcaattcctgttcctcagcctcccaggtagctgggactacaggtgcgccaccacacccggctaattttttgtatttttaatagagacggggtttcaccatgttggccaaggtggtctcaagctcccggtctcaagttgatctgcctatctcggcctcccaaaggtctgggattacaagtgtcagctactgcgcctggcccatatatgattttttaagagtaacattttggcttttctgttggcttggcctcaccttcccatatcattgttcctatcccctctcataacttgtgtcaacagctttgtaggtagccttccatgtttttcagtgctcataacatcattatatacataaacatacacaaatatatgtatgtcaggattttgagtttttcttatttaacaaaaatgggatcatatacatacttttctcctcctcacttctctctgtcttgagtacttcataaaaccccttcacctcaactggaatagctctctattctgtgattttaatgcacaataagtcatcttctgctttgtttttaggcatttatgtcgtttaaggttttttctgccacaatgaacaatgatacattaaaagtcctttaatgtatgtttttgtaagttggtcattttatatatgtggttagattccaaagagtaaggattctgtgacttaaaaaaaaaaaaaagcatgctgtaatcccaccacttcgggagactgaggtgggcggatcgcttgagcccaggagttcgagaccagcctgggcaacatggcgaaactccatctctacagaaaatacagaaaaaattagttgggcttgggggcacatgcctgtagtcccagctacttgagaggctgaggtgggaaaattgcttgagcccgggagttcgaggctatagtgaactatgattatgccactgcacgccagcctgggtgacagaaagagaccttctttctaaaaaataaaaaagcactttaatacctcacatttccaccagcagtgtagtaagaacacct

SEQ ID NO: 484 - DNA, 1044 bp, Homo sapiens
ggggtgtcttggaactagtgccccatggatatggagggatgactgtatattatttcctaaaatctttattgattttgcctttcacgtgtagcttttgaattaccctacactaattttttatatggtgtggagtagggaactaattttatttactattataaggctaataaattaccttactcaccagcatctatcaaatactacctcctttctccagtaagctgcaaagtttctctataactacatctgtaggcatttccccacattctcagttaatgttttcttggactgtttgtttgtttattcctgtgacagtaccaaggtgttctaatgaatgagctgtgtaataattcttaataatctgatgggacacatccctgaaaatttttcttcaggaatgttttgcctattcttgcccctgtttacattagaaatatcttgggaagtttctgacagaacaaaatcaaataacaaaaattttttgggaattttatttaattatcatgaatgtgtagatcaactgagagagaagtggcattgtgtctttctatccatgaacttggtatgtctttgtatttatttaaatcttcaatgtctttgaatacaattttataatttactctgtaaagtagcagtccccaacctgttttggcaccagggaccagttttgtggaagatagcttttccatggacccaggcgtcagagggagaggcaggatggttttgggatgattcaagcacattacatttattgtgcactttatttctgttattattagattgtgatatataatgaaaataattatacagcacattataatgtagaatcagtgggaaccctggtcttgttttcctgcaactagatggtcctatctgggagtgatgggagataagtgacagatcatcagacattagattctcataatgggcaggcaacctagatccctcacatgcatagttcacaatagggtttgcgctcctatgagaatttaatgctgctctcctatgagaatttaatgctgctgctgatctgacaggaggcac

SEQ ID NO: 485 - DNA, 1107 bp, Homo sapiens
gcctattgtgccaccataatctttttatcactgaactgaattagcaccactgagatatatttaaagttctatgtatattgggatctattttggaatttctattacattctattaatatatttatttttatattgatgccatattgatttttattatttgtatatttatttgaaggagtatttttaaattactgtgtatttattggctttgtggtatagacatttatctgctgggtcaagccactgtctcagttttattttttgtaatttttgctttccattaagccactaaattttaacatgattttatatactttccaaaaatattttgttggacttctaattgaaaatgatacatgtacatatattacttttgggcagaatcaatatttttattatgtatttgttcttacatacaataagaacaataagcccaaatcttagcatacagatcttattttatgccattcactaacattttattttcaagtaatatttattgtgctttttcttgtatcagttgttctttagtactttgacaaatgtaaaaatttttattttttatattgaaaaacttttttcatttctagattcttattgcaagaatagtcagggtgttacttaattcccttattaaatctagtaggcttttaaaataaatttgaatctgtagttatgcattataaagccatatcatctaaaactattttatttcttttttccagcttcttcacattatataattttagtgttttgctaaaatttgtaggacttcattaaatattaaagtagtagtgacttttgactaattcttgattctaagtaaagtagttaatttgtagtattttgtcattgggggctgattgtagttggtttctgtcaaataggcttaggctttattacattaaaaaatatatgttcccattctaccttgaggaatggctgaataatattcatatttatatattgctagattcagtttgctaatattttcctgacagagtttgtgttaagattggagttatagcttcattaaatttttatacaattaatcactgaaatcatctggacctagatatttcttggtgtgatggtttaaaattctgaa

SEQ ID NO: 486 - DNA, 1804 bp, Homo sapiens
tgggaggctgaggtgggaggatcgcttgagtccaggagttcaagaccagactgggcaacagagcaagaccttgtctctactaataatttaaaaattagcgcgcacgcgcgcgcgcacacacacacacacacacacacacacacacacacacacagccaaagtccaaaaaacaaaaaccagactgggcaacagagcaagaccttgtctctactaataatttaaaaattagcgcacacacacacacacacacacacacacacacacacacagccaaagtcctaaaaacaaaaacctctattaagggcctctgaatagttatctctgttccttcagttcctctgaagaattattttatactaggattctcaggttatctcctctcaatctctattgggatcactccactctgacttgtacactcattttcccactgatgtagctgttctcaagttagaagttaagttctcagtcttcattttatcagtcatctcagcagcattcattatggttcaggcactccctcctattttcttcgttagcttctatgacaccagtctcctcatttttctcctactctattagctgttccttcttagtgtctttttctgactccttcattttgaccagatttctaaatactgaagtatgtcaggactctcagctgtcttccatctgtagtaaataaactcactgggtgatcttacctagtttcatgaattttaagtaccatctcttcattgatgagtcccaaatttatgtctcatttcttggccagtcttctcttaactacaggctaatatatccaactgtcttcttgatatttccatttgaagatttaagaaggatttcaaaatctaccatcccaaaaccaaattattcattctccctctttcagtgtggtcctcccttagtgttcctatctcaggaaatgacaccctgttgtgttattcttgactcctttcataccccgcatctcatatacgtatcaggcaatgcctctaccttcaaaatatatccacatctgactactgttcttcacatccaccattattattaccttgggtttaactaccagtttttccttgggttattgtagcttcctaagtggtcctaagtgatcttcctgcttccattcttcttctgctccgtataacattgaacacttcatagtacacagaagctatatgtagaatgtatgatccttgtaaaacataaattatgttaatttgtctgtagagtcttctaacgacttccttttacacttacatacattgcagttttttcctgttgcttgcaatttcctaatagatccattctgtttatttctcttttctcattttttaatcactcttcctctcatacatgcaattccagccataccatccttgcttttcctcacatacgccaagcatactcacagtgtctaaaagccagaaatcttccatgagaaatttgtgctttcaggtgtttcagctgctgagatcgtagtgttctgttttgttctcttgatataagctctgagaaacagaaactgtttcttttatttggttatatggatcacaaggatgagaagaattctgattcagttaagtaatgtaactagtacttacattttaattgcataagattttatgcagcctacagatttattgtgtaagtaccaaaattgctaattcacatcagttgctttgttagaaattgacatctctgaggccaggtgcagtggctcatgcagtcccagaactttgggaggccaagacaggaagagtgcttgagcccaggagtttgagaccagcctgggcaa

SEQ ID NO: 487 - DNA, 1086 bp, Homo sapiens
agctcaggagttcaagaccaaactgggtctctacaaaaaatacaaagattagccagatgtggcggcatgcgcctgttatctcagccacttgagaggctgaggtaggaggattgcttgagtcctggaggcggaggttgtaataagctgagatcatgccactgcacgccagcctgggtgacagagccagatcctgtctcaaaaaatgaaccaactaactaaataaataagtaaatgtagtgatatggaaagttgcttacaatattacttcttagtattgacttctcatgcactatagaactcattgttctgactacataaaacacctaatttttcatttatgaaaaattacagagcacatgctatgtggtcagctactaatgatgaaacgttgagatggctcacctgtaagttcttcagcatacatctcctaagattttagcatctgttttactatctgttgtctcaattgattattttagaaagtatagacaatttttccaattatattattgcctctacgtttattagcaaacgttcttatgatagaaacaagcttttatctccttccctttgacattatggactcaaatcattatttaccctcatactgtttctaattttctgtttattttttctagctctgtgaggaggaagagtcatagctatctctttcatcattttatccctagaacctagtgcaatacctaccacagagtggtttcctaataaatatgtactgaatgaatgaatacttcaagcagtggggagctattgaagaatctcaagggaggatgtaatgtgaaatgatttatattttggaaaggtaattctgatgtcattatggaagagagcaacttgagcaaagctcagaaaaaaaaaagaaagaaacagggggttgccctgtcacatcacccaggctggagtgcagtggcacaattatagcttgctgcagcctcaaactcttgggttcaagtgatcctccttcctcagcctcctgagtagctaggactgcatgtgtgtaccactacacctggctgattaaaacaaaatttttttttgtagagatgggcttttgctatgttgccc

SEQ ID NO: 488 - DNA, 1862 bp, Homo sapiens
aatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcaggtaataattgttggacttagaaccataaaacacaattaaaaattaccgatcataatatatagcttttattacttttgatgttaagtgaagtatgaacggttaaattcattgtaagcttgtcatttttcttttgtccttgttctttgcagagtgactgaatttctcccagtaacttttggtaatggtataaatggttgaaaatagctctaaacctcatttctccctcccctggttgcaatgttttgatgagaaaggcaagatacttgaatcacctgttcattttctttggttgaacattggaacctgaagttggatttaacttctttgtgctgtaagcactaattcaaactgctgtctcaccacttagtccaaattagggagttattttatttttttaattttaatttaattttttgtttattaactctcacctctatctgaaagggagtttttttttaataaaaaaaacccaaacatttctaatttatgttttagaagtttcttgaggttcctcctgagcctctttgcccagtgtaccctatactttagctttagttaacattcttgaatatatcacatatttccttctatgccttcctttcctcctgctattccatttgcctgcatgtcattttctctctgtatatttgcttgtgaaagtacttcttatccaacaatgcctaactcataaacctcttctactctgtcatcattctaactgctctacatcaagaatggtttccttatctatatttccacagcattttcatgcctcattatttatagtacttatcacacagtattatagttctatatttgttttaccttacctactagtgtaggagttgagggccagattgtatcttactcatctttgtattcttggggcctaacctggtgtagtaaaatagtaattcttcaataaatgttcaatagctgtgaaggaaagcaagtattctataccagtccttgtatttcttctaacaatgctaggaaatgtatggtagaaagaacaaaccagtattgttaaaaagacagcttttgagtatgtacaagtctgtgcaaggatatactatatttttctctataattcagtatatatttccaatatcccttcttggggtatgagagtcatgtttctcaaggaacataatgtctagtagtagaatggacaagacaagtcaggccgtagaagtgccaatgtccagctgaatagcgtaagatttaatttacagttaaagacagtggtagaagagtttgtcataaggcagttcaaaaagatgtctttcaaataactgaaactgtgttttagggattcttagaagagagatgatttttaacttagtgaacagggaaggttttatagaggagaggtgaatttttaactgagctgagtctggaaaactgtataaagattaggatagacagaggggacttggaatagaataagtagaaatgggggagaacaaatgcaagcaattttcagagcaaaaataatttttttttttttttttttaggtttgagcaaggaaaaaatgtagggtaaggctaaaagctaggtggggccagattgtgcagaactttgagtgaaaataccttttgggtgtttttgggacccagttcactctaacgagcatctttgttggaaaagagaggtgattatcaaatgatagctttttaggtcactctttgtaagattt

SEQ ID NO: 489 - DNA, 1370 bp, Homo sapiens
cagaacaatcagaggttccagtggctggagaatataaataggatggaacagatagaaacacttaaatttttatatacttattcagaattataaaatgtgttatcaaatactgaatatgaatatgaagtttcatcatgattatgggaagaacttccccaaaggcttactccctgattgattggacttgagaattaagcagtaatgtgagtaggtcctgggcataagatccaaaagcattctttaccctgaccccacaataagggacttgtagtatgtgagtggatagagctaggttttccctgaggagtcctttttgttgtcagcaataccagtcctataggatcagacctttgataattcttctagaaatcccccagagcagctctcatgttataaactagatatgtgattctttccttcttttctttttcttgtcttttccacacccgtctccaccttccctccttcttttagaagagtattgcctttcaaaattgcataatttattacttttattcatttcccatggactggaaaagagaactctagtgtattatattattagtctcaaaaaagtactattagcctctcataaaatactgatagattttacagttgtggtcagtgtttacttttgaccatcagttaccagtaacttctttcatggttcaataaaatcatagctttagtttatggcaccttttcaaaacttcctttggcttttctttgtgcttaatttaggtagttttgcttttagctcacttcctaattctcttttttacacaattcattttggtcctaatttctttactttactatataaacaaggtgctgaaatgtgtgtgtatgtatttaacttcctctacccatttgctcttggttatttcttcagttatgatattctggatttgccagtcattgtccgtcctcctgcctctattactggcataatgtcattgggtctcacagtttcatttcttcattctaattctattgcatgtttctataatgttttctgtagtatttttacagttacagatgcttttacacgtactgtgttgcttaattcgcctaacaaccctgtataagatggccagagtagaggatgttaacatttataggtgagagagctgagagatatagagatttagttactcaagccctcatggccaggaaggagccaatctggggtcataatcaaagtcttttttttttttttttttttttttagtctaccaatctttctgtaaataaaagttgtttaattttaaaaataccaagggaaggtttcaaaatagatactttaaagagagccagagacctcattttcctcttttgccttttccatagggtctaaaaactgtacattc

SEQ ID NO: 490 - DNA, 1088 bp, Homo sapiens
gaatgcctagtatgtaactgaggcattgtagatggtcatttctgctaccttcctttcttccttatatataattcattcaacaaacattagatataatttctgttttgaggggctgcctgtctcctgagaaagataagacgtataaatgagtaaatagagatgctatgatggaagtattatgggtacagtgggccacagaggtagcatagtgagctctacttgatagggaaagatgagactatcagcagaagcttcacagaggtaactcttgatctgggtcttacaaatgaggtttgcttttacagtcctcattagggaggagagggaaatggggttagagatttagaagacattccagaattcaggcatatattcactttactgtgtatttattttaatatcaagttttacaaattgattctttaagaaggaagattgctcttaaaatctcctaattggtgctggacgtactttaaaaattatcctgaatgtgtgacatgttaataatacttagcattatttgctgctgaatccctaattgggtgaagacttaagataacggactctggttgtttgtatttggacacctgtgatgatatcccaggtttgctcttactttacgcttatggagtattttttttattattagtggtagaatatttgccaataagttgcctaataaggttactaatttccttaaattcatatttacaagcacctttggagggggttatttcaatttataggatgatatagtataaaagcatgaacttgctgttatttaatgtttttaaaactgtggttatgacctattaatagaccctgaaattaattactaggttataaccagcattattatttttttctttttcttttttttttttttttttgaggtggaatcttctcattctgtcgccaggctggagtgcagtggcacgatctcagctcgctgcaagctctgcctcctggttcacgccattctcctgcctcagcctcctgaatagctgggactacaggcgcctgccactatgcctggctaattttttttgtatttttgtagaggcagggtttcaccatgttgaccttgc

SEQ ID NO: 491 - DNA, 1094 bp, Homo sapiens
agactattcattccccattgaattacattggcaactctgttaaaagtcaatcatatatgtatctatcagtctgtttctgaaactttctattctgttctattgacttatatgtctatttttataccagtaccaactgtcctgattactgtgattttacagtgagcctggaaattaagagtgtaaatcttccagctttgttcttcttaaacttgtcatttgcatgtctatatacattttggaatcaacttgtcaatttctttaaaaaaaaaaaaaaaaaaaaggctgctagaatttcagttggggctgtcctgaatccagagggagagaattgacattttaggaatgttgagtcttctaatttggaaacatggaatagtctgcattacaagtctcattatattctgttaagtttatttcataagtatttaagatattttgatgctgttgtaaattgtattatttttaaatttcatttttcactgagcacaatgactcacacctataatcctagtactttgggaggctaaggcagaaggattgtttgagcccaggagtttgagaccagcctgggcaatgtagtgagaccccatctctactaaaaattttaaaaattagctgggcatggtgacgcatgctggtggtcccagctacttggagggctgagctgggagaattgcttgagcctagggggggtcgaggctgcagtaagccctgatcatgccactgcactctagtctgggcgacagagcgagaccctgtctcaaaaaaaaagaaaaacaatttcatttttcgtgttccttactagtatatagaaatatagataattttttcttctatgatatttatcttagaaataaaaaaaagaaatataggtaattttcatgtatttactttgtgtcctgtgactttgctcaactaaaatccttaggattttctacctagacaatcatattatctgtgaataaagacagttttactttgtaatctgaatgcattttctttccttctttttcttgttttattgaactagctagtatcttcagtacaatgttgaatattagtagtgagagcagacctttttgccttattcctaa

SEQ ID NO: 492 - DNA, 1079 bp, Homo sapiens
gttctgtattcaaataaatatcagctgaagaaagttaaacagctggtcgggtgtagtggcttatacttgtaatcccagcactttgggaggccgaggcgggcggatcaccagaggttgggagtttgagaccagcctgaccaacatggagaaaccccgtctctactaaaaatacaaaattatctgggcatggtggtgcacggctgactcccagctactcaggaggctgagataggagaatcacttgaacccggcggaggttgcagtgagccgagattgtgccattgcaccccagcctgggcaataaaagcgaaattccatctcaaaaaaaaaaaaaaagaaagaaaagaaaaagttgaatagctttcttttttgcaaatatgctcagagcctttaatgtaccattaagcactgtgaattcttcagagacaaatatagtatcttgtgttttctgaatatcaaatcttagaaacccagtgttctccagctctcacataagactagtattttgtggactctactttgggaagcctttttgtgtatcctcagattggaattctttacctatctacctgtttaactcttcctcaccttttaaggtctagctccagtatcacgtttcccagaatctaacctgactcttccctgttggatagccctcatttgctttcacagaatgccatttaaagaaagcctctatcatagcacgtattgcaccatatgcactggtctttatttccctaactgaagtagacttgagatcagaatctgtctttaatccatatacccactagtctgcaccgcagtgcctggagcacagtagtgttcaatgtttattcagttaatcaatgctactatgtttgttaaaagttaatgtttcagatgttttctacctttccacagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacaggtatcaagttaaacatatggattcttc

SEQ ID NO: 493 - DNA, 1050 bp, Homo sapiens
tttaccattttaaagtttgcaattcagtaggactaataagtacattcttaatgtgcagtcatcaccactgtctattctgtagctttatgactccaaagggaaacctcaaacccagttagtagtcactccccattactccctccacccatccctggcaaccataaatctgctttctgtctctctggacttgcctattctggatattttgtatcagtggattcacacactatgtggccttttgtgtctggtttctttcccttagcattatgttttcaaggtttatccatgttttagcatgaatcaatatagcattcctttttatggctgaataatattctatcatatggatataccacatgttgtttatccattcatccactgatggacatttgaggttctgccttttggtgattgtgaatacgctgctgtgaacattcatgtacaggtttttgtttgaacacctattttcaattcttttgccatatatgcttaggagtggaattgctgagtcttgtaactatgactgagttgttgaggaactactgaactgttttccaaagtggcagcaccattttacatttccaacagcagtgtatgaagattccagtatctccacattcttgctaacatttgttaatttctgtcttttttttttttaaacaaccatcctggtgggtatgaaatgatatctcattgtgtttttaatttgcattttcctaatgacattgggaatctttttgtgtactttttgaccatgtgtataccttctttggagaaatgtctatttaagtcctgtcttagtctgtattgccataggggagtacctgaggctgggtaatttataaagaaattcttggctgggtgcggtggctcacacctgtaatcccagcactttgggaggccgaggcaggcagatcacgaggtcaggagttcgagaccagcctggccaacatggtgaaaccctgtctctactaagaatacaaaaattagctgggcgtggtggcacatgcctgtagtcccagctactcggaaggctaaggcaggagaatc

SEQ ID NO: 494 - DNA, 1015 bp, Homo sapiens
tgactggcagtcccatgtccagcaagagcagacatctccctgatgccctacctcccctcccactttatcacctgcatctttggggattttttttttttttttttttttgagacggagtttcgctctgttgcccaggctggagtgcagtggcgcgatctcgactcactgcaagctccgcctcccgggttcacgccattctcctgcctcagcctcccatgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccatctttggggattcttacaggatttgtggggagttttcagtttggtttgatttgtggtagtggtgcctcagttgatgatgttgtttttctagggttgatttttggggaagggaacctgtagcatacgctagttcactgtcttaataggatccaaagccccagtgtatcttgtctttttattttcagtctatgtgatgctttagttgtctgtcctgtaaatagagatttacaattaaacccagtctgttaagttctgtttggtggtagtggttttgtcgttaacatccaatctgaaaactaatgcctattaagtggtcacatttttcatgctgattttttttccctcccttcctgctgatgggttggttgaaatcttttaatttttttctttccttgtctggtttagatgttctacattctagttctgaattttcagtggctttctcaatgtttttaagatgaatgcctgactttctcaaatgagtatttctaccatcgtcctatggaaagactaggttacagtcatcaccccatccccatcttatatgttacagttcagtattttcattccatctctttattctctccccaagtagcactccctgggaacttcctaggccaggttcc

SEQ ID NO: 495 - DNA, 1049 bp, Homo sapiens
tgttaacaaaagatatgggaagaagggacatcaaccctcctcccttaaagccagcaggggtactggggtggtgcactcccacccaccagtggcaggcagggcccagcaccactgcttgcatgtgctgatgccaggcccaaaacttccttgccagaggacacgacctcacagggctgcccagggggtgggagctgtgcacgggtccgagacgtagcgtgaagcagcacacccagcagacagagtgcacagttaaataccatgtttaatcatcccacaatggacagtagtgcagtagtagaaattataagtgtctctttaaaaagtcactcccccaaagtttccattccccaatacccagataaccatggtggaacagggccagggtgagggggactcaggaagtcttggttccaaggagatgaaagtctttccaagtcaaatttgccttgtgagcagccaagagcccaatgagttgatgcatacgcgctcactctaacacgcacacatgcaagggacacagaacacatacagatggagggacagagaggggaccacagcggggccatcgcacacatgcgctctcatgccacaacattccagtccatctggggctatctcctctggggacagggagcggtggcctaagccccgaagcagcaggtgccggtcagatggagaggagggaggccgtctgtccagcctggctgctctgacaagggccctggcagcgagagaggccacccgccatccctgacacagtcaatcctccctaatctcgggccggatgggagaagggagtggggctccagtgttaagggggggccagatatcatttctttttttttttttttttttttgacggagtcttgctctgtcactcaggctggagtgcagtggcacgatcttggctcactgcagcctccacctcccaggtttaagcaattctcctgcctcagcctcccgagtagctgggattacaggcatacgccaccaaacccggctaatttttttttttatttttagtagagatggggtttcaccgtgttagc

SEQ ID NO: 496 - DNA, 1052 bp, Homo sapiens
ccctctatgcacaccttctccctagctctgcctcactctggctgtttgcagggggagggacgtcccctccagcccctggcagccctccgtgtctccctctttggctgtgggtgtctgcttgggtccctctgtccctgcctgttccctgtgccccatctgtcaggttggaggagctgagcagatgcctgggaacagggcgtaacatgcccgtaccttccactgcctctgtgttccttttgaggggttcccagcagggtaccccgtcatgggaaggggtgcacatccctgtacaccaggagcccactctgcactctcagtcccaggctgcatctctgcagcccccaatttcatggtcccagttctggctcaccctcaaataccaccaggttaggttgacagcttcctggagagcacctgcagtgtgagggtcaccccttgaacagccagtaagcaaagcagggtcacttgcttatgttcctctctggcgccctcttctggcccaaggatcaaatggtgcaactcccttaacctgtgtctgagctctgtgtccagaaccctgaggggttctctctcccatctgaccctgtgactcacccccacctccagtgccggtagaggtcttggtggttgagtgtaccaagatgatcacatttaattctcacaacaaatttctaagatgagcactattggcccattttacaagtaaagaaacagacccagaaaagttaattacccaaggtcacacagtgagcatctaaggcagggtttcaacgcaggcagtctgattccaggctgtgccctggctcctgcatgtgtctacacagaggactagggaagggtctgacacagcagctggcctgtccgattcatgccccactccttccgttaccttgcagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctct

SEQ ID NO: 497 - DNA, 1061 bp, Homo sapiens
agcctcccaagtagctgggattacaggtgagtgccaccatgctgggctaatttttgtatttttagtagagacagtttcaccatgttggccaagttgctcttaaactcctgacctcaggtgatctgcccgcttcagcctcccaaagtgctgggattccaggagtcagccaccacacctggcctatcattttcttttatgggccttgcttttggtgttgtatctaggaactctttgctcaacctgaggtcacgaagatttttctcctaagttttctgttgttgttgttgttgttatttgtatttttagtagagatggggttttcccatgttgtccaggctggtctcaaactcctgacctcaaatgatccacccgccttgccttccaaagtggtaggattacaggtgtaagccaggacgcctggccttccatgttttcttctagaaaaaacttgcaactttaacaaggcttcttggagagtctgttgcacacttgcctaggttcagaagtcagaccatatctaccacctgcggacagagtgccttgtctgacaggttgaataaccgggagctcttgtgtctgcaggagtgtgtgtgtgtgtgtgtgtgtgtgtgtgtgtgtgtgtgaatggcttctgcatatgtgaccagcaggacaccattagatcacttcagcttcaggagtcaccacagggaatcctgttctgtgtgtgtgggagacaaactttagtgtctctgctttgccctgtgtgctagtttaattcctacctccaccactgcccttctgtgaccgacctgcttccctaaccatggattccatccctcttgccattttcaagggaagaagctctgagaaaaaaagggacaggtgggggaagcagcaaggtcagtcactcatatacacaaacacatgagcaatgtcatctctgcccttatatctagcagcacctatgtttgcataaatctggcatcaacaggagaaagcacttgcaaatatccatatctaggctaccacattcctccatactccagctcatcctcattgctgtatttatcacaagggca

SEQ ID NO: 498 - DNA, 1048 bp, Homo sapiens
cagtaaggttgcagatgcaagtttaatataaaaaaatcagttgcataatatttctaaacactagcaatgaataatcctaaatgaaattgagaaaacaattccatttacaatagcatcaaaaataagaaaatacttaggaataaatttaaccatagaatttttttttttttttgagagatggagtctcactctgttggccaggctggagtgcagtggcgcgatctcagctcactgcaagctccgcctcccaggttcatgccattctcctgcctcagcctccccagtagctgggactacaggcaagtgccaccacaacctgctaattttttgtatttttagtagagacagggtttcaccgtgttagccaggatggtcccgatctcctgacctcgtgatctgcctgcctcggcctccgaaagtgctgagattataggcgtgagccactgtgcccggcggtttttttttaaacactgaaaattataaaacattgttgaaataagttaaagaatacataaataaatggaaagatatcctgtgttcatgaattgcaatacttaatattgttaagatggcaatactccccaaattgacttacagattcaatgtaattcatatcaaaattccaacaaaaaggctgggctcagtggctcatgcctgtaatcttagcactttgagaggtcgaggcgggtggatcatctgaggtcaggagttcaagaccagcctggccaacatggtgaaacaccgtctctactaaaaatacaaaaaattagctaggcatggtggcacgtgcctgtaatcccagctactcaggaggctgaggcatgagaatcacttgaacccgggagatggaggttgcagtgagctgagatcgtgagatggcgccactgcactccaggctgggccacagagtgagactgtcgcaaaaaaaaaaaaaagaaaagaaaagaaaaaccacacacacacatacacacacacacacacacacacacacacacacatacacacacacaagttccaactgcctttcttgcagaaatggacaagcata

SEQ ID NO: 499 - DNA, 1054 bp, Homo sapiens
cacacctggctaattttttatttttagtagagacgaggtttcaccatgttggtcaggcttgtctcaaactcctgacctcaagtgatctgcctgcctctgcccctcaaagtgctgggattataagcatgagccaccccgcctggcccaagaaagtttgatttttttttttaggatgagagaaattagagcatatttgtatgctgaagggaataatccagtaaaaaggaaaaatttcatgatttaggagagaagacaattcttggaatgatatccatgagcagatcagagtacaaaggcttattgtgggacaagcaccattctaaatactctatgtattttacctaacactgtataaataaataaatactctgtgtgtttgctcaattaagacaaccacttttcaagggaagtattattattattattatcataactttacatatgaagaaacagacaagtgaaagattaagtaacttgtccaaggtcatgcagttctgccacttaatcattgtgtgatcagggacaagccacttgcccattctgaatttttcttttttcttttctttaatatgaggaccataatcattttcctatttgttttacgaggttgctgtgaagattaaatgagaatagaggtgaaagtagctctttactctaaaactttttggtcagaatttaagaatgtaagatgagaaattactcttttctagtatgaaaacgtatagttcttaagttagctctttaaaatggagattgtacgataccacgtctctccatcaatttttttcagtcacatgatttggtttgtaaacatgactttcccacagatttcatttgtagtaatataaatgtgttagctagttgtgatgtattttggcttttaagatattgttcccacacatgaaactcacaaacgttgctaagttaaagcacctaacttttcattgactctagcattcaaaaatctcacaaaccctggtctgtccatatcttaaactctatacaccagtttttttgccactgcatttattccacggcctgcatacagtgtgat

SEQ ID NO: 500 - DNA, 1057 bp, Homo sapiens
agttctaggattacaggcgtgagccaccacacctgtccaaaagtgtctgtttaataaagaaccatattacaaattcatgagagcaaatctcagccaggccttggatgctgccgttttttcatttaccctattccccatagcatctgttccacacctttatactcttctcaagtcccctaccctattcataataactctattgccaacaaagtcctatcgtctatttccctccaaaaacaagatctagaaggcaagaattttctcagctgcctctcctctactttcaaactcagttacatcttgtattttcctatctccttcctcgtatctctccacctatgctttcctgcccccatcctgtgctttcaatcctaatccctcctgacttctctagagccttacttggtcaattacgcattatttttcaaaacgtcactctttcgtgttctgttgcctccttctcgccctataaaggtggtttaaatcttcctgagttcacctcaccctgcttctccctcagtctcactgctaccttatcttttcttcctttcacgactaaactttgagaaaaacaatcacttgactttctatctgtactttctcacatcaaactttaattttctgtagcctaacttcaatttcagtgactccattgaagttgttgtctcaatgacttgctcatttcaaatcaagagatactttgtcagattcccacactgacttctttgtagcacttaagacaatgattgccttatttggccttagcaaagtgactttccagctttactacccacctttgtaatcagacttttttttttttttttttgaaatggagtttctgtaatcagactttttttttttttttttgaaatggagtttctgtaatcagacttttttttttttttttgaaatggagtttctgtaatcaggctttttttttttaagatagagtttcactctgtcatgatctcggcttgctgcaatctctgcctcccgggttcaaataattctcctgcctcagcctaccaagtagttgggattacaggcgcatatcacc

SEQ ID NO: 501 - DNA, 1028 bp, Homo sapiens
tgtttgagattaaagaagaagattctcagagtggttaagagtcctgtttaaggtaacatcacctagaaatggcaaagctggacttcaaacagaagtatttccagacctactggctctctcaattctagaagcctttctgttcacagcatcctgaatatagtatattggggagtggaagtcttgtatgtcactagacagctttttatgatctctgttgttttctgttgggcccagaacagatgaagtaaatggcaggatgtttctcacaccagcagaggacactgtcagccaacagagacagtgatagctgtaggctgggggctcaggagtttagaaccaaccctagtcctggtgggttgcaggatggagcaacctgtcaccattggacagctgccttagaaatctaatttgtgtatattgagttgttcagtattcagaagagctctatatatggtcctttggtaaataataatctgtgctacaatttattgtttactgtgttccagaactatactcagtcctttaagtgctttatttaatcttgaggcaactcttagattgttactattatccttccttaaaatatgaaggtcaggcatggtggctcactcctgtaatcccagcactttgggaggcggaggtgggtggatcacctgaggtcaggagttcaagaccagcctggccaacatggcaaaaccccatctctattaaaaatacaaaattagccgggcatggtagcacatgactgtaatcccagctacttggaacgctgaggcaggagaatcgcttgaacctgggaggtgaaggttgcagtaagccgagatcgtgccattgcacttcagcctgggcaagaagagcaaaactccctctcaaaaataaacaaataaatacataagtacaaaaattagcgaggcatggtggcgggtgcctgtaatcccagctacttgggaggctaaggcaggagaattgcttaaacccgggaggcagatgtctctgagccgagattgtgccactgcactccagcctgg

SEQ ID NO: 502 - DNA, 1073 bp, Homo sapiens
agtctaatgaccacattctttccttacaacatgctccccttgctcttctttttagctgctatggcctttctgtttctcaaacacatcttgctgtcttctagcagggtgcatttttgcatgttgttccctctgcctggaatgctctctctcaaactccccctctcctctaagtcctttgctgtcatcagatttcatttcaatcattacctactcaagaatcctttcctgactaggtttttatttcccattttatgctgttattgttccatgaagttttctgttgtgtcatttatcagcgttgtaattttcacgatttttaaaattagtccctatttagtaagcactttgagagtaaggaccttatgtgtttcctgtcattattgtgttccctagcacctcatacactgcctggcatctagtaggcattcagtaaatatttgttgaatgcactaatcatttctctccctgcccttagctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcggtatgaactctgttgtccacttgcccttgtcaaggtaccatgctgggaattgatgaagagataggaccctggccaggcagactgaatcagacataagggggagaagagcagagtgggtactggatggtgccagctagagaagacccagcgcctcaccattttgttttctcttccttgctcagctctgccgtttttcaacagccagtgatattcctgggagcagatgttacacaccccccagcaggggatgggaaaaaaccttctatcacagcagtgagtgatattctgtagctgcctcataaggttctcctcttcgctctgagtcctcaaaactgcccatgatttccttccctcagctctggctcttgagccttcataagatgtccatttagctcgctattcccaattcccattcccttgatatctcataaaggtagc

SEQ ID NO: 503 - DNA, 1036 bp, Homo sapiens
tacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcgga

SEQ ID NO: 504 - DNA, 1036 bp, Homo sapiens
acaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttct

SEQ ID NO: 505 - DNA, 2049 bp, Homo sapiens
gtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaagtgcggtctttctctttttttttcctaccagcaaaacaaacttttgggactgattacatctctaatagattttaggtgagaataatactgtagattgttatgcaggaatacttcacagagccttcatttattcttcattcaacaaacatgcaaagcactgtgccagcagtattgtggggaggggaggcacaattcaaaatgaggaaaatagtgtccgtctcattaagggaattaagtttggtgggggatatgattagccaaatagtcccctggcataggaggaagataatgagggagtggaataaggctacaacaacgaatatagggaggaagggacagatttgagagacgaggtagaattaataggactcgatggctggtgggaggagaagacaggagtagaggttagctcccaggtttctccttgaccataggagtgtgttgggacattctgccagtcaagatgggggtgacggggagactgtagaaggaaggtggggagtttttgaagaaacagaatgttgtatagactgagttttgaggtgtttgtggggcagtaagggtaaggtgtccagtaaacacaggttggtgctcaggtaagactgtaaaactgcatttatagatacaggagtcttatagatggtagttaaagccataggcatgaatgagatagcttagaaaaagagaagagaaactagtatacagccccctaagaaactcaatttaaaggttcgggggaggaagcagatcttaaggtgacagatcactggtagacagtttgtgggttttttgtttctttgtttagccagtttggtgaggtaggagaagaaatcagagtagaagaaggttcatgaagggagtgattaacaacatgaactgctgcagagagggagttctttttttttctgtgtgttttacctttctactccccatcttttggggatcttgtaactctatgacttacttacgttattctccagtatttcttgaaaatgagcattggaaaaaccaattctaaaatggctaaaactaggactttcaagttcaccacaactaccaccaattaggagataattgtaaaagaataaacaaaacctaattttgttcctagccaatattataaaccatgttccagcatactagataatagtagcatactatatttatttccataatttgtcttctttagagcctatgaactcctaggagcagaagctatattctcttcatttttgtcatctcagggtcatggcatataccaacagatcagtatgtgcaaatataattgaaataggctagtagtctgtggtttatgagtatgggctgggtgggcagtggatcaagaagtgataggagtacacaggatgaactcagaattcctgaatc

SEQ ID NO: 506 - DNA, 1116 bp, Homo sapiens
tggcacctctgggcattccttttcattactggttgagcatccttccttctgctctgtcaattggcaaaatatgctggagcacattctggactagcagttgccttggggtagtcaggctgggtatttgtttggtatctcttggtgtagcagaccccagaatctcatggcaattaggatttggtggctaaacgaaagagttagtgcaaggaaaagcctagttggaatttctgagtctgggccatccttaagctgctgtctactgcctgaatgggaagtaatgtcgaattggaaaattagctcaccatttttgttctagctttgcagacatttattcctctgatgataggctgagaaatgcctaggccggcttagaaggcacacagcatgacagaagtactccttcaaagcagctgtgtcaagaaggaagagctggaaaagtggatttgctggggaattagatgcatttagttttccacttacgcacaactgccttctccagtatatcataccaaggttttttaggcctttgtggcttaccctgcaggaacatactgtgtcctgttgttctggactgtagcatcttcaccaccatcctcttggcaatggttttttgtttggggtttttttttttttttttttggacaaagtataataatattgagggacctttctagggagcctttggtcctttgtccccattttccaaagggagggaactttcctcttaaaagagacagtgggaacttttagccaggtttttggaaaaggcctgtgggctattaatgagagtgagctgcaaaaggaggaagggtttgtttgggtactttgaagtacttagctaggtgttttctacagtatcttatataattgcatcttacagcatctttacatgcgaaatagtttatcagttatcttcaattgcatattacaaaattctgattaaatttttcttaaataagaaaactatcatttcatatgacaagaaatcctaatttaatgttactccaaggttggttaattcagtggctcagtgataacaccaaagactcagtttcttgaaatttttttgctctgccatcctccatgtttatcctcacgccagttcgcctcatggtc

SEQ ID NO: 507 - DNA, 1817 bp, Homo sapiens
tatttggattttgtttttaaaaacaaagacaacacattttaaaaaaatgtgatattcagtttagcattttggtttctatgatcccagcctcttcttattcattaaatgttattaagagtcttcatttaagacatttaagaaaaagaatgttgtttctctcaagaaatttgtaatttggtagaggaaataagacatgtaagaagtatgaaggtctttttcttggacttgtcatcctaattgttagtatttctgttatacctgaaagtgaatgagcactaaaagactttgtgataacacgttaaaaacaacaacacctctaagaatgttgtaattaacatgtaatgcagagttctttgtgaggtcaggaagactcgtagagtgttacagttgaaaggaacctcttaagaagttaactaatccaataccttttttatttatagctgaaatccagaaaggttaagggatttagtcaagaacacatgtttcaagtaggaaaggtgaaaccagaactccagaatcctgacttggtagtcattaggaagtattttgtaaaggaagaagttaatctaaaacaattggtaaaattttggttagctgtagtaaaaataacatacatataattttatttatttatttatttatttatttttgaaggaaggatagcagtaacaaaagcataacggttgagaagaaccaggtgtattgagtctgaaccaggcttaaggggaaggttctttgcattacatgttaattacaacattcctataggtggttttttttttaacatgttatcagatactgctttaagatactatctgttgaatagatgactcctaatcttgctgtagcctctacctctttcctaaacttcagattgacacccaaatgttcctaaagtgaacaacacaagtcaaaagagtagtgccctactcttctgtgacctcgtagtacttgatgtacacttccattgtggtgtttttagtgcattgtggttatttttctccctttctccagtataaccccttcatgaaaagtagtgttttttatcatctttgtcaccccatgtcagctcagtgattggcacataatactcagtaaagtgaatgaaatgtttataaaatggcatgagtgtgatggtgggggacaggaaagaaaactggatgttctagagggctgttttcctgaacatgggtttttcagtgccgtactcttatctcctaggatcttaggctagtcttggttttggtcttccttcactctcttttatgtctttctgtgagccgtcatccacttatggggacttaactgactcatgctgtactctcatagagattccctttttcttgtttctcaaaactggttcattaatgtatagatttgagtgaaggataatcctgacccttctggtagatatttacactttaaaaaggcatttattagctgagccatgggcctgtagtcccagctactctgaaggctgaggcaggaggattacttaagcccaggagttaaggctgcagtgtgttgtgattgtgcctgtgaacagccactgcactccagccggggcaacatagtgagaccacatatctaaaaaataaataaataaaaataaaaaggcattagttaatctaagtaaagatctggggcttgagggatgtcaattcaagtttttttagtatgccagatgagttacaaggaaatgatatggtggcaaaaatattaagtaaaaggaacagaatttttttttttttttttttgcaacagagtctctccctgttgcccaggctggagtgcaatggcgcgatttccgctcactg

SEQ ID NO: 508 - DNA, 1059 bp, Homo sapiens
catccggccggatatttcttataaatggaatcatataccatgtggccttttgtgactggcttctttttgcataatgatttcaaggttcattcatgttgtagcatgtatcagtatattcaggcactgcataacttttcagtgaattacagaccacatgtatgatggtggtcccataagattataataccgtatttttactgtacctttttatgtttagatacacaaataccactgtattacagttgcctacagtattcagtatagtaatgtgatgtacaggtttgtagcccaggagtaataagccataccatatagcttagatgtgtatatggcttagatgtgtagtaggctctactatctaggtatgtgtaagcacattctatgatgttcacacaacaaaatgataatgcatttcctggaacatatccccatcgttaagtgatgcataactgtactttattcctttttattgctgaataatattccattgtatggatataatacattttgtttatccatcatttgatggacatttgggttgttgccatttttgactactacaaataatgctgctataaacattcatgtacaggattttgtgtggacatacattttcatttatgttggatatatacctaagagtgatatcatatgataactctatatttaaccttttgagaaactgccagactcttttccaaagtggctgcaccagccagacatggtggctcatgcctgtaatcccaacactttgggatgctgaggtgaaaggatcacttgagtccaggaattcaagaccagcctgagcaatgtagcaagacatcatttctactaaaaagaaaaaaaaaaagaaggcagtgtctgcaccattttacattcccactagcagtgtatgaagatgttttcccatattctcaccaatatgttattatttgtctttttaaaaattattttcatcctagtggatgtgaagttgtatctcattgtcgttttgacttgcattttcctgatgacggatgttgaacatttttcatgtatttattggtcatttgtatattt

SEQ ID NO: 509 - DNA, 1023 bp, Homo sapiens
tcctccttgtagttaataagcatcttgtagggagattctttttgtaattgtgataaaacatatgtaacataaaatttaccgtcttaaccatttttaaggtatatttcagtggtattaagcacatttacattgttatataattattaccaccttccatccccagaattgtctttatctttcaaaactgaaactccatatccattaaacagtatccattgctccctcccctcagccctggcaaccaccatagtactttctgtctctgaatttgactattctaggtacctcatgtaagtgaaatcatagattgtttgtctttttatgactggcttatttcacaatttatccacattgtttcatgtgttagaatctccttttcaaggctgaataatattccattgtatgtatgtaacacattttgttaatcccttcatgcatcaatggacaccttttggctattgcaaataatcctgctatgaacatagatgtaaaagtattgaactctgctttcggttctttggatatatacccagaagtaaatttgccaggtcatgtgataattattaattttctgagaatctgctgtattgttttccagaatggctccatcattttacattcccaccaacagtgaacaagagttccaaactctcacttccatgccaacacttgttttctgttttgtttttttttttgttcgttttctaatagtaaccatcctaatgggcgtgagatgatatctcattgtggttttgatttgcatgtcccccaacaattagtgatgttgagtataactttgtaggcttattggccatttgtatatcttctttggagaaatctgtggtcaagttgtttgcccattttttgaactgggttgtttgttttgggttttgggcagtgagttgtaggagttctttatttttagattttttattttttttagctaaactgatcaataccattgtaggagttctttatatatattctggatattaacttctgtattctggatattaactatat

SEQ ID NO: 510 - DNA, 1041 bp, Homo sapiens
tgaaaacaatttttttttttattaacgttaaactcactagaaaactctcaagaattgtgttgaagatcatttgaaaatatatctgccaacttcctcttccttcctgaagtgtgtttacagacagagcaagttacaacagtcttactattctttgaggatagagcagcttcctggggattctggaggctcagttttctggtctgttattaggacacaatactgatgttgaggaaagtaaggccttgctgacaatgggaattattcttaaaagttatttttctatctattttagctagattagtaacatgtactttcattttgttggtggaaatatttaaaacaattatttttctggtgatcactgttttagccgtattacaaagcttctaatatgtagtatttttattatattctagaaactagaaatacataatattattttctagaaactccacaaatttcatttgtatttcctctgtgcttgaaatattgtttgagagacttttcaaattttcagattgaagatctttttgttttctggatttgttgtgaatttctagtttcattgtgttgttaaaaaatgttgtttgtggctgggcgcggtggctcatgcctgtaatcccagcactttgggaggccgaggcgggcggatcacgaggtcaggagattgagaccatcctggctaacacggtgaaaccccatctctactaaaaatacaaaaaattagccgggcgtggtggcgggcatctgtagtcccagctacttgggaggctgaggcaggagaatggcgtgaacccaggaggcggagcttgcagtgagccgagatcgcgccgctgcaccccagccttgggacagaatgagactccttctcagaaaaaaaaaaatgtggtttgtatttttccttttagagtttctagaggtattttttgtagcccaatatacggtcaatttttgtgatagttctatggctatatgaaaataagatatattcatatattagtttagagtgaaatatccatcagagctaccagtttgattatg

SEQ ID NO: 511 - DNA, 1052 bp, Homo sapiens
gttctgtctctcctgttagaacgaaagctccatgaagggattgtcattttattcaccagtgtaccctctatgcccagcacaacttttggtcatattaaacaaagaatgaataaataaatccaagagcataggaggaggagcatccaaatgagcctgaaaaattagagaaatatttgtagtagtatgtgatatcttagctgagcttaacaagtataatgagatcaagagtttggattgaaaatgaggtactcaggaataaacgatttctgaggtctctaagatattataaaactttattgaaagatctaagaaaatttaatgaaacacattgtccttattaatctataaatatagttttaattaaaattccaatagggggccaggtacggtgggtatgccagtatttccagcacattgggaggccaaggtgggaggattgcttgagcctgggagttctgaccaacatggtgaaaccctattgctaaaaaaagacaaaaaaattagccaggcgtagaggtgtgtgactgtagtcccagctactcaagaggctcagttgggagaatcgcttgagcccagaagtcgaggctgcagtgaactgtgatctcaccactgtactccagcctgggcaacagaattagaacctgtctcaaaaaacaaataaaataaaattccaatagggtatagtataacacttgataagtcgatattaagatttatatggaagaataagtgactaagaaaaaccaatagaattttaaagaaaaataaagcagaaattgccctacttcctataaaactgtaacagttataccacatggcttcaggtgcaggaacaggcagattaatgaagcagagtctagaaacgagccacatatgtgtttatggaaactgtaaatatctgatgtagtgtttcagatcagtagggaaagagtagaatatttaataaattgtgtttacacagtttaactttaaaaaaattagatccatcttacattagacacaaaatttatttctaggtgaattatatcccaaatatgaaaagcaaatcttca

SEQ ID NO: 512 - DNA, 1032 bp, Homo sapiens
catgtgagatcatacagtatttgtctttctgtgtcttgcttattttatttaacataatatcctccaggttcatccatgttgtcacaaatgacaagacttccttcttttaaaggctaaataatattccattttatgtatataccacattctttttatccatttgtctgtcgatggtcgcttaggttgtttccatatcttggctgttgtgaataatgctgcagtgaacatgggagtgcaggggtctccttgagatagtgattttatttactttgcatgtagtccctgaagtgggattgctagatcatgtagtagttctatttttaattttttgaggaacctccatactgttttccataaaggctgcaacaagggtttattaattgccaataaaatgctatgaaaaataatgagaaatattgcactgaccatcttacttgcttacatttcctttttgcttttgcgtgattttgattttgcaagccttgtacgtggtatatgcactgaactaaacagcctttattgaacttgaaatcagctggagaagactggtaattgagcactataataagtactgtaaaggaaaataccaagtgcaatggaagcataaaagggagggatccattgtagtctcactggttgagggatgtttccctcaggaaatgacagatgggagctaggcgaaattggtgatggaaataagcatggaagagtactctaagaaagggagcaattctctctaattgtgtgattggtcttgagaatgattgttctattggcatttaatagcctaactttcaactgtgtaattaaacttgctgtattttaccaatctaagactcaaaattttttgtttacatttcaacatctctgaaattgggagatatcttacaattgatggtttgtcacagttcagttggcaggtttctttttaaagaatacataaaatactggtgcagcttaccatcaatggcatcttagatttgatgaaatgaagaatatttctttagcttgttttgaggccagcccatttgc

SEQ ID NO: 513 - DNA, 1062 bp, Homo sapiens
ttattagtgattaccatattagcataaatgtagaacattccatcacctcaagaaaattctctttgacagcactgcttcagaaaattcatctcgaagaacttcagccaacagcttaaagcccatttcttcacattctagagcaggcctgggatccttgaacccctagagtccacagatggacggcagggatccaagaactcctaaaatcatgtgctaaattatgtatatgtgcattttgctgagagtttattgcttacatcagattctcaaagggatcttgactccataagagggtagggatcacctactttaggaattattttggttacatttgatttttaatagtattggaaaagagctgtgtcactatattatacctctataaaagtgtcactttgcttctgttaaaaatgcctggaatttttttctcctgctttataaatctttaaaggacttctttcttgagctttacaaaattctgatcttcaagcagtatgtgatgactgggctaggtaaatatcacataatttgaaattatggaataccttgagaattattggatctcctctttcattcctccttccctctcccagcataaatacctgaatttattataaacaggattttttattaatggaagattttggcccttgatctatgggctttgcaaattttatgattttattttttaatgtgtagagcttgatggggtaaggaaaaattttgccattaggtctgtcatgactgtgaccattattagcaatgttatatgtaaaatctggtgtttatatcatcttgcctgtatcacagaattttttgtctgttcagaattgagtttttatggtaatgaacaggctttataagtataaatattttacatgtgacagttctgtaacctccatttttcttgttgggaacaggtttgaaggttgaagtgactcattgtggaacaatgagacggaaataccgtgtttgtaatgtaacaaggaggcctgccagtcatcaaacgtaagaaaagtttgtcagagcagcgatggtgtgaggcagcttgctctagttagt

SEQ ID NO: 514 - DNA, 1060 bp, Homo sapiens
gccactagaagtaatgccttcacactgctaattaataccctgttgttcatgattcttttggggtcttttatggccgataacttacctcatacagaacatttattttggaatatgaactgtttttaagttttaatttattctaaattttctgtaatgaaataacacgaaacaagttcatccataatcctaccactctaatgtaaccactgttaacattttggtatactatacttctttcagtcttcatctggtgtacattttacttaattatacttaattactgtagagctgtcttgtttactacttttttacttaacatattgaaaataagtggtttaatgaagttgattttaaatttttatttacatgtaattggcactaagtaagagctaaaaaaaaaagatatatacatgtagtacaaaacttttttccatttgtaggtctgtaatattgtggcagggcaacgatgtatcaagaagctaacagacaatcagacttccactatgatcaaggcaacagcaagatctgcaccagatagacaagaggaaattagcagattggttagtacttaaccttagaaatgagaatttaaaacatattagggtgaactgtaatactagagaaccatgtccttatcaacccataccttatgaccatttcatggactgtcagaattaaaagcaatcatggaagtaatctaatgttcttgatacaagccttggtgggctatatgagaagggttaggtccttctcatttaaccctgagctttttaagtagatccagggaacagatcctctcagaagaaatgtttccatttagtaaactggaacctccacctaaaagaggtgggaaataggaggaaaagtcaaagaattatgactagcaatactaaaattcttttttttttttttttttttttttgagacggagtcttgctttgtcacccaggctggagtgcagtggcacgatcttggctcactgcaagctctgcctcccaggttcacaccattctcctgcttcagcctccccagcagctgggactacaggcgcatgccacca

SEQ ID NO: 515 - DNA, 1041 bp, Homo sapiens
cccttgagagattacataggtttaaaatataagtctttttttaaagagtgataaaaatttgtggatcataaggaagtttataattttgtgcccatgttggagaatactagcatctgttaatattaatacagcccttttcaaccaccagcaccactattttagataaaattctgctgtgaataaaactttggattggccgggtgcggtggctcacgcctgtaatcccagcactttgggaggccaaggcaggtggatcacagggtcaggagatcgagaccatcctggctaacatggtgaaaccccatctctactaaaaaatacaaaaaattagccgggtgtggtggcgggcgcctgtagtcccagctacttgggaggctaaggcaggagaatggcatgaacttgggaggtggagcttgcagtgagccgagatcgtgccactgcactccagcctgggtgacagagcgagactccgtctcaaaaaaaaaaaaaaaaaaaaatttggattacataggacttcctctgtgctgtcaataacttgaagttacgttgcaattgtgtgaaacagataaatggatactgaaaaaatgaaatatctaaccctttttcaaaatgtgtttaagaccttctgtgttccagcaaccagtgatctttttgggagccgatgtcactcatccacctgctggtgatggaaagaagccttctattgctgctgtgagtgttagccaggtttatcttacctaaggttgacagaccagtatcaattttgcagtttcaactttttgaattttaatattttctttgtagccaactttcataaatgttctttgggtttttgaaaagaatgattattctctggtttggagtttggaagttccatatgtatctattaaatcaagtttgctagttatattattcaaatcttctgtattatactttaatttgtctacttgacctctccatgattatgcatttttagttactttttgttgttttgaatagtttgtttgtatatttcagtaatgtctttgtcatagaaagata

SEQ ID NO: 516 - DNA, 1015 bp, Homo sapiens
gctctatctcaaaaaaaaaaaaaagaaaagaaaaactactgggtgctaagctcaccatctgggtgtaatatacccatgtaacaaatctcacatgtacctcctatatttaaaatactgaattttttaacaatccaaatatatgctgcctatgagaaattcacttcacctgtaaagacacatataaactgaaagtgaagagatggagaaagtcattcattccatgcaagcggaaaagaaatgcaagcaggagtagctgtatttaagttagacaaaacagactttaagtcaaaaactataaaatgagacaaagaaggtcattatataatgctaaagggatcaatttaccaagaggatataacagttgtaaatatatatgcagccaacactggagcatccagatatataatataaagcaagtattattagctctaaagaaagaaggagactccaataatagtagttgagaacttcaacaccccactgtcagcgcttgacagatcatctagacagaaaatcaacaaagaaacattggatttaaaatacactttagaccaaatggacctaacaaatatatacaaagcatttcatccagcagctgcagaatatacattattttctcagcacatggaacattcaccaggatagaccacatgttaggccacaaaacaaatttcaacaaatttaaaataatggaggcggtcaggtgtggtggctcatgcctataatcccagtactttgggaggccaaggtgagtggatcacttgaggtcaggagttcaagaccaccctggccaacatgatgaaaccccacctctactaaaaatacaaaaattagccaggagtggtggcacatgcctgtaatcccagctactcaggaggctgaggcaagagaatcgcttgaacctagaaggtggaggttgcagtaaaccaagatcacgccactgcactccagcctgggcgacagagtgagactgtctcaaaataaataaattaaattaaataattgccgggtgtgg

SEQ ID NO: 517 - DNA, 1060 bp, Homo sapiens
gtaaatattttaaaagattagagctctgtagggttgagacctctgaaattgagtagagagaagagtttgttgagggatttttttgttttgttttttgatagtttacttgctgcctctcataccttaatgtgattttcatatattttttatatatatatatgtatgtgtgtgtatataaacacatatgtatgtgtttggaagtatagcttccttttcttttatatttattagaatagtgctttaataattatagaattgtattggcagcatcttttatagaaatataatcatgtttattttaagaactgacaacttgtttttgctatcttttagtgcaataagcagttttaaaggaaagttgtgtctgcatctttaccatggatagtaggaggaacaggcacctccatagtttaaaagggcaaagaatacagccttaatttcagaaggaaagttttgtaattttcagttttaaagcatatcttttaaaattcatcatgataaaaggctggacgcggtggctcatgcctgtaatcctagcactttgggaggctgagacaggtatatcaccggagctcaggagtttgagaccagcctggccaacgtggtgaaaccccgtctctactaaaaatacaaaaattagctgggcgtggtagtgggcacctctaatcccagctactcgggaggctgaggcaggattgcttgaacctaggaggcggaagttacagtgagccaagactgcaccattgcactccagcctgggcaacaaaaccaaaactccgtctcaaaagaaaaaaaaatcataatgaaaatgaagtgaaattgcctaaatgagtccaacttgaatattagaaataaagttgaacttttatataattgtgaatagcttaacatatttaaattatttgcaaatagattgtgtttattgaagaatcatattggctagatgcccattttcatttactaaaatgaatcaggaaaatgcaagatgatattttaaaacttttgctaatgtatcaccagtataactttccttttaaaattaaggtgatagtaacaaagg

SEQ ID NO: 518 - DNA, 1030 bp, Homo sapiens
ttacaaagggcacaccactgcagggagtgtaaacaattctttgttgcaacagacaagattttttttaaaaaaagaaaaaaggatgcattttaggtacacagggtatggacgcattcaacatttacttttatctccacagatgccaacctccccttgttgcaggcagttgggcttttccaactcattgctaacaaagctggcatctgcattaatttcaatgagaatttcaagtactgaagatgaaaagttggggagattcatgtttgaaaaatgaaaaatgaacaaaaaatccaccttgtgcagtgagatagctaacgctgatatatcaggaataattttaaactatttttgctgtaatgtgtagctttaatgtctcttttcagttatggacccataaaagtattcctatatcttgtgaataaagatcattcttgtggactagtacgtggatgcattcataggctttgggaagcagtggtgtgcgtatgtgtgtctatatcaatattttatgtttataactctgcgtattaagtttatatagaaaaaaataatgtctttctttagtgtttgggggactcaatggtaatatgaccattgcagtgtaatctgactgctcactctagagaacacttctgttatacacaatgcacatacaaacatacacccctaaagcgtagctaactgctcccactagataattgctgctaaaaacaaaacaaaacaaaacaatacaaaacaaaaaaaaccctaagtaatggaggaagaaatagcattcttttaaaaggggcttttctgaagagtaaaatgtaaatacaggacatgtggggagggtggggccgcctgcaaaatgtcctgaagatggacaaatagccttttaaattctactttttaaccatctttaccgtgtgtgcctatttgtattgcagatgtgaactactatttttggaggttgatatcagtatgttttgaaactgaattattacataaaatcagagtaacctctttctccatcctccttttccacactatt

SEQ ID NO: 519 - DNA, 1055 bp, Homo sapiens
caggactgacttggaataaagaattgctgaaaatcccattgctgagatcctaaggcttcccaggcccacgaaagtgaatgggagtgagaaactgatttgaggtcattttagatgtggtaactctgaaacatgagtagaggctgggtgccgtagccacaactgtaatcccagcgctttgggagagtccacttgagcccaagagtttgagaccagcctggcaacaggatgaaactccatctctacaaaaaaaaaaaaaaaaaaaaaaaaaagccaggcgcagtggtgtgcacctgtagtcccagctactcgggaggctggggcaagaggctccttgagcctgggaggtcgagatggagtgagccatggtcgtaccactgcactgcagcttaggcaacagagtgagaccctgtaccaaaaaaataataatataaactaaaataaaaggtgagcagggccaggcacagtggctcaggcctataatcccagctctttgggaggccaaggcaggaggattgcttgagcccaggaattcaagaccagtctggacaacagagtgagaccctgtctctacaaaaaaataaaagtagctgggtgtgatgatgcatgcctatagtcccagctacttgagaggctgaggcagaaggatagcttgagcccaggagttcaagactgcagtgagccatgattgcaccagtgcactccagtctgggcaacagagcgagactctgtctccaaaaaaagcaaaaaacaacaacaaaaaaaacaaaggtgagcaggaggctctcatcctccctcctctccccacagaagccttgtactacacagatgacacagccatggccagggccctggtgcagtccctgctagccaaggaggcctttgacgaggtggacatggctcacaggtgagggggatggtcctgggctgaggcaaaccaggtgggaaagttattgcaccccttgaccagaggaatgacatttgtgcatgtccacgcccccaaccctccacagaagcctgtgtcaggctggcacagcttcccaagctaaaacagcagc

SEQ ID NO: 520 - DNA, 1020 bp, Homo sapiens
tgaaggagccatggtgggagttatttataagtttctcttgcatttgtttggctgctttgttgcctagcaaccaaatcagctgctgtaccaaccccacctgactgaggcttaaaaatagcccagcagctgaggggacagagcagggtggcctagggcaggcaggcaccctagcagcctctccctggcacaggactgctaaaagctgggtcagaggagcacaaggaccctcactgtcctgaatccatgggacagcctcggctgggtcagccctctgacagcaggaggggcaagaccttacactgggacatggcagagggcaattgggttttcttccaatcctggatggctccttcctatatgcgccgttcagggccccttcacctggggagcgttgtaggcggggaccctcatccgatgcaggatgttgccctgggaagtgtctggttgcctgggtctgtagtggaagtccagatcatagggaggacaagtgtggccccggtgtgattgtggggagaggactcccgggtgagaagccttggccttggcatggggatggtgcctggtctgctcccttgcctcttcctgcctcctacggcccccacggtgaccggcttcgcctggccttctacccccagatcgcagcctgcagctgagcgcatgggagagcagcatcgtggatcgtctgatgacgcccactctctccttccttgctcggagtcgcagcgcggtcacactgccccgcaacggccgggaccagggtaggggctgcgaccctgggagaggccccacgtggggccgggcaggggccagcctggcgcgcgggccgcaacccgaccgcactcatccctctgcagccgtgccggtgtgcccgcgctcggcctccgccagccccctgacgccgtgcagcgtcacccgaagcgtgcaccgctgcgcccccgccggtgagcgcggggagcgccgcaagcccaacgccgggggcagccccgctccggtgcgccgccggccggaggcctcgccggt

SEQ ID NO: 521 - DNA, 1026 bp, Homo sapiens
gcttgttaaatagccaaaaccggctcctgccatgaacaacttgtggagcaaatcgggctcagtttgttctttgccgggagatgtattttgtgagccaatgttcatacgttaatgataagttttactgcagccatttgggcttaattgcattttgtaagagagttgtgttgaggtttctgtaagaagtgatttgattaaaaacctctatatccagtgtaattccatctctttgttttttaaacgttttaacaccagagaaagatctccaattttggagactgatgtttttagttttgtagactaggtacagttcaattttagcagtggtgatggtagtagtagtaccaccttagtgtatttatttaataccaaatatataggtacttttaaatttggtttagcctgcaaaatatggattacaaaaagagtgatctattttgttccgaggaattggagggaggaagcttggaatatttctgagattagcacagagatgggaaatgttgatgactgggagggtacacagacatacgatttattattattattattttttgagacaaagtctcgcgctgtcacccaggctggagtgcaggggcacaatctcggctcactgcaacctccgcctcctgggttcaagcgattctcctgcttctgcctcctgagtagctgggattacaggtgtgtgtcaccacgcctggctcatttttgtatttgtagtagagacggggtttcaccatgttggccaggctagtcttgaactcctgacttcaggggatcacctgcctcggcctcccaaagtgctgggattacaggcgtaagccaccgcgcccggccacgatttattatttttagaatggatagtcctaaccactaagcattttagggcgctaccctgtttctgtagggcatattgacatcctgaatgcaaggaagtctggttaatgctattctctcaaatacagggttttggtggattttttcacacatattctataaacatctaagatctgttcactgtttgac

SEQ ID NO: 522 - DNA, 1043 bp, Homo sapiens
tgacctcaggtgatccgcccgcttcggcctcccaaagtgctaggattacaggcatgagccaccgcgcccagccctggctaattttttttgtattttttagtagagatgaggtttcgccaagttggccaggttggtcttgaactcctgacctcaggtgatccacctgcctcgtcctcccaaagtgctgggattacaggctggagccaccgcgcccggcctagaaaaggagcattttaagtgtgctttccttcagtgatttattttgtcagatgtatactcatatcttttgtagtgtatttttcaggtaatagtgtttctttggaagcgtaggatgtgctttctgccacagagttgagttataccactgaaaatacatgtatttaggcagatgttttcaacctctgcctaaaaagttttatggactaaatccaatctgcagatatattttctttggctcatacagtgttgtacatttgaattagttgtcaacatttaaaaaggagattttgtgtaaaaatgtggattcaggctgcttttgaaaaagcagatctggcagccatggatctgcttttctgttttgcagcaaccatcttttatagttggggcatgtcatttccaatttgccctagaccctgccaacagtctgacatgtagccctgacctggacagagtgttagttggtatttactattttatacctttctattacttgtctattttccatcttttattacctgttctggatatatcatagaggtctctgatactcccattcatagtcactttgctgtcttacattatcattgaccttttttttctgtcttggtaccttatatccttcgtttgtttcttcttaaaaaaaaaaagattttaggcagctttgaaagatggagttgaagcaatgcagggggaacccccaaaacactgaattactttgtttccaaactgaagaaaaacagacttttggagagcatagaggcattggtctcacccctgccggtgccttgtttagctggtatgtgttcagtgtactcacttttgtt

SEQ ID NO: 523 - DNA, 1033 bp, Homo sapiens
aaacaaaaagcagctaggtaggggccgggcatggtggctcatacctgtaattccaacacttcaggaggctgaggcaggtggatcatctgaggtcaggagttcaagaccatcctagccagcatggtgaaatcctgtctctacgtaaaatacaaaaatcagctgggcgtgttggcaagcacctgtaatcgcagctacttggaaggctgaggcaggagaatcgcttgaacccaggaggcagaggttgcagttagccaaaattgctccactgcactccaggctgggtggcaggagtgaaacttcatctcaaaaaaaaaaaaaaaaaaaaggctgggcgcgatggctcatgcctgtaatcccagcactttgggaggccaaggcaggcagatcacttgaggtcaggagttcaagatcagcctggccaacatggtgaaaccccctctctactaaaaatacaaaagttagccaggcattgtggcgggcgcctgtaatcccagctacttgggagtctgaggccggagaattgcttgaacctgggaggtagaggttgcagtgacccaagatcatgccactgcacttcagcctgggtgacaaaatgagactgtctgaaaacaaaacaaacaaacaaaaaaaaacaactaggtaggaaataggttttttttgtgtgtgtgtgtgtttttggagacaaccttgctttgtcacccaggcctcagtacagtggcatgaacatagctgactgtagcctcaaactcctgagcttaagtgatcttcctacatcagactcctgagtaactgggactgcaggtgtgtaccaccatgcctggtgatttagcaaaatttttttttcttttttttaatagagacgggtttcaccgtgttagccaggatggtctggatctcctgacctcgtgatccactcatctcggcctcccaaagtgctgggattacaggtgtgagccaccgcgcccggcgatttagcaaattttttgtagagacagggtctcgttttgttgcccagggtagtcttaaactcctg

SEQ ID NO: 524 - DNA, 1029 bp, Homo sapiens
tattccacaaaaccgccattgtcatcatggcccgttctcaatgagccgctgggcacacctcccagacggggcggtggccgggcagaggggctcctcacttcccagtaggggcggccgggcagaggcgcccctcacctcccggacgggcggctggccaggcggggggctgacccccacacctccctcccggacggggcggctggccgggtggggggctgacccccccacctccctcccagacggggcggctggccgggcggggggctgacccccccacctccctcccggatggggcggctggcgggcggggggctgaaccccccacctccctcccggacggggcggctggccgggcggggggctgacccccccacctccctcccggacggggcggctggccgggcagaggggctccttgtgagcttgtgaggaactttctacttaagaatgaccaagtggccttgtgggaaggaagagggttgccatttgttaatggtgtttataaattgctattggattagtataagctgcaaagcagctactaatttattttctttaactaggagaatcataatatggacattttggataggcatctttttaattttctaaagatttccaaaattggtaatgttatttctaattaggaagtttggttgaaaataagtttctgaactctgtgtcaaatctagtagctacttccaatttgtaattaaaaaaagaaaaagtcttcaaaggttgaatgtgccttcatggattctccagcatgagcaaactgaagtatccaaaactgaattaaaaatttcatctaaattataccttcttcttagctttactatacttagtgtcaaactgatttcttagatttcgtagtcacttagttttgaaaccttgattcctttcctcttcgtcacttctacgtctagtcagttatttgttgaatgccatgtatgtgtaaagcagtttcagatttcactcctgtgagttctatttccattgctattggatgcctagtgaggaaagctcctt

SEQ ID NO: 525 - DNA, 1032 bp, Homo sapiens
acttggcatttgaggctagctatgttttggttcttcccctgggtaaatgtgtctctcattccttgtctcttgatcattgcattttaatagcccttgaacagttatatttgcttttccagctaggactttttatttttcgctacttcctccccacacccaccaaaatcacgtatttttcagtcagtagcaattttgaataaatttaagattatagtacatctgataataagaggtaacctgagtgcatatctgtgcttacagtcgttctaagtacattccatgtattaaccatttaattattccctacaatcctagggggaggtatgattataatctgcattttacagatgtaagtgaggcaaggaaagatgaaacagatccaggattgcacagctagtaaaggggatagagctggattcaatcccagagtctggttgtagagcatgtaaatctttgtccattttttcatggaactccaaggcacctggggctggcagactggtgcatgagaggataaacagtattatatctgtgagaatttcaagcacagtatataggaatatgtatagagtaagaccttgtcattggagaaaagtggagcgatcttggctcactgcaacctctgcctcctgggttcaagcaattctcctgcctcagcctcctaagtagctgggacttcagttgcacaccaccatgccaagctaatttttgtatctttagtagagacggggtttcaccatgttggccagactggtcccgaactcctgatctcaagttatctctccgccttggcgtcccaaggtgctgggattacaggtgtgagcgactgtgcccagcctttttctttttaaaaaataaataacatgggccgagtgcggtggctcacacctgtaatcccagcactttgggaggctgaagcaggcagatcacgaggtcaggaaatcgagaccatcctggctaacatggtgaaaccctgtctctactaaaaatacaaaaaattagccgggagtggtggccggcacttgtagtccc

SEQ ID NO: 526 - DNA, 1043 bp, Homo sapiens
catgtaccaggcattgcgttaggtgttggaggagatacaagataaatataaggcacagtccctattctttttctttctttcttttttttttttggagacagtgtcttgctctgtttcccaggctggagtgcagtggcgtgatcctcagctcactgcagcctctttctcctgggttcaaatgattctcctgagtagctgggactgtaggcatgcaccaccacatctggctagtttttgtatttttagtagagatggggtttcaccatgttagccaggctggtctcaaactccagaccacaggctgtccacctgggcctcccaaagtgctgggatacaggtgcaagccaccgcacccagccagcacagtcccttttttttttttttttttgagatggagtctcgctctcgcccaggctggaatgcagtggcgcaagctccgctcactgcaagctctgcctcccaggttcatgccattctcctgccttggcctcccgagtagctgggaccacaggtgcccgccaccacaccttgctaattttttgtatttttagtagagacagggtttcaccgtgttagccaggatgatctccatctcctgacctcgtgatccacctgcctctgcctcccaaagtgctgagattacaggcgtgagccactgcccccagccccacagtccctattcttaagggaccttcatgtttagtgggagagacagttaattacaatacaggatgataagggcaatagtagaacctggaatgagatgctcactgactccttctggagaattaggggaaggttttacaagaatttacatttgagctgttgctggaaggtttcgaataagcgaagcaggtggtgagtgtgtgtgtgtgtgtgtgtgtgtgtgtgtgtgtggtggaggttgagacaggagtggtggtttggtgagaggaggctattcaaggcagtgggacgagcatgtctaatggtgtggaacaggaaagttcattctaaaaatgtagtttgattaagggtagaagcataggagtcagtggtagaag

SEQ ID NO: 527 - DNA, 1034 bp, Homo sapiens
taaggcccagtatactctttttcttccgtctctgctcagctgtctcatgagagaggccttcccttaatgcgtgatataaaattgtataacttttactcctccaggtgccctcatctgctcactagaatgtcagttccaggcatgaagggacttttaaattattgaacctccagtgtttagaatagtgcctggcatgtagtcagtacttaataaattatttgttgaataagtggacaattagtaatgtgtagaagggaagagggtctattgtggagtctccttgctaatacactgctgtttggccaaaggaggttcaggagatagaggctgacaagtatgcctgtggctggccagatgacatgcaggacaggctaggcaggaggagggcaactgtggtggcagggggtgactcagggtttcaggtgtctcttcgctgtcacagagtaactaaaggccagagcctcagatttgcttattcactcatcgcaacaatggggaattgaagacttgttggaatgataaaattcttgccaatatccaagaagaggttaattaataggaaatatgatggagtaataaaatgggagatttatgtgtgtgtacttttgccatctggttagaattagagggaaagatggatgtattggaatagattgtgtttttttgttgttttgagacagagtctcgctctgtcacccacgctggagtgcaatggcacgatctcggcacactgcaacctctgcttcccgagttcaagggattctcctgcctcagcctcccgaatagctgggattacagccatgtgccaccatgcccggctactttttgtatttttagtagagacatggtttcaccatgttgtccaggctggtcttgaactctggacctcgtgatccgcccgcctcggcctcccaaagtgctgggattacaggcatgagccaccacgcccggcttggaataggttgttttttaaattcaacatgttacagcataagagcagtttgcagtcctgtagcagacatgggatttccctc

SEQ ID NO: 528 - DNA, 1026 bp, Homo sapiens
gtgaggacatctaattacctacatgagcttgctggtcttggaacttgtttttcctgtttgttttggaaaacgctggacatagctttgatgtatgaccatgttcatagatctgggaatagacaactggagcagaagggaatttttgtgcttttatgggtaggtacggagagttactttaccttgaaatgcatttgttaaattcattttaatatacttctgttcattgctttcttattttaaacatctgatttttgtcaggttcaccaggttgagttttgtggagcttgtgaattagtcttgcataatgaaaaccttagcacctgaaatattgccagtgaaagtatcaggttacagtaaggaaggcttttgctttccatactgtaggaggttagatgaatgaaaacctgtcagacagaggcagaccatctcatactttgagagaaaagcttgggtccttttggagtaaagctgagggctaaagtagggtttgtgtttatagattttgagcatcagtaacagaatctgcatttgggtagccattttatcactacttattttctctcatttcagaagtgtatgctgacttgtaaagtgaagaagccagtggtgctgcgggtgttcttttggggtagtgtctgggatccagtacgagttgaatcattgttcaaataaggtaaaagcatggtggtaaaagaaactaataacttcactaatttgtaaaaccaatcttacgttaagaattgattatttcgagaccagcctatgcaacatggtgagatcctgtctctacaaaaaataaaaaaatttaaccaggcctggtgatacacatctgtggtcccagctacttgggaggctgaggcagaaggatagcttgagctcagtagttggagactgcagtgaaccatgttcatgccactgcactccagcctgggtgacagcaagaccctgtctcaaaaaaaaaaaaaagaaaagaaaaagaattgattatccagatgattcgttaatggaagttctgggttcttatga

SEQ ID NO: 529 - DNA, 1052 bp, Homo sapiens
ggagtgcagtggcgcgatctcggctcactacaagtccacctcccggggtcacgccattctcctgcctcagcctgccaagtagctgggactacaggcgcccgccaccagggccggctaattttttttttttttttttttttttgtattttcagtagagatggggtttcactgtgttagccaggatggtctctatctcctgacctcgtgatctgcccaccttggcctcccaaagtgttgggattacaggcgtgagccactgcacccggcctattttatttattttttggaggctctgtcgccaaggctggagtgcagtggcttgatcacggctcactgcaaccttgacctcccaggctcaggtgatcctcctgcttcggcctcctgagtagctgagactataggcacaagccaccatgcccagttaatttttgtatttcttgtagagatgaggtcttactatgttgcccaggctggtctcaaactcttgggctcaagtgatccacccgccttggcctctcaaagtgctaggatttcaggggtgagctactgcacctggacaataattccatttttaaaaatagttaagtgtcatgattggctgcttaatttagcttagaaaagatttatcataatgagagctggaaggaaaccacaggtcgttagttaatatagattatagtgtctttattaagttaggaaagctgagaatttctcttaagaattgagaagaaaatattccccaatggtaacatactcatttaaaatgggggctaaaattactgttactgtccctgagagacataggagaggagcctctggggtgaattgaatattttttttaagccgccagctgtgctattcattttgtttccccaatgattaattgcatagatgatcctgagcttaatagacacgcattgactgaattctcagaggagtatctcaagttgcttacactggggatgttttgatgaaaaagttctaagtgaacttttagcttgctgttgattttccctgctaacatccagcatcgaagagatttgtcttccaaa

SEQ ID NO: 530 - DNA, 1090 bp, Homo sapiens
ttgagtcaccacgcccagcctgtatctttaaatgttttaaacagttaaattaaatgaccattctccccagagggacatcacccccactttttaggagagtacccaatgcacatttggatattcttttctataaattgaagaccttagaattgaaattagtatttactgatttaccttacttaataacttgagagccacttaatagcagagtacatgtcatgaaggggtctctgatttgatttattcagggatggggtggagtatgaggccttggcagagtgttactctagagatatcacagctgccctctattctgtttctgtgtcttttactcaggagatgatgacctccagagaaaagagtaaaatagtaaacatgtttcatatttcacctgagctcagctttcctcccataactgtccagaggcattcagaacgcaagtcaggcccaccccactgctttgtctaaaacgctttatgggtggtggtatttctttcttggtatttttgtctgtcttatctctatcagttgatggcttgttcaccaagaatttcctacttcttccctttagtgactgttgaaagcatggctctcctgactggatgttggtggcagtgaagttttgttcaaacgtggcactagtaaatgaagtgtgtctccctaacgagatcagtttggtcttatgtgcctttgaataaggtgtagaagggatgagaatgatctcaatttctaggttagcagaactgtgatacatacataattttattccttgactgtattgttaatatttgataaactgatttttaaaattattgttccttcttgtgaagagaatggagattgaagaggaagcgtgaaagtgtgtttattcatttaacaagtacaaagtgtccactctgtggctaaacgcaaagcactgaagatgaaatggagaacaaatcagatgtggtctctggttcattttgtagcctcctgggtttggtatcctgaattgttaaacttatttagttaactcttttttgttacctaacagtcatcgaatgtagcattatctaatctggaaaagcatgctgtcttctcagcagagtag

SEQ ID NO: 531 - DNA, 4148 bp, Homo sapiens
ggcctctcaaagtgctgagtggggttacggtcgtgagcccagccccccttttttttttttttttttttaagacggagtcctgccttgttgcccaggctggagtgcactggcgtgatcttcgctcactgcaacttccacctcctgggttcaagtaattctccctgcctcagccttctgagtagctgggattacaggtgcctgccaccacatttgactaatttttgtatttttagtagagacggggttttgccatgttggccaggctggtctcaaactgctgaccccaggtgatgtgcctgcctcggcctcccaaagtactaagattacaggcgtgagtcactgcaccaggcttcaatcgggttttgaccgtaaatgtaaggataaatttttttaaacacaattgtgttttaagtaaaacgcatctgttttcaagatcaaggaccattgatctgcttggtaattagacaagtagtttgagtcaagaaggcttgggcttctgaaaaggatgatgggcttgtgctaccctctcaagtgtctctgcagaacagtttgaaaacaaattctttctcctagtgacagaattatatctgaaatcaattcaaaaggctgtttgaaattctgtccttgtgccaggcgtggtggatcacgcatgtaatcccagcactttgggaggccgaggtgggcggatcacgaagtcaggagatcgagaccatcctggctaacacagtgaaaccccgtctttactaaaagtacaaaaaattagctgggcatggtggtgggcgcctgtaattccagctacttgggaagctgaggcaggagaatcacttgaacccaggtggcagaggttgcagtgagctgagatcatgccattgcactctagcctgagcaacaagagcaaaactctgtctcaaaaaaaaataaataaataaaaataaaataaaataaatacataaataaaataattagtttcaattcatgttaaagaggaggctccgggaatgggagtcggggggcgtcacagtattgcagctcttgagtgcacttgtcaattctggtaagcttaatatgtgcagaattgttaagtttggctctgtttgtatttacatggcagcttttcttcatcttaatgaaaattagcttcttagttttctagtttctgagtgttgaaatgagtgtttccttttccactaacttgttgcccttttttattcttttaaagtctgataatatccacctgttgtgtaagtcatctggatggatttttatttctgacccaagttaaaatagaatgttagacagtctgttactaggcagacatagatagatatccctgaacttgtgacagaaataaaggtctccatttggcaagagtgaacccagagaaccccaaaataatgcttaagaacaaccaaaaaaacaaaatgtatttttatttttaatattctcattgtaaattgtttgtttatacctccacctcccactcctgaataacttactcctttattctgacttcatatagtgacactactgccaaaaatagctccaaattgaaatatctttgaccttgctagagcttgcaacagtgtgatctttttggcaggattaaaaccgtgggttcttggcatcctcatctagcagtcttttactcatcaccttttgtctctgacttcttattagtttctcagttctcctctaaattatgtctctaagattttgcttgtttcccctgtgagatggagctatagcagcttcctaggcgttttttgtcttttggaaagttcttgaaattcaagtattttatttgaatataacaaaaataaatactacctttcagtttatctatatcttgtcacctttatcagattgtaaacttggtaagggtggacacttggcattcattggttccataagttcgttagtaccccttgtatgccagacactgctctagacaggcaatataacatagtggttaaatgtgccaacggtgaggctgggcggggtggctcacgcatgtaatcctagcactttgggaggccagggcaggaggatccattgatcttagaagtttgagaccagcctgggcaacacagggagaccccatctgaatgaattaatgaatgagcaagtcgatcgtggtttggattttggcagtatgaccttgggcaagttaattactttctctatgcctcaaaattcttatctgtaaaacgggattaaaaatgccctcctcaaggataaaatgaattaataaaaacactggttaagcatttgctattctgggcgttgggtatacagcactaaataaagaaagatgaggtttctgttgttatagagcttacattctaattaaagacagaataacaagtaaacaagatagtttcacatactgagttttgctctgaagaaacaaataagatacatactggacctagagaatgactggtggctatttttgactgggtggtcagggtgaacctctgaggagatagcttttgagctgagatcttcaaattctgaggggtaggaggggagaaatatttgattattattttcccttcacagacaagaggcagcattacttggcagaatctcgctaggcagcaaagtgtgatagaataggccctggagtttgggcctggtttggctattaattagctttgtgatctttgatagattccttactcttactgtctttgatagacatgtactttagcacttaaagtttttactgctgggaagatgtccaaggcgctaatagagtataaaggagagaagtataccttgtagaccaggcgttaacctctcagggcaacttagaggcgctcttctttcctggagggggaaaaaaggaaaaagactatttgtttcttggtgggaaaatgaccctgaaagaaagttgactctttatttttatttatttttttttttgagacggagttttgctcttgtcgtccaggctggagtgcaatggcgcgatcttggctcgctgtaacctctgcctcctgggttcgagagattctcctgtctcagcttcctgagtagctgggattacaggcacccgccactacttttagtagagatggggtttcaccatgttggccacgctggtcttgaactcctgatctcaggtgatcagcccacctcagcctcccaaagtgctgggattacaggcgtgagccaccgcccccagctgactcttttgtaataaagagctggaacaaattgatggttctttatgactagatgtgccacatactctgtaactaagttaaattgcatgcggtttcttctcttggaactaggaaacctgtctcacatctcctcattacttttattaacagctgactttagtctcaaagcttctttgcttactgagaaaagactgcatgcaccaaaattaataagcaccctcattcttggtcatctcttacagtattacccagttagggttacatgtcaggttttccatttgctgctgtggcttggtctgtttgggatttgtactactaagaaattccttttgatgaaagagcagagtggtttttaaaaatcagtcatttcatcttttttttttttttaatgttactttctgtttttaaagtttattttatttaaacagttgttttttttgtagaggtgggggaatcttcctatgttgcttaggctggtctcaaaatcctggcctcaggccattcccaccttagcctctggagtagctaggactacaggcccttaccactacatccagctaattttaaaagtttttactttgtaggccaggcacggtggctcacgcctgtaatcccagcactttgggaggccgagccgggcagattacctgaggtcgggagttcgagaccagccttaccaacaaggagaaaccctgtctctactaaaaatacaaaaaaattagccgggcatggtggcccatgcttgtaatcccagctacttgggaggctgaggcaggagaattgcttgaacccgggaggcggaggttgtggtgagctgagattaagccattgcactctagcctgggcaacaaaagcaaaactcctatctcaagaaaaaaaaaattttttttttaactttgtagacacgggatattgctatgttgcccaggctagtcttgaacacctggacttaagcag

SEQ ID NO: 532 - DNA, 1006 bp, Homo sapiens
ccagcctgaaaaagcaggtatgcataaatattgaaaagggaaaccctaaatttatttacctcaggaaattgcttttaaagccatgggaccagcaagactcttagtaactcctaccctgtacccagaatcttgatttagggagtttaaacctcagttttagctcatttggttatgaaagatacctttttaaaatttaatctagtaactagaagaaactaaataattggttcaacaccaagaggctatgcaaccaaaactgagagacaaaattgaattgaaaaatgttaaccaactctgaagtatttatgacagctggaattccgggcagttcttttctccttgttctgcaaatcatttggcacttgctcactgacttggcaaatgaggaaaaaatattttaggaaggcagtatgtgctggggtaggtctagagacactttacatgctatcatatacctagaagagacttttctggaggaatttctccactagaaagtatgcttttataattgattgtaatctgacttctctgtttttagaaacagataaatttgccactggatgttcagtttttatttctggcttatctgtttcatggttttttcttttgttttccctctcctgcaaggaaagtatctatccagagagtttgagaaaccatgcctttaaattaactaactgctgagttctacagaattggagaaaattgattatttccttgtatttcacagactgtatccttttaagtgacatctcttaaataacttcatttgcaatctgcagagactcattttcctgcatctgtgcaatgactgtgagttttggatgcagtatgcccagggccctcactagtaattggtaacagaagcagcagtagcctgtgaggatgggaacatgaattaaaccctccttagtgctggtggtggatcacctccctcaagcatagccctttaatcgggttgtattcactttcataatctgcatctgcctctcccttcttttcttat

SEQ ID NO: 533 - DNA, 1670 bp, Homo sapiens
aaagaaactagtatatttgctaactggagttatttggaaaaaacaaaaatgcatctgttcccagtcagatatgagaaagcctgctgattaactgaagagtttttattctatatgtaaagaaaatattatttgaaagagttttctagtaaattttacttatttgtagccagctgcttaggagtagtggttaatgtcaatgatctatatcatagtagataggaaaagtggatccaagaaccccaatgggtttttacaccaacatacgtaatttttggctttttgatggaaacaaagtttctcatcattgacaagcctgacactcaggaatgtacagttaggttactatcaagtctctgtggttctggaaattcatcttgctctaccagagttatatattgttaaatggagaagaacacaacactagccttctgtgcacaccggggtgggggtgttttttagttactctttgctaacttcatgcgtccttgggtactttatggtccgatagtgccctcttgtggcacctagttaagatcatgtagctcagccacagaaatatgacctaagtagtcagaccatttccattttaaaaaacaatattttatgttttgcttatgtgattttagtaagttcttttaagctttgagcagatgcattctcccaagttttctttggtgtgtacctgttgtaactatacttttaacgatcccaagccttagtggtatcttaagaagttcatcccgcacaagggggagagagctgactaggatagggtgtggagtgttaccacattgtagataggggtcagagtacctgtctaggtaccacagctcacagtttttctctcgtttccaatgacctggagccctgttaaaatccccgtgcctgtgaaactgtaagctattattatggtatattaaaatggtctttgtgtggtttactaccttaagaaaatgttgatagtttttcagtcactgtagaagtacacctccattttaaatgtgctgcaatatgaatgaagtgacctgtgtttcatcacttgttcaaatgattcttatccatgtttttgtacttagtaagggccatacgtagtgggattaaatatttgtgcccttgctttgaaaacaaaactgaaagtgaatgacacataagggcagggatttcagaacagatttttcttgaataaaaatgcttgtgtcaaaaattcaaacatttgtctctttcctttccattccagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatct

SEQ ID NO: 534 - DNA, 1047 bp, Homo sapiens
actctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggcaagtatctcatttcccctgcctggttgtgtttttatctcactagctggcagtttaattgtaatgtgatctaagttagagctctgattaatggtaaaaggtaatccctatttcctagacttttcgttagtaaacattaaaagcatcacccaaggaaacctttaggttaactctagctttcctaccttcctgaatttgtattgcagcataaactttctttagactactctgcaatgatgttttcacatttaaaatttgccttggattctaccaatgtaagccaaagaacagtagagatttgtgggtcagctatcaaaaaaaagtatggtctttgccaaaatgaatggccattggagctcttagaccctctagcacccaccatctactatgttcgatctgcatcagcctatcatggtgaagagctgcaccctcaataccctccagttgaggagactgggcagaatgggaaaggccaaggcatagtccaggaaggccttgttttaaaaccacaaggtgggtgtatgtcccagtagaagccaacacggctgcgtgttaggagaggacatgacagtgcttccgtctttctcccctgggggacacggtgagttggaacatgaatctttgtttgtatggttggatggattgggatggcagagaggttacagggaagttgcactgggaccaggttgtggtcaagagggactaacccagcaagtggctccccctttttttttcttttatcgtatttagcatgttttttgatcccttgattcttcttggctgtattaacacgactttgacttgattaagctttctgcattaatggtacagatgagatgttttgaatctgtacttgccttca

SEQ ID NO: 535 - DNA, 1018 bp, Homo sapiens
gtccaaggttgaacattctatgttaactttgctgaaagcagattttaagtgactgagtgaaggttgggtaagaccttaagttattttttgccctagatcacattacaggtaagtaggtttttgtttttgtttttgagtatcctaaaaataacttttgttgttctctttggttgcttttgtaagacacaactccatggatcatatatttttctcttaattggcaagttcatagaactgtgaatggcagttttcagaaattattacgaagtaaccgcctagaaagtcctttggtaatacaggaatccataagacatgtttttttcagagaatcaaaaaccaaaaacggtaaggcactattttagagcatgctgttaagaagcctcttgtgtctctctcttgtgtttttataaataggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctg

SEQ ID NO: 536 - DNA, 1024 bp, Homo sapiens
gcagtttcagaaaacctgaaagacaaagggcctgtggggccttgcgcaggctgctggagtcccagacagacacagtccttcctgggaggagcattgtgtaccttggacaccccaggagaaacagattttttccactggtgtcataggcaaggactttggcttccttcatcatggtggtggggcagggatcaagggatgtggttagtaggctcagccttctacctgaaagagcctatcccacatggactggccatagggtgggccctaaccttcagactcctgccggctggggactcaactgtgagcagaaatcttggaagctggtaaaattcattctcccggcctaactcccagggaaaacctggaggtgttttctgaaaccaaactagacctctggccccaaagcaggggtctttgctgtgtccttcctatatgggggtagagagtgggtacggggccagagaggagtacgccttgaaggaaagcagactggaagtgtccactcaaagctattgctggtacaagggcagccacttcattcactcaaggccggtttagagcggttgctacttgctggggggccccaccctggtatgtgcctctccccaccttttcccctcaagccaaaagcttgtgagctggggaagggtgggcctggaaaggctctgtgcaaattgtagctgggagcctccgggcaaaagctgagggaaagggagaggcggctggcctaaaatttaggtgggcggaagaacctgtgacggagctgtgaccgctgcacaggccagagaccctggagtcctcctcaccccggggttgggggccggacctgctgagccgggccgccccctctccacacccactcccagcacctggcccgacctatcggctggcggctacgcctcctttaccctactgtcttgcctcaggtcgcaccctgcgcgggcccagtactcggccgtcagagggagctgccaggctctggagggcgccccggaaaccatgggtaagtgcggaggctttgagg

SEQ ID NO: 537 - DNA, 1075 bp, Homo sapiens
cagagctcagatagaagaataacccgaagcagctccttctgcagcttatggaaattgctaacctaaaaatgggcgcatcaggctgggcgtggtggctcacgcctgtaatcccagcactttgggaggctgaggcgggcagatgacctgaggtcaggagttcgagaccagcctgaccaacatggagaaaccctgtctctactaaaaatacaaaaaagttagccgggcgtggtggcgcatacctctaatcccagctactctggaggctgaggcaggacaatcgcttgaacctgggaggcagaggttgcggtgagctgagagcacgccattgcactccagcctgggcaacaagagtgaaactccgtctcaaaaaaaaagacacatcagttttcctggccagagaaaaatcccagcctgtttctgcactcccttattaaatgtccggagaaatgcaggaggctgtacttttctgctgggttgcccttttctgttttccttattattaactatccagcatgtagtctccttcctggatagaaatgcatggtctgctcacatattagacattgaatgatccttttgacttgcccttttatttattaagccattcatttgcttatttctccaaatactgagcatgtgtcagtcacagtgctaggtgctaaagatgcactagggaataaaacagacattgtctctgccttcaggaacatacagattagtagaaaagagctattagaaaaatccacatacaattatgtaattaaaagtataggtactacaaaggagatagaatagagtagtggtcagtgagcatattgtgctttctatgccagatgggcattgtaccaagtgttttacatacattaactaatttttcttcataactaataatatccctatttttcaaaatgacaagattaaggcacagagaaattggacactttgctcaaggcctcataagctagttagtgggatagtctgtttgaacccaggtattctggtttcatagcctgagatcttaactgttttacaagatactatgagagtttctagcaggaggttctaacctaacttt

SEQ ID NO: 538 - DNA, 1042 bp, Homo sapiens
tcttcaccctgccctgcctgcagttgagggggcgaagaagaaccctgtgttctcaggaagactgcctccaccaccgctacccagagaacctctgcatctggcatttctgctctctatgcttgagaccgggaggtttaggctcagataagtgagctctgggccatgagagggtaggtccagaaggtggggggaactgtacagatcagcagagcaggacagttggcagcagtgacctcagtagggaacatgtccgtctaccctctcgcactcatgacacctccccctaccagccctcctcttcctcctcctcctcctcctgtgggaggtggtcagtgggacttagggatctttcacctgctgtgcccagtagttctgaagtctgcttgtggagcagtgttttatgtttatccctgtttactgaagaccaaatactggtttggagacaacttccatgtcttgctcttctacctccctagttagtggaaatttggataagggaactgtagggcccagattctggaggttttatgtcattggccacagaataactgtctctaagctatccatggtccagtggtccctgccaagtctgtagacttcagagagcacttctctcttatggggttcatgggaacaggggtgggtgtgacttgcttggtggcctcattccatgtgtgcctgtgcctggggcatggactttgttaagcagagtcagcagtgaggtcctcattctccagccagcctctctgccctggagaatcatgtgctatgttctaagaatttgagaactagagtcctcatccccaggcttgaaggcacatggctttctcatgtagggctctctgtggtatttgttattattttgcaacaagaccattttagtaaaacagtcctgttcaagttgtattcttttaagttcttttattctcctttccctgagatttttgtatatattgttctgagtaatggtatctttgagctgattgttctaatcagagctggtacctactttcaataaattctggttttgtgttttcttttg

SEQ ID NO: 539 - DNA, 1057 bp, Homo sapiens
caggaggcttgcttcaggtttttaggaaccatttttgcaattggagatgtttgtgaggaaaaaaatctctgttgaggggggtactgtgtgtctctgaagtggcctctgtgttgcgtctcaggcgtcctggtcctgtcctggtacccacctggcatggctgatgataacggggagccctcagatgacctggtgcccgccattctggacaccgcccatcagtacagcatccaggtgagtctccaagaagaggccacgtgctctctgccctattctggagagttgctctcctccgcccacagggttagtgcctctacagaagttcttggcagtagcccaaagggataacaaatatgtggcaagtgtggttttgggggagggttcagataaatggtgcctatgttgctcttagttttttgaattctaagaaaactgagaaaactaaatataggaccaagagaagactaaataattatcacttttgttaaataataatagaggttaggttgtaaaccctggtggaaaaagggtaggcaagagccaaagggacctgcagactcaactctctagtgggaggcagtgctggacctcgaggagtaggcaggtgttctcagcaggtgggctcactttcaagaggaaggacggactggacgaagcatttccccacatgtgccaatcaagtaagtcatcccttgcttctgtggtgaaggaagaaaaatgatagagaaagaagaaaagccccactcccctattcctgaagagaattccaccactgacatgtctaacagatcacagcagttttccactgacacagcttcagcatacttattccactgtttcaggcagctagcaccaaccacttggagctggcacaaggttgaaacctattagccaccctgtaacagcccaccaaaatgattcccacatgccctgctgcgggagatgggcaaactgctcacccctgttttggccttcaagggcagcagctgcctttatctctactgtgcccaccactgccaggccctcttctgaactcagcctctcctccaggccatggtta

SEQ ID NO: 540 - DNA, 1050 bp, Homo sapiens
attgaacgtacgcctcaggggcctgtgtctaggattgctgttagcatacagcatttggttgtctttttgtttttttttttgagatggactcactctctgttgcccaggctggagtgcagtggtgcgacctcggctccctgcaacctctgcctcccgggttcaagtgattctcgtgcctcagcctctcgagtagctgaactacaggcacacactactgtgcccggctaagtttttgtatttttagtagagacggggtttcaccatgttggtcaggctggtcttgaactcctgacctcaagtgatctgcccatctcggtctcccaaagtgctgggattacaggtgtgagtgaccgcacttggcctatggttgtctttgttctagccgtgcactgtgccaacaacttattaatgattttaatctaatagggaatatatcttttaaatttggattttaggatggagtacatattattaaggagactaaggaagaagtaaccccagaacaactaaagctgatgagaactcaggacgtcaaatatatagaaatgaagagggttgcagaagctaaggtaattcactctttgttctgattggttttattggttaagaagggaaacttaaattcatcaatctcaagttattcattaatttcttctggcatttacaatctcacttgattgtaataatgatttagaagtatagttagcatggtagagtggaaagagttcaggtttgggaatgagacagacctagggtttgagttctggcactgccataaattactagccccatgacaatgggcaaattcaactccctgaggctcttccctcatttctgtctcaggcgactgttgcagggattaagtgcgtcttgggaagtgcctagcccaatacctgatatttgttgggatcctttcctttaaaagaataaagcaagttctttgctggctggcaataatgatgtgaaatggtttaaacttttgcagtttttttttttttttggtaccctagaagaatctaatataaagtgagaccatattctgtgttctag

SEQ ID NO: 541 - DNA, 1050 bp, Homo sapiens
taacatttaaacaggttaacaaaacagtgcatgtcactcattggtgtttaaaaatagacaacattgtgtagttaaatagcagagctgaggaatataagatgcctctttcatattcttatcattcctctaaatgtcaaattctttagctttgtagatcatttaggtcagcctttctcaactggggttccgtgagagaattaaaattataattttaaatgaaacaactacttgaacacctttcttctcagttttcctaggactgtacacagctagtactttctagatgcctaggggagaagttaattcattgcctacagtggatgccttgggcagtagggctgtgtccgttctcaactttgagaagggctgaagcaggtgctaataggtagtttattaacctttcgattttacaaaaccatttccttctctttactgatcacctttttactcttttgtaggataaaactcagaaagtgaaggtgaagaaagaaacggtgaactccccagctatttataaatttcagagtcgtcgaaaacgttgacgtgttatagataagccttgtcattctgtatcaaaaatctgttgtcgttttctagtaacttcaaattccattactccaaatggcatggttttccggtttgtaaccataactaaattgtcagtctgacatttaatgtctttctatggacaacattaaatctccctcccttctgtaattgtttttggattgtgaaattagtcttatttttatatacttaattttttttttctttgagatagggtctttgttgccaggctggaagtgcagtgtgtgattatggctcactgcaactttgaactcctgggctcaagtgatcttcctgcatcagcctcttgagtagctgggaccacagacatgtgccaccatgtctgagtaatgtttaaattttctgtagagaccaggttttgccatgttggccaggctggttttgaactcgtggcctcaagcgatcctcccaccttggcctcccaaagggctgggattacagggatgagccactatgcccagc

SEQ ID NO: 542 - DNA, 1112 bp, Homo sapiens
tgtgtggcccaggctgtcatgcagtggctattcacaggcgggagtatagcaccctatagccctgaactcctgggctcaagtgatcgatcctcctgcctcagccgtctaagtacctggtaccacaggcgtgcaccgccatgcccatctgctcacaaccctttacgagctcctgtgacacaagataaaagccaattacttaccatggccttccagaccctttgaaggtgattcaccctcttgcttccttacagatcttccctcctgccatgtgtggctagcacgtgctcctatgttctagccacaccgtaactccttaaacttgctaagcttatttccaccccagggcctttgcttgctgttccctttgcagggagtgatttgccatctctccatatgttcactctctcacttgattctgatttctgctaagatgtcccttcctcagggaggacttttctgtccatcatagccaaaacaaatgcctctgtgctctctaatccctcgggcagaacattagctcttatgtaacattacatacatggcctagggtttttcatcctgtagtcatgaaaatcccgttggcacttgggaagctcttagagatacctagctcaatcctctctttttatggagggggagatcgaggtccagggaaggaagaaacttgcccaagttcataggtatagaaataataatagccagctgccatttattgaacatctgctctatgctaggggtttcacatccattcttttgtttattcccattattttcttagtagtctctgattttgcagttgaagaagctgaggctcagagaggttaggtgatttgtctgaagtcacatagcaggagggcatagactgggattcagacccagatctgtttgacaccaaagattgggttgttcctctggcctctgtgggttcccacattccaggacccaggtcctgtgtctcaggccagaagattttctatattggctggagcttctgtgggatgcaggcagtggatgagaagggaaacgacagcaaatagaggaagcacaagtctctggcctcagtgttgggtgcacacaaagcaaatgggagaaggaggagaggggctcccttc

SEQ ID NO: 543 - DNA, 1057 bp, Homo sapiens
aaagggctcagccatttgtctgggcaggtctgcggaactcaaatccggctcatctgcatctcctcaaataaacttctgggaagtgaatgcctgaagcaggcagagtgcagagaagtcagcaaatatgtgcgtagtgaattccaagccttctgttcccagctcctgggaggggccgcagtgccttggggtgtcctgccgtgtctccatcgggtcccctgcctggctgctctaaccctgaggaatggcctccattgtgggcctgtggaaacagggagaagaatctcttatccagcaggtctgagggccacaggaacataagtaacactgaagagtgaggctgatccctggggtttgcgcgagcctgcaaatgcatgattcaacagcactcgcctggtgcctctgggaggcaagctggatgaggatgttgttcccattttatagatgaggaaactgaggctcattgggaagggactttcccaaggctatgttatgagttagttgcagagctttgaacttgggcccagactgagcctgaaacctgaccttacactgagtcccagccccagtccctgaacatggtctctgaacatggctcagattttgccccaaaagcatctggaccaggaggttggagcggcctgggataccccctgaatactttcatactaattctgctatggacagatgcctgcaatcccctagaggcttggacattttccaaaggaaacttttactgaagaaagatcatctttatttatgaaatacttattccgtgctgggcaccatgctaagcactttgcatgaattatctcatttaattctctgaacaatttataagtttgaaactatcattatcctcgttttacaaatgaagaaactggggctctgcgagtaacctttccagtatcccacagctagtacatagtggagctaggattcaaacccaggtctcgatgcctctgtaggatttcattgttaagctgcactgcctaacagggaccagaaattgtagtttttcttcttctcctaaaagcaaacatccaggctgggcacagtg

SEQ ID NO: 544 - DNA, 1044 bp, Homo sapiens
tataaacctttaaaattgctttgaaactaaaatttcattccagttcatgactgcactgttcaaatacttgatatgcaataaactatatcttcccaaagattcatttgcttataaggaactttcttcctctccagcaaaagtttactgaaaatacccactgaaaagtagataaagagttaagtgacatgtcttaacttaaccagccaataaacaactactaatgtctttgagttaaaaggttccaaagagttaactagcactacacattgtggaatcttggataatttaaaataactgcattttcttttatgctaagtgtggttccttgcaagaacactaggctaacattagggttctgccaactacctgttggagttgagaagcttattagacttcactgtgctttcgtttcctcacctataaagtggcttgtgtacttgtttcacttatctcacaaagttgttgagaagataaaatatattatgagaaatacttagagtaatgtaaaatacattatgtgattaagaatgtggtaagacctgaaagacttaagagttgactaatttgaagttcatgaaaattctcacaggactttgaaaaaagaaaaaactggctgggtgaggtggctcatgcctataatcccaacacttcgggaggccaggccaggaggaacgtttgagtcatgagtttgagaccagccagggcaacataatgggaccccatttctacaaaaagtttaaaaattagccgagcatggtggcaaatgcctgcagtcccagctactcaggaggcagaggtggggggattacttgagcctgggaagtcaaggctgcagtgagacatgactgcaccactgcacacaagcctgggtaacagagaacctgtctcaaaaaaagaaagaaaaaactttagcactagataaaattaagtcctaacaaatttacagagggccgctacatatggccttgcaaactatgaaccatacaaattctaagaagtgccatttacaaagcagtcgccccatattggcctacttaaaatcaa

SEQ ID NO: 545 - DNA, 1048 bp, Homo sapiens
tatatgggccattgtaaggacttcaacctttactgagtgataggaagtctttgaaagctcttgagcacaggagtgacatgatagattttgtttgtttgtttatgacagagtctcaactctgtcgcccaggctggaatgcagtagtgcaatctcggctcactgcaacctccgcctcccaggttcaagcaattctcgtgcctcagcctcctgattagctgggattacagacatgtgccactatgcccggttaatttttgtatttttagtagagacagcatttcaccgtgttgacaaggctggtctccaactctcgaactcctgacctcaggtgatccacccacctcgacctcccaaagtgctgggattacaggcttgagcaaccacactgatggttttacaaagattattctagctgccatataggaagtagactataagggagcaagaacaggaactggaagaccagctggaaaaatactattgtagcaatcgaagtgaagaaggatggtggcattttatacataaagaaaccaagacaccaagactccactctcagccaccacactaattgcctgtaattaccatcgggagttctgaaggtgtcaggccatgaaaggaaatcattccatattctccaataaaactgtgagagccagaagttaggcagtcgtcaagtaagtcggatctgcactgcaaaaggagcttccgacttcttggcctagaagaactctgccctatatgtgtagtgcttggaaacatctcttgcagctatcacattccacacccatcccctaattccctatgctctacttagtgagccactgtgtcctaggagatgaaaagacctagtccttgcctttgggaaaatagcatcaggacatgtgctctgactagattccctttcaatactgtattgattgatgttgaagtcactggacagaaattgaggtcgaggaaatattcaatattcatttagttgtaaatgactattacacaaagtgctagattcatgaggctatataatattttctttttttttttttttcaa

SEQ ID NO: 546 - DNA, 1557 bp, Homo sapiens
acggctgtaatctcatcactttgggaggctgaggtgagtggatcacctgaggtcaggagttcgagaccagcctgaccaatatggtaaaaccccatctctactaaaaatacaataattagccaggcatggtggcatgcacctgttgacaggagaggctgagacaggagaattgcttgaacccaggaggcggaggttgcagtaagccaagatcacaccactacactccagcctgggcaacagagcgagactccgtctcaaaaaaaaaaaaaaaaaaaaagaagaatatttacaactttatacacattacatattacatattacaaaattatatacatttccaaagaaacacatttcaaatacagatgcacttatattttattaatctggtatgtgttgtaactcttcccattttcaatagtaggtaaaccaggccaaagaacttttagaaatgaagcagactgactgaagaccccgtatctcaggtgacaacaattctgtgcccaaacaatgtgtcctctgattctgggtgtgaccctgaacaactgaggaggcagctcagctcctgcagcagctctgctgcctcccagatactcactctcccttctcttaggttttgaatttgttatgaagaaaaaagttaagaatagtataaactataaacaagtgaattattttatctcagagtgaaatattagcgttcttatatttaaatggtcaataaactaaagagtcccttcccacagacatagttgcctctgttcctgtaatggggataatcgaacccttcatagaaattgcaaaatcctgttttcttactatgtggacagccaaaaacatcttaggctttatcaggtataacctctgccttggctttcaggtctgaccccagggtctgtcattcttccacagccctccaggtggagagaacttcaactggagcaggtctgtcaacaccagttaccacccccacctttgctcttgttttcttccatgctctatggcctgctgtcatctggaatctacctttactctcagactcagctgcacttccatcccctctccagacagcattcttcctaacctcctttagcatgtgattctagaatgcttggagatttcaaaagccacattagtcaccctcttggtctgggcttcttgaacggttgcccgctgccacctgccccccgctcccccaactctctatcattaatcctcaactatcagctatcactcaatacttactggatcagttttttttttaatctgaaaatttagaaattgaggaagaaaagagattatatcagtggtttccaagttttccctctgcagacaaaatcacatacagcttccaatatatgaaaaagtccagtatataaaatataagtgaagctattgtggttcaagtagagggggtgcctagggctctattctcttggcttcccccactccataaagatactaaaagccaaaatacatcacgtaggcatgtctaagaaccacccatgagagcctgtaaaactccttcgtttacttctttctgcttagtgctgtgaagtg

SEQ ID NO: 547 - DNA, 1004 bp, Homo sapiens
gtgagccaccatgtacaggctttttttcttttttttaatactgggtctcgttatgttgcccaggctggcctcaagtgatcctcccaccttggccttccaaagtgctggattacaggcatgagccacagtgcctggcccatagcactcttgtttttttgttttgtttttctattttttttttgaggcagagtcttgattgtgtttcccaggctggagtgcagtggcacaatctcggctcagtgcaacctccacctccccggttcaagagattctcctgcctcagcttcctgagtagctgggactacaggcacgtgccaccacgcctggctaaatttttttatttttagtagagacggtgtttcaccatgttagccaagatagtctcgatttcatgaccttgtgatctgcctgcctcagcctcccaaagtgctgggattacaggcataagccaccatacccagctggcccataacactcttaaagcatctcctacattgttctagtatttaggctgaaagttagggactttgactatgtgtggaaccacttgaattcatgtcagttcctggactgtactgtcacttgttatgacattattgttacctttagtttttatttttacaaccttatcaggtaggtatttaatgtttacattgaagaagtaaagatcctgaataacttctcaaggttatagtcacacagctagtaagaagcaaagtggcattgttaatacctcccaccattaaaaaaaaaaaggtggttatagcaaagtatacactagaataatttgagttgtttgagatggatacaggtatctctttttttaaattagtaggtacaaacaaagaacttgaaaaccacatccttttagattctttgttgtttctaggagtgtatttcaaggtggttagtaatttgtgtttcctgggctccctttaatagtgttagcaaatttgctttgtgattaccttgacttataatctccccacacactgagttgcctc

SEQ ID NO: 548 - DNA, 1940 bp, Homo sapiens
gagaatcgcttgaaccctggaggaggaggttgcagtgagccaagattgcaccatgcgctgcagcctgggtaacagacggagactccatctcacgtggtaggtgagccaccgctcctgaccgagaaaggatttctatgcattgttctttagttatagttctcttttccttgagttttgaaaaagcgcaaaaactgcttatctgccataaactggaagaacctatttaatgaaaaagtttggtgagaagaaatcaggagaataatatcaaacagtgttctagagggctacttagcatgattatctaattttttcttagaaatttctcagttgattgccctcttgtggtattttatttacttatttttttaaatcttccattacagccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacggtaaggaaatgatggaggtggaagctgaattactttcttgttcctttgggactctttttttttttttttgagacgaagtctcactcttgtcccctaggctggtgtgtgatggcgccacctcgtctcactgtagcctctgcctcccaggttcaggcgattcgcgtacctcagcctcccgagtagctgggattataggcacctgccaccacgcctggctaatttttgtatttttagtagaaacgggatttcaccatgctggccaggctggtcttgaactccagacctcaggtgatccgcccccctcagcctcccaaagtagtgggatcacaggcatgagccaccgtgcctggcctcctctgggattactcttaagtgtttttagtgggtcattgagcagtggcttgccaaatgtgaattggcaaagcttttctggtgaaatacctttcctactttggtaccatgatgaggaaattaaatgccttcagatatgaggatggtccattgttcctcagcattctttctcttctcccaaattttccttagtattttaccctgctttagccaccaggttagaaattgcatgtgtgtgtatacccattttttcagttggctgtgaagcagagaatatcaactagttttggatgttgacccttgaaaatctttgggtgaaaatatgttcaaatccattgaatcctcattggaaaagaggtttaaccttgcaaatccattacattcaacatctttggattcattccactctgaagaagatggaggtgttaatgagattgctgtacatgagcgtgaacaacgatgcagtggaaaagggatgttaacagcttagtgttcacctcctcaaaagttgaatgagttggccaggcacggtggctcacgcctgtaatcccaggactttgggaggctgaggcgggtgtatcacgaggtcaggagtttgagaccagcctggccaagatggtgaaaccctgtctctactaaaaatacaaaaattagcagggcatggtggtgggtgcctatagtcccagctgctcgggaggctgaggcagaagaattgcttgaacccgggaggcggaggttgcatggagccgagatcgtgccaccgcactccagcctgggcgacagagcgagactctgcctctaaaaaaaaaaccaaaaaaacaaatttaaaaaaatcccatgcagtggctcatgcctgtgatcccagcactttgggaggccaaggtgggcggatcacctgaggtcaggagttcaagaccagcctggccaacatggtgaaaccccgtctctactaaaaatacaaaaattacctaggcatggtgacaggggc

SEQ ID NO: 549 - DNA, 1028 bp, Homo sapiens
gcctcagcctcccaaagtgctgggattaaacttttgatattttaaaagattttagtatccacaaatatgcctcttaaaggtttttgcaaatatccatattgctatatatattaagaacattttagttgttagttttcagagaggttatgtatactaaaaatttgtttgaaagcttgggaagtgatttcatgttaattctttaaaggcggacttcatttcagaggccccgtaagatgaaaggccttttgtagtttaaaaatgaaaccaaaattgatctgtttttccagttctcactttttggcacatatctcctccctcagtttaattaccattttcctttgacagatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctatttgttctattttctcttggatcatgactttcttttcttttctttttttgtttttgagacagagtcttgctctgttggccaggctagagtgcattggcacgatcttggctcactgcaaccaccatctcccagattcaagtggttctcctgcctcagcctcccaagtagctgggactacaggcatgcaccaccacacccagctaatttttgtatttttggtagaggtggggtttcaccatgttggctaggctggtcttgaactcctgacctcatgtggtctacccacatcggcttcccaaagtgctgggattacaggcacgagccactgtgcccagccatatcatgcctttctatactgagattataacctattttttaaatttgattttaaaaacagttgaaacttttagacagttcctaaaaaattagcagctatggaataataactaacatttaatt

SEQ ID NO: 550 - DNA, 1026 bp, Homo sapiens
acaaaaaattagccgggcatggtggtgggcgcctgtagtcccagctactcgggaggctgaggcaggagaatggcgtgaacctgggaggcagagcttgcagtgagccgagaccgtgccactgcactccagcctgggggacagagcaagactccatctcaaaaaaaaaaaaaaaaaaaaaaaaaagaggggaggccaggtgcagtggctcacgcctgtaatcccagcactttgggaggccgaggtgggtggattgcctgaggtcaggagttcgagaccagcctggctaacatggtgaaaccttgtctctactaaaaatacaaaaatcaggtgggcgtggtggcgcacacctgtagtcccagctacttgggaggctgaggcaggagaatcgcttgaacctgggagtcagaggtttcagtgagccaagatcacgccactgcactccagcctgggacagagcaagactccatcacaaaaaaaaaaaaaaagaaaaaaaaaaggaaacgttcagtgaagttgaaggtagatcaaagcatacaaagagagatggcaaaaaaaaaaaaaaaaaaaaaaaaaaaaaaaaaaaaaaaagccaatacaggaaatctcaaaatcaggctgctttaaagaagccaaaagaaatatatatatacaacccgtatagtgtgtatgcacaataagatacacacatacacaccataagattctactcccaagaaattgaaattcaagaacaggcaaactaatctctgaggatagaaagtaaaacaacagttgcctaaagaggggatagggattgaatgggagaggacataaggaactttctagggtgatggaagtgttctatatcctgaatatagtggtgattaaatggatatatgcaatcatggagtctcatgaaagataccttttttttttttttttttttgagacagagtttcattctttttgcccaggctggagggcaatagtgccatctgggctcactgcaacctccacctcctgggttcaagtgattcttctgcttca

SEQ ID NO: 551 - DNA, 1124 bp, Homo sapiens
gcaggcatgtgccaccacgctggctaattttttttttttttttgagtcggagtctcgctctgtcccccaggctggagcgcagtggcgcgatctcggctaactgcgagctccgcctcccggggttcgtgccattctcctgcttcagcctcccaagtagctgggactacaggcgcccgccaccacgcccggctaatttttttgtattttgtagtagaaacggggtttcaccatgttagccaggatggtctcgatctcctgacctcgtgatcctcccgcctcggcctcccaaagtgctgggattacaggcgtgagccaccgctcccgccccatgccagctaatttttttgtagagacagggcttcgccatgttgtccaggctggtctccaacccctaggctccccgccttgccctcccaaaatgtggagattacaggtgtgagccacaatgcctggccattttgaggaatttttaaacactggctttaatttttcaaagtatctggagcaacttctgcttctgagagatagagtagatattcttttccccagtcctcctgctaagtacagctaaaaaccccaaaaacactctatattatacaaaatgaacataagatgactctgaacaagaagaaagcagattggttagggacctccagatccaaggaatgactcagcagtgacctccctaagttttctttttgcctcatatatgtcagaatgggtactggagaagccagcaacccaaaactgccaacgattgcagacaaaagccccaagaaaagcttgtcttttttttttttttttttttgaaagagtgtcttgctctatcgcccaggctggagtgcagtggtgcaatcatggctcactgcagccttgatctcccaggcttaagctgcttagactacagatctgcgccaccatgcctgactaatcaatacagttgttttttttttttgaaacggagtttcactcttgttgcccaggctggagtgcactggcgcgatctcagctcactgctgcaacctctgcctcctgggctcaagcagttctcctgcctcacctcctgagtagctgggattacaggcatgcaccatcacgccctgctattttttgtatttttagaa

SEQ ID NO: 552 - DNA, 1044 bp, Homo sapiens
ggcacgatctcacctcactgcaacctctgcctcccaggttcaagcaattctcctgcctcagcctcctgaatagctgggattacaggtgcacgccaccatgcctggctaattttttctatatttttttttagtagagatggggtttcaccatgttggccaggctggtcttgaactcctgaccttgtggtctgcctgcctcagcctcccaaagtgctgggattacaggcgtgagccattgcacctggcctattttattttttaactcttttctctccttttttttttttctatctcctaccagaaggaacctttaatgtttagaaaaacgttgatttatatcttatttaagctttataatatcctgaaggatagtattacacagatgaataaatttaggcacagagacttaaaattactgtctaagagccaggctccagatttctgggtgaaggtttcacattgtatcacagaagggagttttaaaatcacagtagatgacttgggctaagtgagaaattgtgaaaatgctttaattgttagtatcattattgttgttagttttagtttctgaagtatagtcacacactttaagtgacatacatttccagatctctgaactgtggagaatttcttttccccttattatgggagaagttttacgatatataaatcacattgaaattttcatacaaaaataatacaaaataaaataaaatacaaaaaatacaagaaataaatacaaaaataatttttaaaatagtacaaaatgatgaaattttgttaacacagtgattggaaaatatgggttgaggatttgggattgtttacctaagtgacgctctgaagcaaccttttggttatatgtagattcagcttatttatcctttttagtggatgttgttcttttttttttttttttttttttgagacagggtcttgctttgttgcccaggctagagtgcagtgtggtgagatcagggctaactgcagccttcacctctcaggctcaagtgatcttcctacctcagcctcccaagtagctgg

SEQ ID NO: 553 - DNA, 1050 bp, Homo sapiens
ggccaggtacggtggctcacacctgtaatcccagcactttgggaggccgaggtgggtggatcacctgaggtcagaagtttgagaccagcctggccaacttggcgaaaccccatctctaccaaaaatacaaaaattagccaggcatggtggtacatgcctgtagtcccagctacttgggaggctgaagcaagagaatcgcttgaacccaggaggtggaggttgtagagagcccagattgtgccactgtactccagcctgggtgacagagtgagactccgtcttaaaaaaaaaaaggtcccatcgttgctcactccattttttcccaagcatctacctgttggtcagcttgcctctctatcccctgcccctacacacccccacccaacaaccacagaaagcatattgtctaaagctctgtatactttactgttttttttttttttttacaattttccacattaatatgtgttcataatatgaaaagaaattattcaaaaatataaatcagttggcttccctggtggtctagtggctaggattcggcactttcaaaaatataaatcaaagtccatgactctaaaaataacatatgcattgatatgctcgcccctttgacccttctctcaagagaaattccctgccaagtaatccacatacataagaagtgtaaaaagtccctagattaaaagagcataaaacttcattatggaaacacagtagtcccagctatttgggaggctgagacaggaggatcacgagtccaggagtttgaggctacagtgagctatgatcacgccattgcactccagcctggatgacagaggaaatattaattttagagtaatcagagaaagccgcatgaagaataaattaataagtatttattgaatgtctaccatgaaccagggagtaggtgatgtgctgagaagacaaagatattgtccttgtctctctatgatcttactgttaaatggaggaaacatattggcaaactgacagttactgtctattgtagggagggctatcatatagataaatgctgatgctgtg

SEQ ID NO: 554 - DNA, 1014 bp, Homo sapiens
taggcaaactggcttctctggtgcaaaccagttgttaattgccatttattttctttgctataaaactgtaccagccatctacttactttctcattagagtgaatctggagaaaaggcttaggttagatttaggaaatccaggagaaaaatgcaggacagtcagagtaagaccagggatgggcataatcctttctctcacttgtcttaccagccctagaccttaagggtggccaggacctccttgcatttgccagtagaggttgctattgaagtagtgtaaaacctcttgtttctattcctgctaactccttttgccccatcttatttttctccttcactgacaccctcctatcacacacacattattggttagttatcattcccatctctgaggttcacatatgcagtggaccaccctgcctttagctgtccagactttgactgcaacctgtctttctattccactcctcctcccctcccccaaatgatttgaaatggagaggaaaggaaatggagtttgatggttttaactcttctgtggctgtggcttagggagcagaatgttttgattgcttgatttaggggtcttgaggtctcctaatacaatattctttttgttaatagaaaggccccactccattttttttttctctgagtattttggactcaaagtcttgtgttgaaatgtcggtacctgcccccgaaggggaaaagatccctttcagagtttatttttcccccccattcatggggaattcttctcattatcagaagatgaagattactggtcctttgaacagagtataaatatagccaacaccctaatatatttctaatgattgggctttagctttaaaaacattaggctagatgcctccctattttttgtggcatgatttagctgtaactagcctggaggcaataacaatactaaatgaccttttgtagtcacattaaacattgaaatggtactgagactgccttggtggggagttttggcctatgggaatgatg

SEQ ID NO: 555 - DNA, 1053 bp, Homo sapiens
cctagagcatggcttggatcctgatcagctgatttcctgtctctacagggatgtgatgtgattcctcccccttccttctggaagaaatggatattttttttcatttcctgtttgatagcatattttctgagtaccaggagacacttgatgactataaaacatttgatgtgtggggggtgggaaggaaggaggcttttgttttcagcagaatggctttcatttgaggaattcaaagcacatacatgaacccaagctgttttgttcccatgggagagacacaggctctaagaagattgtttcgaatccctttcctgggctgtgtctacttgacctgcactggtagagccccttctcccccataggttagaaaagctcggtccctcatggagctctgcatgctgtggattctgctcttgccacatccgctactcagccctttttgtgcctaaatccgctggagagcaactattagtccctgggggaagtgacaccacccttggaatggaacctggctggatgccccttgatccctgactgagtgacacagactgggacaggaatctggctgtccagatttcctgtcctctgtcctcactagccgacttggctgcttccaccctggggctgggggtatggggtgtggtgggagctggttgctaacaagcagcgccgcctgtggacctgcacagccacttgttttcctagccaagagctacccgtccagtctggcctgttcctgatccatctggagtgagagcagagacctggaagagagatcagtggggaggcagtcattgtgatcccttttgtttgtagtgaagctttgcttagtgtttgagggcctggggtttaattttgtaacagactcttactatagttgtgtgtgtttaactataagattttcttttcttctcttttctccttcctcgtcctcctcctcatcctttctcctcctcctcctcctccttcttcctgtctgtttttatttttcccaactttataaaggtataattgatatataaaaattgtatatctttatggtgtacaatgtga

SEQ ID NO: 556 - DNA, 1047 bp, Homo sapiens
aaaaagacaaaaaatagccaggcatggcagtgcgtgcctgtaatcccaactactcgggaggctgaggtgaggcaggagaatcacttgaaccggggaggcggaggtcgctgtgagccgagatcgtgccactgcactgaagcctgggtgatagagtgagactccgtctcaaaaaaataaaaataaaaataaaaataaataaataaaataaaataaaataaaaaataaaaggaggcattgattttgggaggaaagatacggattcacttttagtaatttcagttctgtttgctgtgacatgctccggtggaaatgttcaagcacttggcactacagagctgcaataagaagagagccagggttcagtcatcccagcccgatatttaaagtcctccataattgcctctctagcctcctctccaaccactttctcacttctaagccagacaaaactgtcttaatcttatcccattgttcaccacctgcctcaaagccctgtaggaagtcttctttgatctctccactggaagttagttccagttttctaaacttaatgctagttgtattttttttccatatcatttgtattatactttaacatcctatttgtatgtatgcattattttcttctacaggattttaaactcctagaacctgggactatatcatgaacttttttttttttggagactgtctccctctgtcacccaggctgaagtgcagtggtgcagtctcggctcactgcaacctcctgcactcaagcaatcctcccaccccagcttcccaagtagctggggttacaggcgcatgtcaccatggctggctaatttttttgtatttttactagagatggggttttgccatgtgctcaggctggtctcaaattcctgagctcaagcgattcgcccaccttggcctcccacagtgctgggattacaggtgtgagccaccgtgcctggcataaactcttttttgtctctcacattactagttctgtattttgcacagtgtcaaaaaatatttggtgatttacaaagtaaatggaatctg

SEQ ID NO: 557 - DNA, 1622 bp, Homo sapiens
aggtccctgaacctggcacctgcttttgttactggctccttaagtcactggagacatttttgctgtttcctgggttagcagctgctttgggataatagtagcaactggttgtcaggatgtcagttctgcctcaaagaaaatcagtgtatttatatgaggagagttaccttttctgttcttaaatttcttcagggtttgtctgaagagtgagcagttggaagtcagctgtgcccttagtttgatgaccccatgaccctcatctttgaatctgaggagacactgccatttctactatccaagtactaaccaggcctggccctgctcagcttccaaaatcagacgagatcaggcgtgttcagggtggtatggccgtggacgagacactgccatatttttttcgtcctgctctccctctggtgagactctgagttctgggttctagcatgtaggtcagtgcctcctacctggtaagcattcaacagatatatgtgggatgaatgattgaatgaattccttgatcttgctgtccaggttcagtttctctgacactgatacgtgggtgctctatgggagggggacctttgtttttaggagaaagattgcttcaaaggaattatggaaggtgttgatttctagggggctttgggggaactatgggaactctaagatatgattcgttctcgcctcattggtctagatctttctcctcgatagtaactgtctgctgacagacttgccctgtttcaggagcagtatcctgaacctgactcatctgggctctgtccttgagcagggtaagggattttttttttttaacagccatcctgtcactgtagattcagaagccctcaggaccacatctcaggcactgtagtcttggacttcctgatctggctgcattcagtcaagttccactcagctcttaggtgtctgtgcctttgtaagggctgttggagacagaagggctttttttccgctttgtcagcagctggccagagaatgcctattagtctgccagatcctaagtctttcacgtttccctgtctgtgtctggaacttagggcagaatctcttaccacctgaggttacatctcactatttgcctttgtgggacccattggaggataaaagatgaatagccatgaaaggcatgcagagttattgaactatggttctttgaaatgctgtgactctgaggaaagatccctggtctccaagaatacaactggagccagaccattgcaccaccaccctcctttcccaagagcctctttggaaccatcactcattccatagttccaaacatccttgtttttgtttaatttttatctgataaatgttatgaaacaattttaatggtgaaacacacagaggaaatgacaaactagcatgtgttgtcttttaaatgcacttagttcaagtggttaagtcagttgttcctgttgttagattgctgttgtgtagtcgactttccttctttaggtgggaagagtctctgaatagactttaaaaaagcaaaaggaaccagctcttctttagctgattgatcattcctttacatctgactcttttcagcacttaaattcagattgtactatgctgattgctttcagatcatgaca

SEQ ID NO: 558 - DNA, 1157 bp, Homo sapiens
aattagccaggtgtggtgacgggcacctgtagtcccagctactcgggaggctgaggcaggagaatgtcatgaacccgggaggcggagcttgcagtgagctgagattgcgccactgtactccagcctgggcgacagagcgagactccttctcaaaaaaaaaaaaaaaaaagccaggtgtggtggcaggcgcctgtaatcccagctactcaggagggaggctagtgcaggagaatcacttgaacccgggagacccaggttgcagtgagccgagatcacacctctgcactccagtctgagtggcagagtgagactctgtctccaaaaaaaaaaaaaattctcactttcttcttctaaatccattttatagcacacaacaattcttctcttacccagaatgcttatttgtgtgttagcttgtcccatttcttagtcattttcgttattcaaaattatttaaaggagaattgagagtaggaagggaagacttctaatagtcctcttcgtttaaattctgtaatcatagcttccactctcctccttttaggtcctctaacttttgattcttataccttgcatatgaggctctttccttctttttccccccattttagtcatttttctgtagaaaatttctgcttatgcttggggagctagatatgaattcttgttatacttactaagcatcactggttctatctctagatgtttaatagtcaggtttttagatcaataggtttttagatcaatcccaaattcatagtgtcatgaaaagatagatgaggaactgagcccacctggagaagtcaaaggatacttgggccaagtgatataactagttattgacaagcttaaaccatgacccagggttctgatgtacagttgaatgcctttcctccaaatcacattgcttgctgttgaagccttggctaggagtaatctttagtaagatccttgaattgtgactttttttcttttgtttaattttattacagttccttcctttaacaaaaatgctaagtaatataagctttaagagggttaaaattagtccggtttcaaagatatatttgagaattatgtagtatctcttgagatagtctagagatcttagagctacgttggggcctaaggactgagaatcgctgtcatcagactag

SEQ ID NO: 559 - DNA, 1039 bp, Homo sapiens
catcagtccctggctgtcatcattttgctgtgcaaaaagggaacatcagagaggggtccaggagccactccacatatcattcgtaaatgttattgctaatggagagagggatgatggtgggggcaggcgtatttgtgttcatagaggaaggtaggactgtaatctccatgcctagtttctgattggcattgataatataaccatctttcagagagtcagctccaagaggtaactgggaaacatctcagttttgctccgggcactatttcctttgccatctataccagaagctgtggtgaatgggaaagccattgctttctgaagtgcccttaggcctttctcagtgactcttaagttttaagaatcatttgggtgagcataatgctgaaatcctgtagctatgaaagctgcactgccatggcaataaaactccccattgaataagtaaaatggcaatttccaggaatctgggtggtagttatttcaatcaagttgagaaatgggatcaccgagagggggatttccgcagaatctgggctgtcagggaaatctttaggctgtcagggaaatctttattccccattgtcttctccttacaaattccaggagaggagtatgaggttatatttgtgtcctcagtaagcccataaaggtcagccagtgtgctaccttacattgtaattttccttttcaacattcttttttttttttttttggttaaattttactttaagttctgggatacatgtgcagaatgtgcaggtttgttacataggtatacatgtgccatggtggttttcattcgtttatgtactgaacataatcttagtacctcacagacagtgcacatgtactaacacctttcctgaaaccttaaaatataagaaatatagaaatacaggtagtttgtaagtctttgctcttggggaagccaattttggatttcctttgtctttttgtcctatcatactccttgaaaggggtagtaaaagcatttttctctttttccctctctgtagttcaccccagtggggcacat

SEQ ID NO: 560 - DNA, 1012 bp, Homo sapiens
gtgcatccccacacccagctaacttattgtattttttcataacaacagggttttgccatgttgcccagggtggtctcgaactcctgggctcaagaaatctgccctctcggcctcccaaagtactgcgattacagacgtgagccaccgccttgtgctgtctctctttttctctttctctctctttttgataaaaatcaggatcttgagtattctggattttgtcaaaaactgagctggaggtggtgcggtggcctgtaattccagcactttgggaggccgaggcaggtggatcacttgaggccaggagtttgagactgggttggccaacatggcgaaaccccgtctctactaaaaatacaaaaattagccgggcgtggtggtgtgcctgtaatcccagctacttgggaggctgaggcacgagaatcgcttgaacctgggaggtggagtttgcagtgagctgagatcgcaccactgcactccagcctgagtgacagagtgagactgtgtctcaaaaacaaacaaacaaaaaaaccccaaaacaacaacaacaaaaactaagctggataatagttttcttcccaggcatatatgagcatcagagacccaaggattataggtagggaaaaaatgtaggcaactgtattgaaggtgctctgatttttaagaaaattttaaaaattcactggatatgatgtatttggggtgattctttctttctttttttttttttttttttaacctagcagtaaagtacaggcccagttgggtcctacttaaagttttcctgtttgacaatttatcaggaattattattgcttaagatagctttgaagtaaattgtctgtgtcaaagaccttcctccacttctctcacttacctagctcttggcagctgtttccaaaatgtttgcactaactccatagattcatgtctgaaggattagatactccaggaacatctattgggagaaagtttaactacaactgttgtccatttttcaattaatgtgcca

SEQ ID NO: 561 - DNA, 1057 bp, Homo sapiens
tcttctgtgtctatctatctttgtccagtaggggtcactgagggttaggctctcaataagagaaacactaatctagtgataaatgagctggattccttgtctattgtgacatctttgtatattcagtactatgttttttaaaatattagagcagaaacaaaaggcgtgaacttgtattaagaactttatgggcgaagcgcagtggctcatgcctgtaacccgaggcgggtggatatcacctgaggtcaggagttcgagaccagcctggccaacatggtgaaaccccgtctctaccaaaaatacaaaaaaattagacgggcatggtggcgcatgcctgtaatcccagctacttgggaggctgaggcaggagaattgcttaaacccgggaggcagaggttgcagtgaaccgagattgtgccattgcactacagtctgggcaacaagagtgaaattccatctcaaaaattaaaaaaaaaaagaatatttctggacaaaaataacaatcctgggcaagattctggaacagtccccatagacagggcttcttttcttcgtatcatttttttctccatttctttaagatgttggctaccagagtttcctggaaaaagcttactagatagatattatttcattggggaaaagggtcaaaatgccagagagagagattacttaaaatggtaatatggctgttgaggttgactagatattcttgtcctttccctttttgaagcaatgctgtcgaagcctaatttgacttagtcattgagctgttcaataccacacattactttcacttaccttcttgcatttgccactgaggatgacttgatgccctgctaggaggtctcttgtgtggtaatcataataacaagagttggcattaatgagtcaatgtttaatgctttttaaatagttaatgcttactgtgtgccaaatatattatgcattttctcacttaatcctcactgtaacactgtgaagaggtaattttattatccctttttgacatgagataactatggattaaagagattaagtaattggttcatagata

SEQ ID NO: 562 - DNA, 1021 bp, Homo sapiens
gcatggtgatgcatgtttatagtcccagctcctcaggaggctaaaccaggaggattgcttgagcctaggagttcaaggctgtagtgagctatgatcacaccactgcattctggcctgggcgacagagcgagaccatgtttcgaaaaagatggttgagaaatggtggacagatgccaagtggagtggctcatgtctataatccctgcactttggtaggctgaggcaggcagatcacttgagcccaggagttcgagaccagcctgggaaacatggcaaaaccccatctctgcaaaaaacacaaaaattagccagacgtggtggcacatgcctgtagtcccagctactcgggaggcagaggtgggaggattacttgagcccggtagtttgaggctgcagcgagctatgattgtgccactgcattccagcttggactacagagtaagaccctgtctcaagaaatggtgatagaaacagcactagcaggctgggcgcggtggctcatgcctataatcccagcagtttgggaggcccaggcggatggatcacctgaggtcaggagttggagaccagcctggccaacatggtgaaactctgactctactaaaaatacaaaaattagctgggcgtgccgggcgcggtggctcactcctgtaatcccagcactttgggaggctgaggcgggtggatcatgaggtcaggagttcgagaccagcctaaccaatgtgatgaaaccccgtctctactaaaaatacaaaaattagccgggtgtggtggtgtgtgcctgtaatcccagctactcaggaggctgaggcaggagaattgcttggagccgggagacggaggttgcagtgagctgagatcacgccattgcactccagcctaggcaacagagcaagagcgaaactccgtctcaaaaaaaaaaaaaaaaaaattagctgggcgtggtggcacacacctgtagtcacagctactggggaggctgaggcaggagaattgcttgaacccaggagatagaggttgc

SEQ ID NO: 563 - DNA, 1034 bp, Homo sapiens
tgatctcccagcatcagcctcccaaattggtggtattacaggtgtgagccactgcgcctggcaacagcaatttatttaaatatttattcaggttgggagtggtagctcacacctgtaatcccaacactttgggaggctgaagtgggaggattgtttgtacccaggagttcgagactagcctgggcaatatggcaagactgtgtctcaatcaatcaagcaatatttattcattcatttatttattcattcattcattcagtgtcctcctgatttttattccctatgttcagatcttatctatcaaaaataaatccctcatttaacttagttctcttcttaatccttaatgtcaagtatgtaatattttctgactttttaaaaaacctaccattaatttataatctgattttcactctaccactctcttgagaaatagtctcacaaaagcactcttacttatttgtaggaaagttaaaaaactttcttagtctttatcctccttgacttctgctgtagtatttgataccggtgatcattcctatcttgattacactttcttgtatttttgcttacctctttcactgttattgttttgttttgtctttttcttctgtcctttgttgattgcttttccatctcctgccttctaattttggctgttccctgaggctcagtccttagcactctgctcttctatcttactcctaatccagaaagcccatttccatgtctttagctagcacctctgtgcatgtgacttctaaagttaagttctcagctgacccaaactgaattctggtatttccagctgcttcaagaacattttcatttgtaacttctttgctgccattttaaattcaacatatttaaaattgaatttatcaaatccactgcccttttaacaaaccttatgacctgcctatttctgttaatggtccactactgttgttccacactgcaaacttgaaaccttgggtctatttgagggaggggtttttgtttttgtttttgagacaaagtttcactcctgttgc

SEQ ID NO: 564 - DNA, 1070 bp, Homo sapiens
gtattcatataacactttctaaacacttttccttctatgatctcatttttatttttatttttatttttatttttttgagacaaggtcttgctctgtcacccaggctgggacgcagtggtgtgatctcggctcactgcaacctccgcctcctgagttcaagcaattctcctacctcagcctcctgagtagctgggactacaggcatgtgccaccacacccggctaatttttgtatttttagtagagacggggtttcaccatgttgtctaggctggctcatttttatttttatcatatctttgtcaaatggataaggaagattttatttttaaaaactatactatagatttaaatcctttccttttttctcttcttccatttcagggtcatgcgtcttcaggatgagctggtcaccttgcgtctagagtgtacaaacctgtaccggaagggtcatttcacttcacttgaattggttccaccctctactttaaccaccactcatctgaaagcagaacccttaaccaaggcaacccattcttcttctacctcctggttccgaaagcctatgactcgggctgaacttgtggccatcagctcctctgaagatgaaggcaatctccgatttgtgtatgaactactgtcttgggtagaagagatgcaggtgggtgcatatccaaaagcttatgcagtacactgatgtttactggatctggaagcttatctaagaggaccaaattgctttgtgttccctgtgcagattcccttaattattattattcttttatttgagtgatggggtcttgctatgttgcccaggctggactggaactcctgggctgaagtgatcctcctgcctcagtctcttgagtagctgggacaataggtatatgccaccatacctggcttgactttcttaattattgatgctgcctgagacccaagcccccttctccttaaatcttgcatggatgaggttggcacaaattctcacagtcccgtactgaatagcatacagttttctcatttgaaaccctttggaatcttttccctcagctaactgtactctgagtg

SEQ ID NO: 565 - DNA, 1048 bp, Homo sapiens
tgtaagtcttcctgaaatcaagattgaattagacatgagatgcttgggaaagaaatctcaaacccttcatacttcagttttcttttttttttttcttgaaatggagttctgctcttgttgcccaggctggagtgcaatggtgcgatcttggctcactgcaacctccacctcccgggttcaagcgattctcctgcctcagcctcccaagtagctgagattataggcatctaccaccacacctggctaatttttgtatttttaatagagatggggtttctccttgttggtcaggctggtcttgaactcccgacctcaggtgatctgcccgcctcagcctcccaaagtgctgggattacaggtgtgagccatgcagttttcttttatataccaggtgaatttcttaagctgctattaatttctcaacattttagcatttttgtaaatatttggaacacagcaaatcagtttttaaacattgatataatcctttttcaacaattctggatgggatgttgtttatgcctttccctattattgttctctctggttatttcttctctctggcttgtaatcatcatattatatccaggtaacatttatgagattactaaatatgtgctaacgttaatatgcataatgctgtagcaaatccaagttgaagatctcaattaattaatgtagtttagtttttttttttttttaaatagagatgaggtctcactatgtcgcccaggctgctcttgaactcttgggctcaagcagtcctcccaccttggcctccaaaagttctgtgattacaggcatgagctaccacgcccagcctcaattaatttagttctaaaaattcctgagatgctagtatttgacttgttgcctttctctgctcaacatataagctcaattctgctaaggcaatcacatttttccttagaaggtctctaatgtggagctgaagtcttacaaaggtaatagtcaggttctgtgttatttctagggtcgaacaatcttatcagaaggttatggccctttggcatcagctgcatgttaa

SEQ ID NO: 566 - DNA, 1023 bp, Homo sapiens
aaggggttgctgtgaaacccttcatataaatgagagagtaacatcaccacttttttccatttgagtagctacgaacttgagatagagaagaacttatagatgaattctcaaaatcagatcatggaagaagtctgttgatatttcagtcattactgctcatcaacctatcacattttcttgtggctgtaacatgtttggactctcaaagattagtatacagtatgtgaaatttaggatcaggtaggattaggcagaagattccctaaataaagccttgctttcattagtaggatatcaggtctgcttatctctgatgtcgagcttactggtcttttgtgtttgttcattcacagaggacaaagaggagactgtggccaagatgtacatttcagagttgaagaacatccggctacgcctggaggagtatgaacagagggtggtcaaacgaattcagtctctagccagctctaggactgacagagatgcctggcaggacaatgcattaaggattgcagagcaagaggtaagccctaagagccatgtggatgctggttgtggagtgaatgctttcagagttcattggatggcaagagtatggcacctaagaaatgaggcaatagactcaagacagtccttctcaggagttcttcttgcagtctataaatgtcttttacccgtggagaagtgtgatttcagctccatgtgtattgctaaatgttgattagtttcctacagagttgagaaggcaaacagactagtaaatttttctaagcagtatatttgggctatgtattttgaaactgcttagtagagatgctactcttttattctatcccttatgtgcctgtgttactttaaatgacttggttaccttcagtcatatgaccaataaatataaggaatgactctgatttgaatgtgggctctgatacatgctctgtctgtgactttgagcaagtgagctctcatccctagtttactttcttgtaaaatggagatggcaatgcacgatatagggttatt

SEQ ID NO: 567 - DNA, 1067 bp, Homo sapiens
aaaataagatcttccaggttcatcttgctttttccagtctcaaccctggaaatcaactgtttctccaaggagttctgattcttttgggcagagaatattatttagaaactaagatctgggtaccaaatgtattcattgttgttggagtattattgcttataggcccacttagcagacagagctagaaaacataggccgggtgtggtggctcacgcctataatcccagcactttgggaggccaaggcaggtggatcacctgaggtcaggagttggagaccagcctggccaacatggtaaaacctcgtctctactaataatacaaaaattagccaggcatggtggcgtgtgcctgtaatcctagctacttgggaggctgaagcaggagaatcatttgtacccgggaggcggaggttgcagtgagctgagatcgtgccattgcactccaccctgggcaacaagagcgaaactctgtctcaagaaaaaaaaaagaaaacatatatttacaaatatatatatgcatacacacacacacacgtgttacatatacacacatatacatgtacgtaagtttacagatatagatcaatatatttattgatctctcaatttctctttctctctctctctctctctctcacacacacacacacacacacacacacacacacacacacaaattcatatgtatttgtctccccatccagttcccaacccatagcacagggattattctagcctctttccatatttttaacccccttccccaagagagaaaaacctgctttatgttatccacagtatatttacttattgttcagtcctagcatttacagatagtagtttcagaattgttaactcactgcagtaaacaaacctaccaaactagagtttaacatttatttatagttccttatgtctttagcctaaaggtatatctatagttcgaatactgagttcagaaattgcttgtgtgtgttcttaccctttcttccccttcagtgtgattatgttatttatctgaaatacagttaggcttatatatttctgttgtgttccatttgagagc

SEQ ID NO: 568 - DNA, 1024 bp, Homo sapiens
ttccttatttatttctttacaagaatgtaaaacattaacatggttctaaaagtcaaatctatacaaaaagaagtgtattcccctctagctagtccttttatcccctttgccttccttcgatcctttcaattccatccttttcatctcattagtttctggttatcctttctgtctgtctctttgtataaacatatacacatatattttctcattttcccttcttttatatacaaaatataacatgctatagatactctgttgactttgctttttctgcttaaaaatatatcctaaaaccacttaattcacagaaatctttctcatttcatttacagctgcataattctccatcgtatgtctgcttcatagtttattcaaccagcctcctatatatgggcatttaggtggtttccaatatttagctattacaaatgtggacttctttctaccttttttgttcaattctgtctccctctttatgtgtgtcttgttcctggcagcacacccaggaggatttacagcaattgaggtcagacttggatgcagtttctatgaaatgtgacagctttctccatcagtctccatctagttcaagtgtcccaactctgcgctcagaactgaatctgctggtggagaagatggaccatgtctatggtctctctactgtatatctgaataagtgagtgagctgaggttttgggtccaagagcaatattttccattgggataagaaagagaaaggcttaaagtatttcatgaataatacagagagattatagatcctgaagagcatatactgataatgagaggtcttggcttcagttcctagtaacattaagtaggttcatttggactgcagtgaagaagtgccagtgatatgaaaggggaattaatttgcagtgttgggactatgatttacctcacttctgtttgattaaatatttctgaaaataatacttaatggcataaagacaaaggaagagacactaaagaataaaaagaaaagtttttagttacactaggt

SEQ ID NO: 569 - DNA, 1033 bp, Homo sapiens
ctcactcagccttgcatcgctgttccccgtagataaagatggatcgtttgtggtcaagcccagctggatacatgggttaaagagggaattacctcatttactttattgtatttgtaccaaggtatctgatagcagtttccctttgttcttctagccaatctgagctagaaagtatccaggaagttctgggagattaccgagcctgccatggaactctcatcaagtggattgaggaaaccactgcccagcaggaaatgatgaagccaggccaggcagaggatagcagagtgctttcggagcagctcagccagcagacggtgagtgtggtagtagctctggcgagaagagttagaaatttaaattttctttatcataaaagaaaatgatgtactggcaattaaagcttcctccaaatggaagatatccaaattcccttttctttgagtggtttgagcaggatcgtcccaagatactggttttgcatttagactagagaacctgtaaggtaccttcagttctgagtttctgtaactgtattgaaaccactagatggacagattaaaattatctttattttgtttttttttatattacattttattttactaggattagatatggggttttgaaaaccaagggaaaattgtaagtagaagaaaatgattcttttttttttgaaaatgatttattttaagcattttttttttgttggtattttgttttgttttgttttgtttagcattatggttaagagtatgagatctggagttgtattgcctggattccaattctggctcacttacctactataagcctttgaagaagttatttagcttctcagtgttctacttccttatcagtaaaatggacatagtttgttatttatttaacctaccttatgagattatcgttgctaggattaactgaagtgatacatgtaaaatacttagaatagtggttctcaaagtgtggaccccagactagcagcatccgtatcacctggggacatgttaggaatgcaagttcttgggtt

SEQ ID NO: 570 - DNA, 1058 bp, Homo sapiens
aagctgatacagaaatgggattttctattacttttaaaattgaagagtcctcttcccaagtggtacctcaaggaatttctgtaaaacatttagatgctttaacactcttcagctctaaacaggccaatgaaggaaaagtaaacaatttaagtctctgcttgactttaaaaccagaagaaaacttatctcgagaaattgcctgtggggcccagagtgaaccattcccttgtatgaccccaagacctgaaggattgcactaccaggaatcagatggaaaagcccaagtgacaggcccatcccaaatttccaaaacagacaagtctttccaaggaaccaccagacaggagaccaactatcaagattcctgggttacttcgaaaactaaggaaaccaaacatcaaatttcctcatctaatgaatgtaaagaaaagtcataccaagaagtatcttttgacccagcaagaggtcttaaattggaagaaatcacagtttctagaccagattcaaaagaagtcaggtatctagaattctcagacagaaaagaccttcatcatcagggcagcaaaagtgatgataaactttgtggaactctcaaatctgaaatagcaacacaggaactaactggagagaaatttctagaaatggcaaaccctaatgttgcaggtctagaagcaggatccattgaggacatagtgactcagagaggttccagagtcttgggatcctttcttccagagaaactgttcaaaggagtgtctcaaaaagagaatacagggcaacagaatgccatcattagtcctactgttctagagaccagtgaagaaaagacagtgtccctaacagtatgctctgcagtgaagacagagaagacaccacaggaaaagctcagagaaagccctggcagtgaacaaactcccttcatgactgcacctgaaggaaagggaaatggaggtgtaaacccagagcccttcagagcaactcaggtcagtggtgtgcttttttttttttcttcctaaagatacaattagtttaatgctaaaattcttaactgggtacag

SEQ ID NO: 571 - DNA, 1050 bp, Homo sapiens
ctcacatggagtatgaagtccagtcttgtatacctcaaattattgtggattgcctactgattgtcctttgtttggggggatttttttttaccaggcccgtcaccaagaattgctgtcccagcagcaaaatttcattctggccacccagtcagctcaggccttcttggatcagcatggccacaatctcacacctgaggagcaacagatgctgcaacagaagctgggagagctaaaggaacaatactctacttccctggcccaatcagaggcagaactgaagcaggtgcagacacttcaggatgagttgcagaaatttctgcaggatcataaagagtttgaaagctggttggaacgatccgagaaagagctggagaacatgcataagggaggcagcagccccgagacccttccctccctgctaaagcggcaaggaagcttctcagaggatgtcatttcccacaaaggagacttgagatttgtgactatctcaggacagaaagtcttggacatggaaaacagttttaaggaaggcaaagaaccatcagaaattggaaacttagtaaaggacaagttgaaggatgcaacagaaagatacactgctctccactcaaaggtaagggggcagttcctggcatccttggtgaaacaatcatggcagccttcacacaatgtaggtagtgtctggggctcagaataagaactccaggacacagtaggagagctgatttatacttggaccatgggcagaaggtcttcacaaacaatgcacaaaatgtaaaatacataggtactagcccaaaggcctgatagctagctaatacctaatacctagcactggcaggagtatatcacactgatggtgaaggtggaagtattccccttcctgtatcctgaccagcagacttggactcccaagagacatagcacacaggggaaatttaaaccaattgcacagtctttatttctgtctttatttcacagagcatctagggtgaatccttaccttccttcctatctaaagaacttgctcgctcttctaaagtttagaat

SEQ ID NO: 572 - DNA, 1094 bp, Homo sapiens
tttagaaatctcttctctctgtattatttattctgccttcttttctaatattgaggagcaggggctggacgcagtggctcacgcccgtaatcccagcactttgggaggccaaggcaggcagatcacttgaggtcaggagttcaaaactagcctggccaacatggtaaaaccccgtctctactaaaaatacaaaaattagccaggcttggtggtgggtgcctataattccagctacataggaggctgaggcaggagaatcgcttgaacctgggaggtagaggttgcagtgagccaagatcgcaccattgcactccacctgggtgacagagtgagactgtgtctcaaaaaagagggggtgattcaacccagagacctctttcatggaaataaccaagcaattttgtgatgatcatgccactctggaactggaaagactactctcagttagtcccagggggaggcccacatcatcactttctcagggaaacctaccctgagcttccaggccaggttgaggcccatgacccatgttctcatagcacggtgtgctttccttagtgcctgggatagtttagagcacatagtagataccaataaatatttggtgaatggatgaaaagaagagaatcaacgatataaccttgtgaaattagttgcctcaagaggagaggaagaggaatccaaggagacaaagaaggactggctagaaagatagcaccagggtaccacagtgtcatggaagtcaaaagaacacagtctcaagaagaagggaggatccatacttatttctcaccactgcttatccttaaccccctctaatctgatccaacacccatcactgtgctgaaactgctctcttagatattcattggcttcctagttgccaagtctagtggccttgtctgcctcactattcccctctttcattgtacagcatttaatatcagatcttctttcttgaaagttaatttactttctggacattgtgctcttccgttctcttctctggctgctcttctgctttcctttttggtttgtcttcctatctcctaaatatgtggttccttaaactctgtcatctgtctcttctcttc

SEQ ID NO: 573 - DNA, 1051 bp, Homo sapiens
gaaatagaataaaacggtttttttttgctgggcatggtggctcatgctgtaagcccagttgggaggcttaggcaggtgcatcacttaagctcagacaacatggtaaaaccccatctctactaaaaatacaaaaattagctgggcatggtggtgcacacctgtcatcccagctacttgggaggctgaggcaggagaatcacttaaacctgggaggtggaggttgcagtgaaccgagatcgtgtcactgcaccccagcctgggtgacaatgtgagaccctgtctggaaaaaaaaaaaaattaacaacaacaacaaaaaaatttggagacaggatctcactctgtcgccaggctagagtgcaatgacacaattacagctcattgtaaccttgaactcctgggctgaacgattttctcagctcaacctcccaagtagctaggactacagatgcacatgcctggccaattttttaactttttgtagagacgagtgtcttgcaatgttgcttcggctagtcttgaactcctggcctcaagggatacccctgcctcagcttctcaaagtattggaattacaggtgtgagccattgagcccagccagaatttgcttctttagagtcctgccttcagctctctacttagaaatatttgtctttgccatctctgtatatctgaaatcctaatgagtaaatgtgattccctccataaagccttctctgatacctcctgccttccttcttcccacccttctgtcaggtcttttctaacttgcaaagccccatgattttgtcatcaccatggttttggtgaccattagtctaaaaagagggattaatacactgtcttttggaaagtctacaggcaggaaagggcttacaggggtcatgagagttcctgcagagtgtgtggaaagttttctcatgggttcacgagtacatgagagctcaaatagcatcaaaatccttagtatcccacttaaagcaaacttcgtgtcatgctatgttgctttatgagccactccgtagccatgtttataataataaaagtaccaaa

SEQ ID NO: 574 - DNA, 1096 bp, Homo sapiens
ggaagtccttcatgccacccaacttcccagaatttgcagagaggatagaagcttctctcagtgaggtttcagaagctggtgcttcaaatccttccttgcaagagaagaaggagtccagttctgcattaacagaaagttctggtcatttggaccacagggaacctcagtcagagtcagtaactctggaacatgtgtccaaatccataggtattccagaggtgcaagattttaaaaacttaagtggagactgccaggactttagatttcagcagcacagtgcaaaccctcctcatgaattccagcctgtagaatcagaagctgtagcaacaagtggtaacacagatgtaatgcaggaatccagattctcaagtgcaacctggccgagggccacaaaaagtttagctaagggaggcttcagtgagaagcagcacccccttggggacacagcctgcactgtggaaatgccacctctctccccttgcctgagtgaagagctgttagatccagaattgcatgttctcataacccccagcctgagagagaaaacagagtctgagctaaagtttgaggaggatgagcgatggattatgatggaggctgagggagagtgggaggaagagaaactgtcagacagggaaaagacttttctgatggcagatgagaagaacagcctggcagatatttttgaagaaagagaacaagcaaacacagcagtggtggaggatggatccgattgcttagctgctgtcttgaggacttttggccacctatctcttggtcagatttgttgccctgatgacccacagccagccaaggaccagttggctactgttcccaaggatatacccctggattgcgattgtgttcttacaggtgaggatattctcggtgaggtggcaaacagaactgctcaggggttagagggacttgtttcagattcagcatgtactgtgggtactattgatgcagaacagctctctgacacagactcagtgcagatgtttcttgaacttgaaaaggagtgtttatgtgaagaaggagtaactcctctagttgagctacagaatcaaatctcttctgaagggctggctgcatc

SEQ ID NO: 575 - DNA, 1059 bp, Homo sapiens
atgtgttgttcttttggggtcttatgctgcttcagctaagcgggcacttccgagttaacttgactcatccgtctactgccatattaggtttatatttaaacatctgactaaacctactactgttccatgtctgggtaggaaagagcaatggcaggaagagtgtagtctcataaaaacactgattagaggcatctttcttttgaaggggattgatatctgttatttctagctgtagaaactgagttctgtaacttactttaaagaaattgaaatgtggtcagttttaacttgtttgcatcttgatttgtgattttatgaaattcttcccagttttgactctactttgtgagatataaactgtattactgaaaatccaggccttgctttgttgaataaattgcagttatgtggagacttggctgtatataatttgtttatttttctttaatacgtctattagtatgagcaagctgccgatgcagaactagcttgggttgctgaaacaaaacggaaactgatggctctgggtccaattcgcctggaacaggaccagaccacagctcagcttcaggtacagaaggtacgtgcccactctttcctgagctaatagaatcatcagtaacttagagtgactaggagagtttctgactatcccatgtcaagtggaataatttagtggcatgatggtaaatagaaattaattttctatgtatttggttgagatgaggaagaatttttttttttgctttgtgagaaaggaaaaataggcccattaatccataattagcaatttccttgatagaaatttttgtaagctactaaaaagataagctagagaagatgttggataggcaaagtgtcaaactgtataagaacaatttttgatgtggctttttcatagattttgtcttaacctttagtaataacaggaaaagggtctttttacttcttaactacagtttacttttcaaaggctttctccattgacattattcgacacaaagattcaatggatgaactcttcagtcaccgtagtgaaatctttggcacatgtgggga

SEQ ID NO: 576 - DNA, 1069 bp, Homo sapiens
ttccctccccaccttgggtcaataccaatacatgagccaatttttaggatctggcacagagtttttttcaagatcatagaccccagcacttctgttatactctattgtcagcacttaaatttgtgacttgtactgtgttattttacccttgatatgtttctctgtaatagacttctagctgttgattataatttctttggaggcaggaaggggtgaacctttggtaaattattgaacctcaccataccttttctatagtattttatatatacatatacctatatgtaatatatattttgtatatatgaaaaataaccatgtagagtctgaagctttagtgtccagataagtgaaactgacagttatgttgagcatctgctattgatggggtataaatcacatttgcaaagtttggtaagttctgttctgttttctattttggcttatattctattcgtttacatgtagactattaaggaagagacagatggtctgcatgaagagctggagtttattcggatccttggagcagatttgatttttgcctgtggagaaactgagaagcctgaagtgaggaagagcattgatgaggtgtggagaaatggatgaggcactcagttagaacattagtgggcccagactgaagagtggtattgattgaagaatctgattgaatgtttttcccctagatgaataatgcttgggagaacttaaacaaaacatggaaagagaggctagaaaaacttgaggatgctatgcaagctgctgtgcagtatcaggacactcttcaggtgagaggccaggaggtgaccaccaaggaaatacaggttctgttttttgccatttttgtcatttttggaattaagcacaaaagtggatcaccttcacaggactgcagacctaagatagtggtgtttccacaaatttagccaaagttccccacttgtagtgaaaaaagtagcgacatctgtctgaattcttactcttcctgccatgtttatcattgcctgctcatcatagattcattcagctacgttgtgaagctggccttactgtgaaagtcattgct

SEQ ID NO: 577 - DNA, 1050 bp, Homo sapiens
ttattaaatcaccatattattaatataaagatcattattctttatctgtgccccttacctgaaatcacaaacagcacaaggtgctttgattgatttatgtcttcttatgttagcagagataatgctaattctctcccaaattcttctggttgtttttgactgtttacttgtcttttgttctaggctatgtttgactggctagataacactgtgattaaactctgcaccatgccccctgttggcactgacctcaatactgttaaagatcagttaaatgaaatgaaggtttgtatctgggtatggcttttgaagaagaattgttttattatagtttttaaaggcttgatttgatgttaacattgagtgtgtctttgacaggagttcaaagtagaagtttaccaacagcaaattgagatggagaagcttaatcaccagggtgaactgatgttaaagaaagctactgatgagacggacagagacattatacgagaaccactgacagaactcaaacacctctgggagaacctgggtgagaaaattgcccaccgacaggtaaggcaggtggtagatgacatcagtgaactactctccgctcttttctaatttcgtattgaatattccctttctgtcttttcctgagtagcacaaactagaaggggctctgttggcccttggtcagttccagcatgccttagaggaactaatgagttggctgactcataccgaagagttgttagatgctcagagaccaataagtggagacccaaaagtcattgaagttgagctcgcaaagcaccatgtaagtattttcattttttcatctctaaccctattgatttgagaccagatgctgccaccagcagcctttgaatgttgtgtatatcttaagagaaccaagttagatgatatccatagagataaattatgttgttcaacatgttttaggtcctaaaaaatgatgttttggctcatcaagccacagtggaaacagtcaacaaagctggcaatgagcttcttgaatccagtgctggagatgatgccagcagctta

SEQ ID NO: 578 - DNA, 1028 bp, Homo sapiens
tactgtcctttcccagatagaagagcacaaggtaagtatgatattatgatgctgcattctttttgaaagcactaattgaaagaaatgcccctttatcttatcttaagctaaaaaagagcactattgttccctcaggtttttgctaatgaagtaaatgctcatcgagaccagatcattgagctggatcaaactgggaatcaattaaagttccttagccaaaagcaggatgttgttctgatcaagaatttgttggtgagcgtgcagtctcgatgggagaaggttgtccagcgatctattgaaagagggcgatcactagatgatgccaggaagcgggcaaaacaagtaagttggggaagaaagatactaattcactgaagagtcttgggctgcatgtattgagtctctgggatgattctcaaacgtgctgtatagtgtgtatattcattcctgttaacttatttcttatgtaattttagttccatgaagcttggaaaaaactgattgactggctagaagatgcagagagtcacctggactcagaactagagatatccaatgacccagacaaaattaaacttcagctttctaagcataaggtaaagcagttaattgctcttaggtcccaagccatagtattcgctaaagcttgtatcttgccaaaaataaaaatcagagctagtaaaaagaaaaccaattggttaatgtttaaaagtcaaaatgatgaagccagggttccattttatatctagatggtctaatcatgatatttgctcatttaaataacagtttaaggaaagtagttatgggagtaactagttaaaactgtaggctttcacaaattgtcaggcacttctatatatggtataaacaaaaaattataaatttcttaaggataagctatggttaattttagttcaaaaaaagtggtgatattcatactttatttggtttctagcctgaaaactcaaattcttttgttccaaatcaagatgtcgtctgacttttaacacttttttcttttctttctg

SEQ ID NO: 579 - DNA, 1021 bp, Homo sapiens
ggcgagcgagcggatcacttgaggtcaggaattcgagaccaacctggccaacatggtgaaacaccctctctactaataacacaaaaattagctgggcttggtagcgcatgcctgtaatcccaactactagggaggctgaggcaggagaattgcttgaacgccggggtcggaggttgcagtgagccatgatcgcgccactgcactccagcctgggcaacagagcgagactctcaaaaaaaaaaaaaaaaattaaaaccacatccctgtggcaggagcttggtaagaatatgttcagtgtgtgtcactttgccagaaaaatgtaatgatatgattttcattctttagtgttaatttgacaaaatgttctctttttttttcccctcctttcctccatcctttactctttactgtctatagttcttcctcggcaatcaggtacagtgtgccttgcaatgttctccttctcaatggatatggtctgtgtagctaatgctgcctgttcttcgctatggggagaggatgtaatctgaagcatgcctgggtcgcacctggttgtcttaccaagtggagaaactgttgatggggccagcattgcaaagctatcttagcagcaaaagaatataagtataattttttataaaggagatgaaatggaggaaagtgaagctatggtatcagtccattacacttctaagaagagcctggttttgtacttctgtgttagaagtcagattaccaaatagcacagttcttatttatattagaatcttttgacagttaataaattttgtaatgtatggtaagtcaattcctgaagaacttcagtactatttaaatatctttttaatatttgtagttacttatattgtatgttataattacaaggtatctgagaagtgtagtgtggagatcgtaattggccgtggcctgaagtatgctgattatggccagccagccaagatttaatgggaccaaattagacttgcaaaaaagattggatgctttgactccacttggtaac

SEQ ID NO: 580 - DNA, 1056 bp, Homo sapiens
tggaatgtagagaatgctatactgaggacagtacaagatgtgtgacaaggttcttaacaccagtgtgcactatcatttcttacctccttttacacagctattttaaaaggtagaagatatctcaaactgcatgtagcttttagtcatgtgtaaaaaaatgaaaatattttactagctagatttgccagtctcctggtactgccaaaatcagatatttcagtttctgaatgtatccgtggcacaggaaatcatgatgttttggatagagagaaaaaaagtgctcctgcctaaataatgggtatacttgtacctaaggtactgtgtatgtttttgatcattagacatattagctcccccagataagtgaacatctaggaaatttcatttatgaagatttaaaagacacattttgaaatagaactcattttttttttcagattgttatacagataaaatttaccatcctaaccatttttaagtacaggactaagtatatttgtgtcatactaccgtcaccaccgtccatccacagaactctcttcatcttgtaaaactgaaactctatacccattaaacaatagcttagaactgaattttaacatgcccgcatcagccagtttcaggtggccagcataactcccttagcaaagacagcctctttggtggtcaatgaactgaacttgaggtggctgccgtcatgtctggttctgtaggttcaatggtagatcttttctccagtgaaaagaatggtgagggggaaaatcctatcacagtagtcaaccaagtactaggaatcttctcttttttttaactttaggactataatacccaattttgggaaatatttgaatcaatgtaaatattaagagtacctttactactaaattcaagtgctagtacataaattttgcttaatcagaatttggtgtttccttctagttcgagaaaaatgtttactttttacttgtgggattgctccagaaatcaattttcacagcttccaactgtttattgtttgttgtcgcctcctcccatcccagccttttctattatcaa

SEQ ID NO: 581 - DNA, 1090 bp, Homo sapiens
gctactcgagaggctgaggcaggagaatcgcttgaacccaggaggcagaggttgcagtgagccgagactatgccactgcactccgtcctaggcaatagagggagactctgtcgcaaaaaataataataaataaatatatggccaggcacagtggctcacacctgtaatcctagcactctgggaggctgagccgggcggatcacccgaggtcaggagttcaagaccagcctggcccacatggtgaaaccctgtctctactaaaaatacaaaaattaacggcctggtggtgtacacatgtaaccccagctactcgagagactgaggcagcagaatcacttgaaccggggaagcggaggttgtggtgagctgagattgtgccactgcactccagcctgggcaacagaacaagactccatctcaaaaaataactaaataaaaataaatgtttgtgtgtgtgtataagtgtatgtgtgtatatactgcgctccagcctcagcgacagagtgagactgtatctcaagaaaaaaggttttgaaaaaggaaaaggaggtgttgcttcagccacatcttaaaggaggtaacacttgaccagaaggaaaagggatctggatgttcttggtacagaaaccacaagttcatatgaacagaagtgtcaacagctgaaaaagtaaggggacaagtagtcccatgggactgcagccaaatgtacaaggttagcgaccagataagactctggacgggtcagcaggaggggccaggtgatggatgccagaccactgggtcctgggtacttaccacattgtgcttcctagtccccaagatgtggtcctcaaaaaaacgaaaagtcacggtcaaatgaatttgggagatgccaagttaaagctctcccaagcagggaaatatagaggaccaaaccccttttgtaggaaaaccctagaaaacctcacttggggaattctgctataagcagtgaaacaccatggaaggattctgagctgttgacaacagattttcatttagaaattcattctgcaaaatacaaaaattagccaggcaaggtggtacatgcctgtagtcccagctacttggg

SEQ ID NO: 582 - DNA, 1138 bp, Homo sapiens
agaatcacaaagccagaaaaggcttcagcaacttctgtatggatgaggaaactggggtgcagaaaggctgtgagatttgcttaagatcacacaggatcagaaccctagcttctgctcacttgttcttccaccccatgccatctctattaagtctgctgttttattcttgaattccagaccctaaaaagtctgccagtcgccctgggagtcgggctgggagtcgagccgggagtcgagccagcagccggcgaggaagtgacgcttctgactttgacctcttagagacgcagtctgcttgttccgacacttcagaaagcagcgctgcagggggccaaggcaactccaggagagggctaaacaaaccttccaaaatcccaaccatgtctaagaagaccaccactgcctcccccaggactccaggtcccaagcgataacactgtctaagcacccccaagccactatccactttgaatcctgctccatacattgggtgtatatttattctgaacgggagaagttatattgttaaaagtgtaaaagaataattgtgttatgaagctgccttattttttttctttttgtaagttactattttcatgtgaatatttatgtagataaaatttgcctcctggtaaccctgtaatggatggggcccagaaatgaaatatttgagaaaaacaagtgaaaaggtcaagatacaaatgtgtattaaaaaaaaaaaagcctattaatagggtttctgcgcggtgcagggttgtaaacctgctttatcttttaggattattcctaaatgcatcttctttataaacttgacttgctatctcagcaagataaattatattaaaaaaataagaatcctgcagtgtttaaggaactctttttttgtaaatcacggacacctcaattagcaagaactgaggggagggctttttccattgtttaatgttttgtgatttttagctaaagagagggaacctcatctaagtaacatttgcacatgatacagcaaaaggagttcattgcaatactgtctttggatattgtttcagtactgggtgtttaaaggacaaatagctgctagaattcaggggtaaatgtaagtgttcagaaaacgtcagaacatttggggttttaaact

SEQ ID NO: 583 - DNA, 1123 bp, Homo sapiens
tacttcagtgcctgttacttttctttctttctttttttttttttttttttttttaacaatcttgaactcatgagttcaagacttctcagcttctcaagtagctggaattacaggctcaagccaacagggctacctgggctacctgttacatttctttctaccaagttacatttctttctaccgattagtgcatagttagtcctgaatattaatggtaagaaacttgtttttattatttttagtttcatcacagtaatttcccagtcagccttttaaaatttttcaattttaccacgaaatcttcatcaccacttcaagtggagtcaccttaaatgacctttcctggtaccgattatctttggataatgagatgttgttttatttgttgttctgttatccattcaccaaacatattcatcagctgtcagagatcatttttctttcatttcaaagcttatcttgacttttgaaggtgaactcaaatactgggaaactgcatttatttttgtaattttggagtgttctgaacccagagttacttttggtaatacaggtctttgtgtgctgctatgaaagaaaggggtgtgagttccctgaaacccacaggtggctttggggtggctgcatagcttactggtagaggcccagggattaagggaggacaaatcatgagtgtgtctcagaagtatatggaaagctggctggccctcttttaacctaagagagtttaagcagctggattttcaatcttttcagaatgaatctgagctttttggacgtacaattcgtgtcaatttggccaaaccaatgagaattaaggaaggctcttccaggccaggtgagtaggagcaacttccagattccctgtgatgttctgcagtttggccttagttgcattttttgtctctatttacttggaagtagatgctaaatgctgcttcctggtagataggagtagatgatggttcacattgggaagggcatgcaccacctttttagagaaacaagtgagtttgagcttctcagcaaagccaaagtgattgtttctgttatgagagaaattcctgcctgagctcatctttcccagttttcttgatattccattcctggggtctccatcaag

SEQ ID NO: 584 - DNA, 1072 bp, Homo sapiens
ggcattttggattttggattttcacatttgggatgctcagcctgtactaactctgttctccttgactccttcttcacttggctggcaggactcctgcctcttcttgtctccttttacctagatggctgctttttctgtctttgctgtctccttcttttcctgacccttaaacactgaagtggctcagagcccattctttggttctccagaagcctgttaccctgtgctccgtttttctaactggtggtttgtagggcccctctttactatactgaactgacatgtgtaggtgatatagcccactgacccacatcgttattttaaaaatcagtattcatctgtaactataatagggaagaacatcagaggaaataaacgaatttgtataatactcgaatatgtttccagatgtacatgcttaagcacagctgtgtcagaacacaaagtgaattattcaggcgtctgcccctgtactcaaacgcagcagttagaaatgcagacgggagtgtcaactggataccactaggagtgatgctattggtgatacggctttgtgaaatggtagataaagttgattagagtccaaagtaaagaataatctgtttatttacatagtagttacattcctagaagattccatggaaaatcaaaagcactccaaaactttgggcttatatgtataatggaattatgttttaggtgcagataactgtaaacacattttttacctataccaatatctggcaggatatttgttgttttgttgttgtttggtttttgtttttttgagacagggtctctttctgttgctcaggctggagtgcagtggtgcaagacggctcactgcagcctcaacctctccagctcaagcagtcctgcctcagcctcccaaatagctgggattataggtgcacgccatccataatgccaggctaatttttaagttttttgtagagacagggtttcattatattgctcaggctagtctggaactcttagcttcaagtgatcctcccacttcagcctcccagagtgctgggattacaagcattagccactgcgcccagcctct

SEQ ID NO: 585 - DNA, 1030 bp, Homo sapiens
gttcactttagtccgacagcagggccaagatcacgtgaggaaggaggcaggtggggctgaggaggggtaaggatggatgcttcctccaacccatctcctctctctcttgcagggacgaggccagcagctctggctgctcagaaacagactccacagagctggctagcatcctctagggcccgccacgttgcccgaagccaccatgcagaaggccacagaagggatcaggacctgtctgccggcttgctgagcagctggactgcaggtgctaggaagggaactgaagactcaaggaggtggcccaggacacttgctgtgctcactgtggggccggctgctctgtggcctcctgcctcccctctgcctgcctgtggggccaagccctggggctgccactgtgaatatgccaaggactgatcgggcctagcccggaacactaatgtagaaacctttttttttacagagcctaattaataacttaatgactgtgtacatagcaatgtgtgtgtatgtatatgtctgtgagctattaatgttattaattttcataaaagctggaaagcagctgcctgtttctgtctgtgtcctcagccactcactgagcccttctgccttaagactccgttagagaacacactgagccccaggtgctactgggtgggggcgaacatgtctggagttgtggctggagtgcagtggcgcaatctcggctcaggcaatccttccttctgcttcaccctctcgagtagctgggactacaggcatgcaccaccacgcctggctgatttttaaatttttttgtagagatggaggtttcactatgttgcccaggccaatccttctcactggactcaagcaatcctcctgcattagcctcccaaagtagtgggattacaggtgtgaaccactacacctggcctcttgctaagtcaagactgttcttatttgaaagataagaacaccctagtgtagagagggatttagctaaagtcacgcagcctttagtgacctaactggaattttatcccaa

SEQ ID NO: 586 - DNA, 1034 bp, Homo sapiens
ccaggctgctctcgaactcctaacctcaggtgatccccccacctcggcctcccaaagtgctgggattacgggcatgatccaccgtgcccggccccaccagacgtttattaagaccttaatatgtatgaggcacattttaatgagatagcctttgtggcaaagaatacagttcttctggagtttacagtgggagaggaaatagacaagtaaatgagggatggcttacagtgtcatagtgcatagcacagggctacaagagcacagtggagaaatacctgagccaggtgcccagggttccaggaggaaatgggaggctaactcttgaaatatttatttagctacatagggaatccggaaaagggatttccaggcagagactactacaggtgcaaggacctggagaaccggacagctgaaagaccatgacgagttcagtgtgactggaattctagtaatggctggggaagtggaggaagtgagatgtggtcaggtcagtcatatgtggaggacattgtaagtcatgctaaggaatttggatttttaccctgaaagctatggagatgctttgaagggttttatgcaggaaaatgatgtcgtcagatttatatttcagaaagttcattctgtcaagtaggaggggaccagccctgtggggaagtaaaacagtgtttggaagctcttgctgtagacatggcctgaactaagacagtggaaatgggaatggagaggaggcatcagatgtgagcaatattaagaagatagaatccatagaattggaggctgattatgggaatgaagaggtaagaatagcgcgattgcctggctttctggcttagggaactgaatgggtagtaccattcagatagagagtatgagaggtaaattagggaagtgacatgggaaaaaatgcattttgaatgtttttagtttgaggtgtttgtagcacatccaggcaaagatgtctaataaggtgggtcagctaaaggaaagagcaagagtaaagatacggaggcaggagagggcctaaattgttc

SEQ ID NO: 587 - DNA, 1120 bp, Homo sapiens
ccgcacccggcgtgaagggcttttaatgccttgttgaatttgtttggatttgattttgtgggtggcagtttgctaattgatttgcccaggtccagcataaagaaatttctgggctgggcacagtgactcacgcctgtaatcctgacactttgggaggctgaggtgggcaaatcacttgagatcaggagttcaagaccatcctagccaacatggtgaaacaccatcactactaaaaatacaaaaattagctgggcgtggttgtgcatgcctgtagtcccagctacttgggaggctgaggcaggagactcgcttgaacccgggaggcggaggttgcagtgagctgagattgcactgctgcactccagcctgggtgatagtgagactctgtctcaaaaaaaaaagaaaagaaaaaagaaatttctcgctttttccagaaatacttcctcaattgggtaggcataattgatatctcagagaagtttaaataaaatggtagcagcaaaagtactttgtagaatacagcctgatgtgcaaaccaaaagtggtgatattgttaagattcagtgagtatatttttgctttggagtttagctattgagtctgtaaaatgttttgtttccaacctagggatgatcttttattctcaccctttttcctggttgcagttatttttttagcttttaaaaagtgactttcttgaggctgagttagagactagcctggtcaacatagtgagacccctgtctctaccagaaaaaaaaaaggtgacttcctcctttcagttttttgtgaagcattgtgaatcaaatttttttttacttaagcaaatgcaatgtgtcactggaagccgaacctctggtttgaaatttaatgctgagatttgaaatatgagagttctcgagcggtatcttacccaattttagtgattattactttgaaatgttgacatcagtttctttctttatttgtgctaacctggctttcatgacctatacttcagtttctctatgacaaccagacaaatctttttaaagttctctaagaagaagcatttttcatcttgttagtcttcactgacttcatatttacaaagaataaattctgaactcttttttccatc

SEQ ID NO: 588 - DNA, 1069 bp, Homo sapiens
tcattggtttaatcagtgaaaccaaatgcttagagaagaacagtggctcctgatttgggttagatttagatggcatcttttttttttttttgagatggtgtcttgctctgtcttggctcaccgtaacctccgcctcccgggttcaagcagttctcctgcctcagcctcctgagtagctgggattacaggcatgagccattgcacccacccaccatcacgcctggctaatttttttatttttgtatttttagtagagacggggttttgccatgttggccaggctggtctcgaactcctgacctcaggtgatctgcccttctcagcctcccaaagcgctgggattacaggcatgagccattgcacctggccttacaggcatgagccattgcacctggcctaaatggcatctttactggggcaaagtggtgcctgttatttggtttctgtgttaaacaagccaacttgtatcttctggtagcatgtgtaggttttactttgtgacatgttaaaacctcgtgataagaattcattagaagtagaactaactactacatagtttagtggtaatttagaagggatagtcaagtagagatttttattattattataaaatattatatgttaaaagaaagtttggaaaacaggtagaaattgtcaaaaacccatcacccaaatgtgacaaatattgtaaattttgcgttcaagtttttttccacacttcatttagctattcccctataattagaagtccaagatagatatagatagatcaatagatctaacattgcagcaaacatctccatgcttatcacttttctcacattatgatttactttcttaggataaaacctcaggaacaggattacaaaattaagagaagcattttgaagcaaatcaattgggctaccatagtagacaggctgatttgtatgggtgctttattttcaattttacctaaggatgatgacttagaaaaacaactgtgggacaaagtagaaaacatttcaagcatagcaacttcctactcaagtagaaattcatgctactgtcttaattgcctggtgggatg

SEQ ID NO: 589 - DNA, 1093 bp, Homo sapiens
tggttaatttttgtatttttagtagagacgaggtttcgccattttagccaggctggtctcgaactcttgacctcaggttatctacccgcctcagcctccctaagtgctgagattacaggcctgagccactgcgccaggcctggttttttggtttcaaaccacaatagacattgctggagaatcaagctcatagtttctttttactctgcatgatatccctccaaaagcttgtctgttctcatgacttcatgacagttctttgccaatgatttgcaaacattatctccagtcttgattctttcctaggctttatttctaaatactcactagtcatttccacttagaagctttgtcttcttttcaaactcagcatatccaaaactgacctcatcttgttgccctaactagaacatgccacaacccatttctgcctataatgtcattattctcttaaggcccccatatttgcaaatcaggagtcatctttgcctcccttctctgaatgctgctgtgctcacagtcagtaccatacagttagtacttgttctcagtttaatgcacacttgtttcatatgacctcctagggcagaaccaagattcgtgggtggaagttgcagggaggcagatttgcctccatataaggaagaactttttaatactttgagctgtctgaatggaatggactgcctccagaagtctcgggttctccatcactgaaggtgtttgagcagaggctgcctgactaattgctaattgaaaggactgttctggcataagatggtgtttttacaagatgatttctagaatccctctaatcctgagagccagtgagtcgatagaaggtagctttgtctctcctgctagactcccttaggacagggagactattttacctttcttttatattctgtacagcacttaattcaggtgctggtctcttaattgcctaaagatgattatttacaggttaattgattcttttcattttgttccaatatttggttaaacaccaaatattgtggatttttttcctttgaaatatcttggggagaccaaggcaggtggatcacctgagatcaggagttcgagacca

SEQ ID NO: 590 - DNA, 1052 bp, Homo sapiens
agttcaaaggcaaaatgtgatggtcaagaaatagaactgagagctggatccttgggaaagggtgagaaggcataaagccaagttgggtatgggtaggacacattaatcattgcctcaaaggctgtggtggggaccccatgtgcactggcccatgtagggcactactgggaatggtacagaggggagcagagaggatgatgatgttacctgcacttattgttccaggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatggtgagtgagcacttggacacgaacagtaggtacaacaagttgtgtgggccagaccccaccaaccagaaccgtctgtaaactacaaccctggcttgtgtggtggagactcgtttggtgtgtcctgttcctttaagggacggcaaagctggcttaaatggaaattgaaaatgatgatcacagttggaggaagccatctgccccatgggaaagtgacttaatattaggtagcatatatagaggaccctcttgtgccaaggcacagagctggcggttttccccagagctttttccgtggcaccacatggcctctgggaaggcattgtgttagggagttaacttcctcagaagatgcatactggttacatggaaaatttgcatgagagtgacctaatgttggtataaagtagatacccttaacacagctggtggaagtctgagttgtccagccacttctaggaatctatgatcatagtagctaaaaatggtgtaacaacctaaatccaactgtaagagaaatggctaactaccacatgtcctcttgatgaaatgttttttatttttttattttttttgagacggagttttgctcgtttcccagcctggagtgcaatggcgcgatctcggctcaccgcaacctccacctcccagg

SEQ ID NO: 591 - DNA, 1186 bp, Homo sapiens
cgttgacacactccctttcttctcctagataactgtaagaaacttggcctggtattcgatgacgtggtgggcattgtggagataatcaacagtaaggatgtcaaagttcaggtaactcgatattttggctccttctttttgtccctgaggaattaattcaaagagacatggtagacccacagatgttgctttggtgggaatctgattctacaaagtctgtaagctgagctgctttggacgtggcagaagaagggttggctcttcaagcaagttcttttcaggacccatcccaacccacccgagtatccagtgtcttgcgcatctgtgagcttttcatgtagttgctgagtcacgtgaaacaggaaaccttttcctgcgacttactgttgtccttcccaaccactgggactcagttctctttgtttactctgcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttgtaagtttcttgatctctttagtatgatgttaaaaacagaagggactgaagatttctggcattgaagaaagctattttatgaacattctgcactgagcaggtaaaaacccaataatgcacaccaaaagtacacagaaatgaggtagtcccatgtagtggagccccaaaggtaggtgctttctgcctaagtggagctcaaggtagcaaaaaataatggggatgagccatggcaccttgtcaggctggtgctataaagccatatgtactgttatttacaccccatagacttaatagtctgtccaagatcgctgaacactagaacatagcatggctctgtgggtttgtctcttgctacattgtaccgtgctcctggggttaagtggaagcaagcattgggagaaatgtgtgagatttagccccagctgttctttagctcagatttaaacctgctgtctcttctttatttgcagaatgaattcccagttcctgagcagttcaagaccctatggaacgggcagaagttggtcaccacagtgacagaaattgctggataagcgaagtgccactgggttctttgccctcccttcacaccatgggataaatctgta

SEQ ID NO: 592 - DNA, 1049 bp, Homo sapiens
aattgagtaggtcggtatactaaaaatagctcaactgactgtaatgattcaggtatgcaaagatcagataatgcaatatattagttaagggaacttttactgtatatggtataatggtctatggtatatttccttgtaagttgtttctctctctctctttttttaaatgttaaagtaatcaagatgatgctaacagtcagttaccagaactcatacagggaccatttgtgtggaaactaaagctgcagaaaatccagcagaatcctgcgctactattgtagttatttgtagttgtttaggcagaaaaatcaaagacaggaagttaggaatgtttgaagacattattctagggtaatgaattcagataagatgtatttcactcatgttaaagctatcctctgaaaataagacttgcctatagaagtatccccaaccaaaagcctattaggaactccctagcccagtcagacagaatgtgtattccagggagaaggctgtatcctgcttatgttagactgtactacatacttcacgtcttaactagatataccaattaagaataggcaaaacctaatcagttgtcagaaggaagatatatatgaacaagagagaaaacaactccatggaactcagaaggagagtccccaaacatgaatttggcagtgatttttcaacactgtccagggagaacataagccagctttccaccatcatttggacaaatttttagtgataggacacatataatttatcaggctttattgtggtttcattttcttttggtttagattcaatactcaccagataacttctcagatgccacagtatgaggaatagggtaccctgtgtggtaagaggactattccccccattgtaaccaaataaactggcatttggcctatatggtaattttcttcataaactttataaaaaataaatatatattttgttgaggatacagggctagtgaaaaataaaaatatcaatataacattaaccttttagaaattagttagcataaattaacccttggaagcctaatcaattcc

SEQ ID NO: 593 - DNA, 1029 bp, Homo sapiens
catggacatacatctaagattgcatatgtagatctcctgttttgatgatcacctagaattctgttttgtggttgtgcctttaattgaccaatgtcttgctatttactgtaaatggtgcaagagtgaacatcttgaaaagggcggcagagtggtcttagcaaaaaaaaaaaaaaaaaaagagcatcttgtgctattatttctgtattgtagatttcaagaactgggctaggatatttccaccttaaaaagaaacaaattgaagttttaaaattattcttgaaatgctaccatagtttttgtagttttatagatttaacattatttttaaaaaataactttgctatattagatgtctattggtaacaaaggattacataccattcttattctgagtaaactgtattttgaactttaacaaatgagaaagtagagaacttttaaaaagaaactcaaactgtggtttttatttcagttgctgcatatcatggtgggtggtagtattttctgctaaagtgtaatggtacaggtcagttagacattataaatatgataaacctgacacctcaaatttttaacttttcacatggactttttctcctcactccaaagtaaacgcgagtcattctaagttaagaagaaagaagcctgaggacaagtcaagctgttaaagcaaaattgcagcatttgttaaatattgctattggtgaactaataattagaaatattactttctgtatcaattccatattttaagtcctttctcagtggaaaataatgcaacatattgggtgggtgtgtgggtgggtgtatatgtgtagtaaaagcctattttaacatgaaggttaagggatgggggagactttatatcttgtagttttcacttgagtgaatactaaactatattcttatgcctgtgaacatttttggcttatattttccaaagaaatgttgacgtaaatggaagcttatgttcctagagaatttcaggagtttaaaataagggaaacaaattagaattttagaacatgg

SEQ ID NO: 594 - DNA, 1062 bp, Homo sapiens
attgcttgaacccaggggttggaggttgcagtgagctgagatcgcgccactgcactccagtctgggtgacagagtaagattctgtctttaaaaaaaaaaaaaagacagcaacagaatttcacaaggctttgagtatagtcttttttggttacttattttcaggaaatccaaataggttctttcaattcctaggtgtatcagatatgttgaaaaggcaaaactaatttttatattgttaacttattttctgggtgtgctgttcttgttctaggagtcacatgatgcattattggaatttgggaataataacctacaaatattggttcatgttaccaaggaaggggtgtggaaaaacccagttcttcttaaaattctgtctcaacagccagtagaaacggaggaaggtaagtcttaagactatattggatgaggatttagttctgagaacgttggaattgattatgggttaaaattttgggaatttaacttgtgtatatatctagtctttctgtttttactttgagtagtaaaaattaactattagcatttaatgttttgcttaagtaaggattcttgcactgttagttttaagtccctttacactcatttttaaattttgcattgagtagcaatgttcatacaaagttcctgagacagaaatgaataatctgctgtaatctttggtgtgtggtagagctttgcttatacttttcttttcttttttttttttcccgagacgttgtctcgctctgtcacccaggctggagtgcagtggcaggatctcggctcactgcaacctctgcctccagtgttgaagcgattctgcctcagcctcctgaatagctgggattacaggcgcgcgccaccacgcctggctaagttttgtattttttagtagagacgaggcgttaccatgttggtcaggttggtttcggactcctgacattgtgatccacctgccttggcctcctaaagtgctgggattataggcaagagccactgcgcccggtctgcttataccttttttattggctgcaacaactgagggccatgaaaaaagtt

SEQ ID NO: 595 - DNA, 1069 bp, Homo sapiens
aggacccagtgggaattcagtttgggagtagaagaaaaagtaaacaggagtatagaaattccagatgtagtttaagtaagaatcaagattaagatgaactctgaacaaggaataattacaaaaggtttaattaagtttaaaatatgccacctccaccaccttcttttatgctaattggctgcctgttagaccattggtgtttaattgcctgattattttgaaagtcttaatacttctactttatccttgtgatcatacaaggaatgagataatacactcagaatacactaatgacagaaagtctgtgtaaagaaattgaggatttgcttgtttaggtattttatctcctaaagcacagttctttcaaatagctttgaagagacgtcttcccagaactttgtatgcatctggatctcacttctgatcttactttcatgggttatgtgtgggtattttggttggtgtatgattgcactggagggggtcattatgaagagtcgatcagacatattgtcaagaattcagcaggacgtttcagccttctttcagatacacactgtgatagggtttaaatggaagcattggtgaccatttatttctttaagaaatatacaaggtccgtgcagcatcatagtactggtctgtagcattactgcagtttaaaaggagtctcatgtttttaaaactggtcagtattcttttttcccaggtaatgtctttgaagctaacagatgattttcccaaagatatctagggttacttgaaatgtaagtttgctaactgtaactcccacctttcttctactcaaggatgcaagtgaatgaagtattattatatgaataagcttaaatctactttgattcctttttgaaaaaataaaacatttatcaactttgatttttaaaatctattactaggaacaaattgttttcagtatacctcagaactaatcagggaaatactgcattgaaaaccactattctagagaaaggtaatgataaaatattaatggcactggccggaatactagtttacattgatagcctaagcaggaaaataacttaggaac

SEQ ID NO: 596 - DNA, 1050 bp, Homo sapiens
gaaatttcgctcagagacatttacaaaccacagtaaaaagtaaaaatgttttaaactttatagcagttatgtttaacttatttattaatcttgaccccaaaagatttttggctgttgaagaaaattaaagaagtactagaggagtaagctccctgtagatgcctctcagtggtaacgtaattggaatagtcatgcatttgaaaaaggtgaccattttgagtgagatggtgtttgtatatagagaggtgtaattacggcagccattttaaagtcataaagttgaactttgaacctccacagtaagctttcagtgagtatttgatagactggcctttgatttctgtaatgtgctaagcttaaattttgtgttacacatttgtatttcttcagatgtagttacatgtctgttctgccccagctagactgtgatatactaaccaatatgttgtctaattcacggttgtgtcctaagtaactggcgaagactagcatatgtgttttatttaacagaattgtatgggagagaaaagaggtcatgggggtcaattactattgtaatagctttaaaaattttttttttctgtaatagccttttttaggggatgatcatcccttaattccacagttttatttacttcattcctaaaatacctaaattctgaatctcagtgtaacatgttaactggacttcatgggcttcttgctatgtagaaacacagagtgatgtttgtatgtatatatgtgtgtatgtatttattcatttatttttgagatagagttttgctcttgtcacccaggctgcagtgcaatggtgcagtctcagctcactgcaacctctgcctcccgggttcaagtgattctctgcctcatcctcctgagtagctgggattataggtgccagccaccacgcctggctaattttttatatttttagtagagatagggtttcaccatgtgggccaggctggtctcgagctcctgacctcaggtgagccaccacactggccaaaacacagagtaatttaaagttcttgcttagtagctaaattc

SEQ ID NO: 597 - DNA, 1057 bp, Homo sapiens
tgacccaccgtgcccggctgaaaattggtcttttctcacagacctgatatgtttccatctggtgatcctcaagtttctggcatttaggaccaaatttaatgagcagcctcagtatctgttcatactcacagttagcatgtgtgcttctcctttgcatgaatttgttttccgtattataggaggtatgtaatacccagaatgagtagtacatgtaacaaagttgtgatgttaacagctttggtttacatatacaaactgaagtgtgatgacaaccctgattatagttttaccagtcaggtcacctcaggttctcttgttctgcttttattttcctgcatcagtcgtttcatgtacttgatcaagtgcaatatttgtgtaggtataaagcaaattcaacagatataagtggcaagctataaaccattcgatgtttgatcataaatgactattgtaataaacaactatttcactaaagtgttttctttaaaatatttcagagaaggatatataaaacaacaactcatgtaccaccggagttaggacagatcatggattctgaaacatttgagaaatctcgactctatcaactggataaaagcactttcagcttctggtcaggactctattcagagactgaaggcactgtgagtaatttacttcttggagagacagtctgtctggttgttttcattttcatatttttgtaacacaaaagagggtaccacacttacaagtcccagaatgctttcttaacctttgttattgatagtaacggctgtggagcaaaaaagacagaaacataactgcttagtcagttgaaaactatagaatatgggaactattaccctgaagccaggtaggaaaaagatcctcttccattaggatccagctgagatgtcatgtcttctaagcaaccatttgaaactccctgcctgacgaatgtggatagggtagcattctatcattattcctgtcagagtacttatctcattatgttgaatttgcctggatttttttttttttcttctggcacagtcttgctctgtcacccaggctg

SEQ ID NO: 598 - DNA, 1456 bp, Homo sapiens
gggtttgcatgtttaattgccaagggacatgctaataagtaggataactgggtttcaaactctgttctgctgagtctttaaaatgacattgaaaaatccattcttgaaactctaaagactgcaacatgaatgtgctaaatttatctctggggattttctggctgcatttatgcttggcaggaagaatattttgggtaactttgaaaccttgttttgtttggaaacaagttcattaatttctattttgtgttgattagaattaataggtttgtatgttttggtcacagagatcaagtgagaagattagcttcgactttttttttttttttttttgccgtagtactttctacctgagggaacctaaatagagtcattgtgtggccatttatggttgccactgttcacataaatatgacactgcacccagacagaaaattccagcctctctgagacactttctctaatatctcacagatatcaataaagggcccactgaagaaatggaatggctggggagcagagtaggtcagggtcgaaaagtttaaattgttgcttctctaatttttgcatgtttctatgtgagcagtttcaccttcttgagcctaagttttctcatctttaaaatgagaagtgggctgggtacggtggctcacgcctgtattcccagcactttgagaggccgaggtgggggcggattacctgaggtcagaagtttgagaccagcctgaccaacatggcgaaaccctgtctctactaaaaatacaaaaattagcctggcgtgttggcacatgcctgtagtcgcagctactcaggaggctgagacacaagaattgcttgaacccgggaggtggaggctgcagtgagctgagattgcaacactgcactccagcctgggtgacagagtgagactccatctcaaaaataaataaaaataaaataagaagtgtgtggatgttaagccataccttgtatggtttgtggcaaggactaagtgagtgagatagcgtaaatgaagctcaatgcgtaggaattacttagtcattgggtttctttggacaagttacttcaacctctcagttaaagtaacctttcagttaaagagtttcagttgcctcatctattaaatagagatgattatacccttttccctgcctgtttttcaagactgtagtagtgaagccaggcatgatgactcaatcctgtaatcatagcacttcgagaggctcaggtgggaggatcacttgagcccaggagtttgagaccagcctgggaaacatagtgataccccatctttgcaaaaaaatttttaaaaaatcaactgagtgtggtgatgtgcacctgcagttctagctacttggaggctgaggtgggagggttgctggagcccaggagatggaggctgcagtgagctgtgatcacactgctgtacccccgcctggtgacagagtgagatcct

SEQ ID NO: 599 - DNA, 1053 bp, Homo sapiens
ctcactgtagccacgaccttccagattcaagcaatcctcccacctcagcctgcctagtatctgggactatagatgaattatactacactgggttaatttttttattattatttttagtagtgacagggtctcactatgttgcccaggctggcctggaactactgggctcaagcaatcctcccatctaggccttccaaagtgctggaattacagttgtgagccactgcactcgtcctcagttaataaggtttaaatgaattttcagctgtaaaatgcaagacatttacccattgtcttaagctgcctaatgtcatataatatagtttcactgcatgttaattttaaaaattgctttaataatgtatcctttgtatttatttatcagttattttaaaaagcagaaccagtttctcagtttcttgtggtaatgttttctttttgcagactttggggttcttcatgaaagatgcaatcaagaaatttgttgtgactcagtgtattttgttgcctgtgtcttcacttctactttacattattaaaattgggggtgactatttttttatttatgcctggctgttcacattagttgtgtctctggtgagtaaaatctttatttcgttttcttttgcaaaagttccttggtgagattactgtaatcttcattggcatgtaaacagttcttaagaagcagctgaaatataaataggtgcttatatacatttcccccttggtttctgcttttgattgtagacacaggagtattgactgaccataaatttccttctccttatgctaactcttcaggtcatagaaactagttgttagtcacttttaatgattcagttgtcaggcagttttgggttgtgcatttgcgagttgccaccagaatgactaagtgtgataatttaatgactcctgactgacctccactgcctaaaatcatggttattttgaagagaaatgagatttaagagggacaagagaaagaaagcatatacttaactggctttcttctgcttcccttcccttgcctttcccttccacgttagacac

SEQ ID NO: 600 - DNA, 1025 bp, Homo sapiens
cacataccacctaactttctcagtttagttttcctagtttgaaaaatgaaagtgccttgtaaactaatgtgttacacaaatgtctgcattatttacttttaccattgctaatcataaattttttaatcttgattttattagttttacttttgactttattcccttttaagatagtctggttactgggagccacagttagaatgactcacccagtaattccctagtctttaagccaaaaccatttcctatatatggagttctggcatttttgcaaatgtgctttatggtacccttgaggatggtctctggatgtttcccgatttcaaacttgtatgaaagattagaccagggaatttctttgtgtagaaattttctcatagttgtcttaagttttaactcatgtacattaatctttagctttgctttacatttgttttctgttgatagccaagtcattgcttgttaaatattccttagaaatgaactttcctatcaatttaaaattattttagctgtatctgtggcactttttttttttctcttttgagatggagtctcgctctgttgcccaggctggagtgcagtggtgtggtcttggctcactgcaacctccacttcccgggttcaagccattctcctgcctcagcctcccgagtggctgggattagagacgcctgccaccacacctggctaatattttgtatttttagtagagaggggtttcatcatgttggccaggctggtctcgaactcctgacctcaggtgatcgcccaccttagcctcccaaagtgctgggattataggtgtgagccgccgcacccagcctgtggtaccttttaaaaagtaaaaaattcaatggcgtgaaacaacagaaggagttctgcttccatttctagttgttaaacgcctttctctagccaagatcacatatatttctggttttttatagctagtgcactataactctgacagtcatggttagattgatagttttactgaaagtaatttatcaaaatccccatta

SEQ ID NO: 601 - DNA, 1024 bp, Homo sapiens
cctctgcctcccaaagtgttgggattacaggcgtgagccaccgtgcctggcccatttcttttttttttcttttctttctttctcttttttttttttcctgactcttaacaccactcaatgacccatctttacaaaaataaaaaattcagctgagcgtggtggctcatgcatctagtcccagctacttgggagactgaggtgggaggattgcctgagcctgacagcccaaggctgctgtgagctatgatcgcaccactgcactccagcctgggtgagagagtaagaccctgtctcaaaaaaaaaaaaagaaaagaaaagaaagagtgaaaaaaagagtaaagggtaaatgaaagttcataacctttaaaaaaaaagtccttatcttttagagatatatgctgaagtatatacagatgaaatggtatgatatttaggatttgcttcagaataatccaggttggagttgaggggcagtgggtgggagtatagctgaaacaaaattggctaggagttgataattgctgaagctcatggttaattatgctctgctttcgtttgtttgaaattttctgtaaggtaaaaaccaaaagaaagggtagaagagatgttacagtcgggtttagactggggagccaaggaaagactcctttgaggaagaaacatttcagctgagacccttgtgatgtataggagttggccaggctgcaagtggcatttggcagttagggaaagagtttttttaggcagcaggagcagcatgtacaaagtccagcaagccctgaggaaggaacatgttggtcccttgaggaaatgaaagaaggctgctaccataggaattgagaggctgcggaaggaggcatgggctagacctttaagaccttggaaactatgttaaggattttgttatttaatccaatagtaatagaagaattttaagcagcacaatgtggctttgcttctttaagagctcaagttggctgtttggtggagaatggttttggtttgggctcaagggagaagagaa

SEQ ID NO: 602 - DNA, 1067 bp, Homo sapiens
tgtatattagatttattgttatcatctttaaaaagctgtaacagctggaatgcatacatgaatcttgcatgctgttagcttggtgggcttggagtgagactcctaagttaatgagtctggctggcctaagagctgtaccttgatatagcttcattattttttattctcttcctacattgaaacgctttaatttcaattttttctttcttgggagtaaaagggaagccccccgccccccaaatccagttgctaaagttggtaatggaaatcagaggttacgcttaaccagaaaatggctttagaaattgctttagattgtatttatagatgtattaaaggtctaaaaaggtgagttacatttttcagttacacttcactctgttttatgaaggaaattatatgccatggagatagtcgggaatttggagatttaaaaagctcttgggatttatccctcacaagtgttaaggagtctacttaaaagcctaatgggaaacacatttattggaattgattaatagtataaactcagaatgataacactgatcattgcctgccaagtagacattttaattggtagctgtgtatctaagagtttcaaatgagatcttgatttattactgaattgaatgtatcttggtacacaaatatttcagtaaaaggaacctatggagtgggggaaagacagcttggggcaaatgattgggaaatcctagtaaggtagagggaatcatgaattggaaatcagaatacacaagtttaaatgttggttctgacactctctaggttggttcttcaattgtacagtagtggaattgggtgagaagtttttcagttctttcttgatctgacgttccatgtttctacattctctttggtcacagtgcatgcaagagatgggaaatggaaaggcaaaccgactttatgaagcctatcttcctgagacctttcggcgacctcagatagacccgtatcttttctggagcaacttagaaggctgagtggtattttgatgcttggggagagtcagacaagactccagtcctgtaatgtgactgggtcatctc

SEQ ID NO: 603 - DNA, 1084 bp, Homo sapiens
taaatctctgtttgttataaattaccaagtctcagatattctattatagcagtacaaaatggacagagaaagtgactttttagtgtgttgtgctatctggtaagccaagtcccccatcaccgttcttttcttgacttttcttgtgtcgtattggacctttattcttgcataaattttaagattttaaaatctagttccaaaatcaaaacaaaaccctgctgggactctaatcagaattataatcattttatattatctgacattgttatgatagcaaatctcctctatgaatgatatacattttcatttacacaaatcttgttttatgccttttaatgatttttatttgtattttcttcacctttattttcttattattaaatttgttctaaatattttataggtagaattactccttctgaggatggaatatatcccacttccattctattctaggtgctcatttcttttttttgttttttttttgagacagagtctcacactgttgcctgggctggagtgccatggtgcaatctcggcttgcagcaaccactgcctcctgggttcaagcaattctcctacctcattctcctgagtagctaggattacaggtgtccatcaccacgcccggctaattttctgtatttttagtagagatggggtttcattatattggccagtctggtctcgaactcctgacctcatgatccacacaactcagcctcccagagtgttgggattacaggcgtgagacaccatgcccagccctactaatttctacatgctcatttctaaagcaaggaaaatatttattttgtgtgtatttcttatgaggcaactatctcacatcaattctcctattaattctagcagtttttgttacagactttttctagatatggtatcatgtcatcagcaaaaagatatagctctacctcttcttttccaatatttgtgctagttttcttattttatttgacaaatactctaagacaatgttacaaactaatatgatggcaagtttctgattttatttgaaattgttttattgttacactatttagggtaccatttacatttttta

SEQ ID NO: 604 - DNA, 1021 bp, Homo sapiens
gcaagcggccgggagggcgcggccggaggcagaggccaggcgagacacccggctgcggcctaagaggccaggctgggtgggcttggctgcagccgccagccccgtgttaaagcggcagccagggaggtgtatcctccccggggtctgcaagacgccggctcagggcatccctcccattccggccctcaaagcctcgctcctgggggcgctgctgggaaagcccacccgcctgggcgggcccttgatgggaatgtggagcagaccctcgtccactccggaggccgagggtcctccgggcttccgaaggaagccgacctcaacgctggacgcttcttggagaatgattgcgttgagtggagatgtggtctgtctataaaaggccgggagggaacaatatctgttaccactcagtccgtctctaaagagacactctttaccgctgaaaacctcaagagtgagcactcccacgcccccgtctctggtcctacctgggtccaaggccgatgtggtgagtaggagtctgtgtgcagtctttgagtccgagggtggcatgtctgggagcactgtgagggtggggcatcttcgatatgaagcttctcagccattaactgtttcccgagtaagattcgaaaattcgtgcactttggtaacaagactttttatgtattcaggggtgggatatttctcacaagctccaattcctagaacacacgcagctcctgtctctgcatatagtcacacacacacacacacacacacacacgcctataagtcacatacccatccttctccaacaaacttcaaaaagttgggccagctcccttcccacgtagctccgactgttcttggagtgccgtatactttggacctggtcacggtcaaagcacctgctcagattctagggtttggttgagatgatggatttgagttgtttccaaatttgcctattactattctgcagtagtcctcattatactaaatttacaccatttgaagacataccctcttccccaattttaac

SEQ ID NO: 605 - DNA, 1025 bp, Homo sapiens
tatatagatatatctttggagaaatgtctctaaatcctttgcccatttttaaattgtgttgtctgtttattgttgatttttttctcccctccccctattgttgaattttaagagttacttatatattctagatacaagcctcttatcagatatatgatttgcaaatattttctcccattctgtggattttcttttcacattcttggcagtgtcctatggagcacagaagttttaattttgatgaattcctatttattttttattttgtcacttccactttttctgtcatatttcacaaatcactgcctaatccaaggtcacaaaaaactttttttctgttttcttctaactgtttgatagctttgtttcttacttttagctctctggtccattttagttcattttcttatatgatgtaaaatggatggggagttcagtgtcatacttttgcatgtggatgtctagtggtctcagtaccatttgttgaaaagacttttttttcccctgttgaactgttctggcaccagttggatatgtttaataagatttttcttactatcacaaagcatatttccgaatcaagcatgtaatcattataactgattttctacaaactcaacagtgaacatgatatgatattaaggagctgccttgattctcttgcaagttcgctagtgatacacactttagtttgaagataaatgtgctgttacaggaatcagtgacattccaggatgtggctgtggatttcactgcagaggagtggcagctgcttgattgtgctgagagaaccctgtattgggatgtgatgttggagaactatagaaacctcatctcagtgggtaaggacaatgagtggtaacttttcagtgtaattcagtgtatactaatagtgctcattttttaagacttgggaacgtttgccaattgtggtcgctcatgcttataatcccagcactttgggaggcaggagaattgcttgagcccaggatttcaagaccagcctgagcaacgttgtgagactg

SEQ ID NO: 606 - DNA, 1092 bp, Homo sapiens
actctaccttgtgcctaatttactgtctttccacaggtcacaagttaaggcatctgctcccattccctcttcagcagttttattcttaaagctcaggaggagtgaggcaaatataagatttctttcagaatgagatactgtatttgaaattatagacgtttttctctatagcatgttgatgggaaaaagtaactaggaatgttttgttgtactcctttttagaatctgactacccacttgttgatgaaccagggaagcatcgggaaagcaaagacaattttttgaagtcagttttgctcacattcaataaaattctgactatggagagaatccaccattataatatgagcacaagtcttaatccaatgagaaaaaaatcatataaatcgtttgagaagtgtttgccacctaatttagacttacttaaatataatagaagttatactgtagaaaacgcttatgaatgcagtgaatgcgggaaagccttcaaaaagaagtttcatttcattagacatgaaaaaaatcatacaaggaaaaaaccttttgaatgcaatgactgtggaaaagcctatagcaggaaggcacaccttgcaactcatcagaaaattcataatggagagagaccctttgtgtgcaatgattgtgggaaggcgtttatgcataaagcccaactcgtggtccaccagagacttcacactggagagaagccttatgagtgcagtcaatgtgggaaaacattcacttggaactcctcatttaatcaacacgtgaaatctcatacacttgagaagtcatttgaatgtaaggaatgtgggaaaaccttcaggtatagttcatccctttataaacattccagatttcatacaggagagaaaccctaccagtgtatcatatgtggcaaagcttttggcaacacatccgtgcttgttacacaccaaagaattcatacaggagagaaaccttacagttgtattgaatgtggcaaagccttcatcaagaagtcccatctcctcagacatcagataactcatacaggagagaagccctatgaatgtaacagatgtgggaaagcattttcccagaagtcaaatc

SEQ ID NO: 607 - DNA, 1080 bp, Homo sapiens
aagagagggtgatggcctggcaggtactttgggggtagcttaggccatggcctgggaatgggggacactcactttcagaggtgcttttcctggtacatgcatggcccaagattggggtgtgcaggccctcagggttccaggcttggaaacaccgaaacccaagtgacaggctgagagtcttcgagatccagggttgctaatgtgacccagtttggaagtggccctgaagtccacggtgtgagtgtatggtgtaggaagaaaggcatcagggctaggggcatagctgaacggtagaatcggatcagggattttgctggagagtgcaagcattcaaacactgaggttttggtggagccctggagtccagagtcaacggacctgggatgtgatgtgaggagcaagtaaaccgagagaggaatgctattgagaagtgtgctctgtccgagcctaggaagcacagcattaagtagtatcagatttaaagtgacaaaatctgatataggaagcattttaggggacattttcggacttgggaagtgtattaatagaacagttatacattattgagtctcaggaccatacaagtagttttgagatgttgtatatgaaatttgctgctctaggaaggatacaggtcatggctgagtttccaaagccacattagcaaatattaggtagttggtagttatttgttgagtaaatattgttaggttcccctttaagggaaagggagctagccagaaattttcggtcttggtttatttccttgtatatgtgcctaaaaagtatacccattcccatgtgtactttgaattttttgtttgttttttcaaataagcagctccaaaccaaaaaaaagcccatgcatagcttcttaaggaacaggacttgtcaacactttctggttcatattcaaaaagtttttattccaatccagagtcgttccagtcaacttgttgggaatatgttcttttccactgaatctgaatcgtagttacttgtattgctttacatttgctcgtcccagtgtgtgagggccatggaaacacatttatgttaaacatctgtgttttcctaatt

SEQ ID NO: 608 - DNA, 1038 bp, Homo sapiens
gcaagacactgttatttaaaaaaaatttttttttaagttcttgaggaacctgtgtttgttcattcagtagatgtgtattgaatccccactatgtgcaaggcatatttgccttgagggtgtatcagaaacaaaatgattatgtttgtcttacaaacgggggaaaaaataggagcatgaaaaatttaagcttaaaaaataatatgccccctaaaaaaagagaacatgttacacaagtctgaagcaagtgaatatgctaattagagaaatagatttgattgtgtgccaggaatggtttcttggggagaaaaaaaatttatcatcactgattagtgaatgtgtagacagtgtttaatttctttacatttgtactgtaaaggcaagcttcttatcaatgctattgcagaagagccttaaacattggtttcaacccatgagatagtctgagaaattccaactttccagaacatgtttccttcatgttcacttcaggatgttggatatagatggaagtgggtggagctctctttagagctccaaacagaatcttttgcttggatggtggggccaggttgagtggggagctgcctggactccaggtttcctctaccctctaacataaacaagattcctttcacaagacaaaacaggcacgtactcctagcttgtggaagtcttaggtatccaaggagatggtggtggttgtgggtttttttggggtttttttttgatacagggtctcactctgttgccaggctgaagtgcagtagtgcaatcatggctcattgcagtctcccagctcctcggctcaagtgatcctcctgccccagcctcctgagtagcgggagctacaggtgcgtgccaccacacaggctaatttttttttcttttttgtagagacgaggtctttctatgtttcccaggctgatcttgaactcctgggctcaagcgatcctcctgctttggcttcccaaagtgctgagattacaggcatgagccaccgttcccagcccaaggagacatattctaagaattgaaggc

SEQ ID NO: 609 - DNA, 1879 bp, Homo sapiens
gttttttattttttattttctattgagatgggggtctcactatgttgcccaggctgatctcgagctcttgggttcaagtgatcctcccgccttggcctcccagagtgctaggattagaggcatgagctaccatgcctggctgaacctttttccttaaagggccagatattttaggctttgtggctgtatgatttttgttgtaactcttcaactctactgtttagcatgaacagacaatataaactaattaggggctggacatggtggctcacgcctgtaatcccagcgttttgggaggccgaggtgggcagatcacttaaggtcaggagttcaagaccaacctggtcaacatggtgaaacccgtctcttcaaaaatacaaaaattagctgggtgtgatggcgggtgcctataatcccagctgcttgggaggctgaggtgggagaatcgcttgaacccgggaggtggaggttgcagtgagccgagatcgtgccattgtactccagcctggatgacagactgaggctccgtctaaaagtaaatgaataaataaataaataattagggttgatgtcttccagtgaaactgtttctaaaaacaggctgtaggccagatgtggcctatgagctgtagtttttagacccttgctttagaatacttcactaaatacttgatcctttttcttcatcatacaaaatactgatagtgttttattgctgttatatatgcagagatggtttaagtttgagcattgaaaggatgagtaagaatgtgtgtgaagtaagatgttacatatcgttttctattccacagaaaaaagttttcaaatgttctgttcatgccttcccgtcactttcattgtttataccagttgctgtgccttcatttttctctagttgtgctacaactatattatgatctggcccctgtttcaaagattatattgtactagataccaaatagaaaagtatttttgtttttgaaggaaaagtggctcttctgccagtttgaaaatgtgtccttgtgtacagatctttaaggagagcagtgtgcagccacttctaagcctaagtcttttaggaagcatggttttccagtaggcactttgaaaagcggcttcctcttaacacagatataccttcaaacgtcaaacttggcattaatcagagttggggaagtagagctatgttattcattcttgtattatagtagtgaagactattcagtagcctgccagtaaatatgaccagctggtacccagctatgtaagggtttagaatgtaagtaataaggtttcaggcactaaacgtagtgcctgaacttagtttcctgcatgactatataaaaaccttagatgagtttaaatagagactattgaaccttctcttctctctagtcactttgccttcccttgtattcattcatttattgcatcttcaagtagtgaagtgtaggacttccccaccaaaccaccagagacccctttggaatgtgttcagtatacatcattgctggagtggcttagtagagtgactggcccagggccaccagctagtaggcagcaagcgtccagtacacagacgtaggtcttttaatttccagaccagtgctgtttttcttcttgtgaaattgtcaattttagattggttttattttggagagtataagccttcttaagaaatgctttttagctgttgtgatcgataatagcataagtcctaaggtccatctgtgtaaacataaaaaccaaatagtctgttagtaaataaatcctacccccctttccctcatccatccatttatttttattaatattcttcctttctctgtatctcccatcatcatttaaaatataacatcttacaaaccttagctcattt

SEQ ID NO: 610 - DNA, 1036 bp, Homo sapiens
gaaagatatttttgtttgccccatttaaaaaaggttaaattgagtcactgtcttcattttcatgagtaccttgtagaaaactattaataatgataaataactaaacttctctagattaccttaatttttttgttgttgttctcagtacatctaagagagtagcatataggccatgtgtatgtggtgataaatgaaaatgcaggggtcttacttggttatttaggacttaagattttatctagtcattttcaactgtgattgaacacttccctttaactcccttcagaaactccaagatcatattgtatcccaggtactagaatttctgttcagctgtttataggcctccaccacaagaaattggctccaaacctattcccattacatcatcacccactaatgtcattacaccagaatgaaatctgctttgaggcttgtattgttgttttccttccatttctttcccctcatcatttcctttagaaggaaaagggaaggaaaaaaaaagaaaaaaatcagagacctgtaaacatttaagagtgaattggacatccccacaggctaaacctagagttgtcagctttcattccattctgctgtgatagagtgttctgcccagtatgtatccacatggagcctggaaagtaacaagtctggtcatgtgacaactggctttggtgctttgctttcagcccctcagaattagttcctaatggctcacatagctccctgccagcatcccgtcactggcacgttaaaccttttcaaataattcctcagaatagagattcttaggagagcactaaatttctccattctttgtgtttaattaaactgttcttgcattttaatatttgccagataagcgcttaagacattacaatacaggttgagtatccttaatctgaaaatctgaaatccgaaactttttgagccctgacatgacgctcaaaggaaatgctcattttcgattttggattttcagatttgggatgctcaaccagtaagtataatgcaaacttattccaaaaaaaaa

SEQ ID NO: 611 - DNA, 1027 bp, Homo sapiens
tcatgatgttgaccaaattttagtacctagacttagtctatcagaagttaaaagagaattactttgagggattcagttttggttcaagttttgtgggtgaagagaaagaaaagtaaagaggaagttgtctttaatccttcttgtattggtgactaattaaaattctcctcctatgtacttttgaaagggactcctagacctctgccatgctatgtcttttatatcaggtgcttagaacaatgtctggcatgtagtaggtgcacaataaatatttgaacaaattagactccacttcaggtttagtgcaaagcaacatcaattccatatttgagtaagaatgcaatccagtaaagtcagggtaatttttttcccttgtgtgactcttattttcccctcttctcaggagtgcaacacgtgatggcatctgcttctctgactgcgctgctgcctgtgtaacatgaccaaacattttagcatttaatctgtccctttccagaactcaacagtacttaaaaccagacttcctcagatgtgtcagagcctcttaggttgacacctcacaatatctaacagattaaaaagaaaaaaattccttatgtttaaactagccaatcataagtaaaacttacgagaatattcataaaatgtgatctcagactgggacacaatttgtttcaaaaagaagtaattgaagtttgctagatgatatatttcatgatgtgttggaaacactggcctcaagtccttttggtctgcgtcctgtaaaagcaatttatctttcattttagcttgttctcatgattcttaaaagctctgtagttgtctataaatccaggtggtgttcagctgggattgaaattagttaaaaaccatatcaagatgattgtgcaccagagtgattgtgtaaaaccctatattcccgcacagcagagctctgggaacagcaaataacagacttcttcgtgttgagttttgccccagtgggcctctttgaaaataggaaagagaaagctaactttgtctttat

SEQ ID NO: 612 - DNA, 1031 bp, Homo sapiens
caaggggaaaaacaagaatagaatgaacctgcgctactgtttccttttgttgaaattttaataaactgaacttctaagtctctgttactccagggttagttttagtagagggttcatggaaaatgttgatacctaatttggaaaaggaaaagatgaaaaattggtgtttgaagtttgtagagcagagtggtagccaagcagcttgttgggtttgcatggaaaaattagatgtcttggtgtacattttatcctaatagattctcttctttctataatcataaaataggttctgggaagactgttgatgtttttccaaaatacctttttttgacatatatttgagattttctgttggtcttgcaaaagaaagttcacttatgcttgttaattacatcaaatctgaaataatatatgctccttccataatgtgatgatgcaaattcccaggtgagcatattaggtttagtgagtcacatttcagaccacttatagaatcaatcatttgacacctagtcccagtagagattttgctgattttagctaatatctgcctttgcaccttcctcttcattgcagctctgaaactcaaaattgatttttttcctagaattgcatccatcattgggcatgtgtttaaataccagtagtttcaaaataaaacaaaaaagggcttaagtctcaaattattgagtagtgctgatcaaaaaagccctttcctaaactatatccacagtgaagttatatggtcctcccccactccaggcttgttaagaaaaaataacacagctgttcctaaaaggcagctgacaaattcaccctcatcctttttctatactcctctacccccacttgaaacaaattttggagacaaggccattgctactgtgatgagaaaggagctctcctccccagtttctgttgtcaggttagtgcaaatgtcagaaatggccactatcagttgtaaagaactgtggatcactgtggtcaagtgccccggcgttgctgttagtttggtcactgaatggaagaaa

SEQ ID NO: 613 - DNA, 1025 bp, Homo sapiens
acaagaaagaatatgaacgtctgccttcccgtctcttctgcctgcccctctccaaaggtcacactagttgttttttcagcaccttgggtgcatatagctcttaattgtgattgtaatagacctctgtcctttagagctcattgttttaagcatgcagattgcatgattcactaggtgccacttgggaaattgtggcagaatctcacaggagcaaagctgtgccttgttctgcttgctttgttatataaaactttatttttaatgaattatttcatagtatattatccttagaagcagtcattcagtgacagccattctccccatcccagcctgtattaataaccagtcagagaaagtctaggagaagtgggcatcctaatgaacatttgtaattctgaccctgcatgagggcctttggattagcaagccctctgtcacctccttactagagtagggtgtgcctcactgcgtctccgttctttctgggcagtctttgctactgtaaacatccttgactggaagctgtaaggtgttcagaggagctttcagtcggatgtttacagcggcaggctgccacggtcgtccccagctacgcaccggctttgaaacattgcaggtttgtgcccacaggctcaattcctcctcttgggggtccttccctcctctctcagaagtcacaacaagaactcaggccatttatcttccttcagaacaaagagtatcatacacctgctttccttgttgaaattgttttctccttttgtctatcagaagccccctttaaaacaagattgtgagctctgtgatgaaatcaggccttgctcactctcattgtgctaactccttgttttctgtgggctgcctgctgaatacactggctggagagaagggtcacatcctgtcagttcctccaaattcctcagtgcttctgggtctctcggggtgtcatacagctccttattccatcttagccagactcaaaatgctatgatccatctgattttaaagtgtgtctagctgaaaca

SEQ ID NO: 614 - DNA, 1073 bp, Homo sapiens
agggtggacacaggtagaccaatgagaacctgcttcagacttccacgcatgagaccgtggggacttggaacagagtggcagctgcagaggtgggacaagtggtcagattctagatacattttgtaggcaaagttgacagggttttctgatggggtgttaagagaaagaagagagtcaaggatgaagctaaggtttttggcttcagcaagaggaaaaatcgagttgccatttgttgacatggagaaggcaatgaatggagcaagtttcggtcaggagatttgggaggtgccgggtttgtgatgcctatctgacattcaagtggagtgttgatctggcagttgaatagagaagtgtggagtgcagagcagaagtacaggatggagatgaagatttggtgtcgaaagtgtagaggaattgaaaattatggatctgaagacatcaactagtgagtggagtaaatagagaatagaggtcccaagagtgagccttggatcctgcagtgtttccaggttgcagagatagaggaggaactaacaaaggagactgtaaaggagaggtcagggaagtaggaaaagaactgggagagggtggtgtttcaaatgaagaaagggtttgctggaagaaggggtgatcagatgtgttgagtgctgctagtaagtcaagtaaaatgaggacaggagttgatcaatggatttagcaacatggggttatttgggagcttgacaacagtagttttggtgaaatggcaggggtgaaagcctgactggagtaggtttaagagagaaggggaggaaaggaattggaggtagaggatagagataacactttcaagaattttgctgcaaaggagagcagaaaaataaggtgaggtcagttctagccttgtccacccaccttaaaagtcacattcccacgtgtctccactcctcccatcctctttccccttttccccaatccatcttttcttttcttttcttttcttttttttttttttgagacagtatcttgctctgtcgcccaggctggagtgcagtggtgcaatcacagcgcactgcagcctcgacctctccggc

SEQ ID NO: 615 - DNA, 1207 bp, Homo sapiens
cgaatcagctcggccgggctcgtcggacggagaaggccgtaggggagtggagcggcgcccccccccacaccctccgcccttgctcttcgtctgcgaggaagcccggcagtcgcccatccattcaagcagtgcgggcctcgggcctccggcctcggcgcgggctcagccgcccggggctgggcgcggcagctccgcgccgtaggacgagggggcctgcgaactcgccggccctgggccccgcggctggcctttgggcctcacggcttcctcccttcccggcggccgggggtcggggcgctggcggtgtatagagctcaccacgtttgcgtggcgcccttccgtccacgctcgttacagtttcgaatcctcagcggccctgtgacgcgggcggcgcagagattctcacccccattcccctaggtgagaacccgcgttgcaggcagctcaagtgacatgattgaggtctgcacactagtgatgggggctggcacttcatctcataacattgaaagaaaaagcatttcccccctcagtctttgttgaatttctctgatgcgtcttgatttacgttacttctgtgccggaaaaccttcttgcgccttccgtcaccttcaggattaagttcagattgggcatgccagtttgcacatgatctggcccttgcctacctttccagtttatcttccactgtatatccctgcttccccgccttccccctcacggccttacctctgttctctgtagctgccctgcacctgcctgttcaccctgttccctttcctgtgctctgagtcgtgcagtcagtccttcaaggcccattgcaagtcatatctacaaaacaggagccgcctggatccgcccactacccccaggacttgtctcaccttcctctgatggccatggtactgaaagcgtctgctctcatcgtccccctttatagtctaaacatgttttctgtctgcttccaccgtcactgaattactcatttatttgttaatgtttcatctctccaactggactgccagaaagttgagatatgggcccaaatctgattaatgtttgcagtccccaagcacagtagctgtcatgtaagtcagtagcccataaggatgaatgaatgagcctcccgcctgatctttatgtacactggcatatgtattgccaggcactgagactgcaagaatctaaagagagaaactaaagaacg

SEQ ID NO: 616 - DNA, 1416 bp, Homo sapiens
gccatctgcctgccttggcctcccaaagtgttaggattacagatgtgagccaccgtgcccagccaactgatgctttttcagtacaaaaattatttatggttaactaaggagataagatttaggtttttcttttttttttttttttactttgtcactgtgatagagataacattcctggcacctctctcatctgacctttttcttgaaatgatgtggaaagttccataataacctttgggaaggatgagcctgtccaaaagaataaccttttagtacaaagagttgtctaattcctgttaactgttaactaacattatacagggttagagagtccgtgttacataattactgatactgaatcaggaagacagaacagttgttagaaaactaaactgccagagaagggtttagtgcctaacctctgaaacaactttgttcttctagcttggtggaaccgtgggggacatagaaagcatgccctttattgaggccttccgtcagttccaattcaaggtcaaaagagagaacttttgtaacatccacgtcagtctagttccccaggtaagtaagacattgaaagttttactttgggggagatggagaggagggaggaaaggtaaaccggaatgattttcactcattgtctagtagttttcacttgaggtgcaggaagcagagaataaagaactttgtaagtttaaatttgttacaatcatacttttttgaaaagatcaaatagaaaacatttgaaaaatcagggcagttgcatttgcagatgtagattggccgtgtgcatttgtctttactatatggtggaactagagtaaagaggctgtttttaaagacaaatcttgtggagaggagtcaatagtaacaaaaattgggaagccggaaagcagatggatgcatagaaccgactaagctgaccttgagtgccggatcttaagcccgcagcagtgaaagcagagaagcagccctgtttgccctgcagaaccccaaaagctcaggagtgggatgagggtgggcctcatgtaactactgcttcagaagactcagaccctgacatctttttcctacagtgcacagttgggcgttagcctcctcccaccttggcagaagactggaggcttgttctctggggagggttcctggatgagcagacagtagggacagttgagggcagtaacactggactacaaacatggggttatgtgtaatgttaacgctgttgacagtccttgccttcttccaccatttggttcccagaatcatcatgtttaggcttggccattccacgtaggaggttgtaagattgtcttctggggtatggatagcccaggataaaagacactggctctggcggctccccatgaaataagccagccagattttcaccatgacaagcctacacactca

SEQ ID NO: 617 - DNA, 1055 bp, Homo sapiens
gaggcttgttattttctaattagagatagtgggctgttccagaagaacccattgccatcggccattccctgcctctcctggttccccaaacaacacctgtgtccctcctgcctcttctccgtgcctcgttgtactttgtgcttcagccgggtggagtatctttcggttcccctagtaccctccactctccctatgattgtactttttcactggctaatttctgttaagaacccatgtccccctcttcctgttggcttggcagtctcctactcactctcatccttcaggttctagcgaagacatagtgttgtctgagaagctttaactgccaaacctcctggcccttggccttcagggttaactgcgtccttcactgggctcctgtgtggtgtcgcatgtatgctgctgatgggcccatctttctggtgtgtgtgtgtgtgtacatgtgtggtgtgtatctcccttcacagactctaagcttctggagggcaagggccacctcattcaactttctgtttctggtgcctggtgtctagggtgttgtaggctgtcacagagatcttagtgtttttgttactgtacctatgatgcaggaaatccaaaatttggaacctgtaatgtatctaagtgtggtgcttagtatggaaattctagtggtgatacattgagcatgtagctttggccaggttttagatatttctggcctagcaagtgaaggaaattcaattctgtagcagaataggttgtcattaaaattgttcaattttttttttttttttttttttaattgagacagagtctcgctgtgtcgcccaggctggagtgcagtggcgcgatctttttggctcactgtgacctccacctcccaggttcaagcgattctcctacctcagcttcccgagtagcttggattacaggtgtgcaccaccactcctggctaatttttgtatttttagtagagatggggtttcattatgttggccaggctggtctcaaagtcctgacctcaggtgatccacctgcctcagcctcccaaagtgctgggattacaggtg

SEQ ID NO: 618 - DNA, 1028 bp, Homo sapiens
gttattttttttggtctttggtatgaaaaaaattttttgtaggcaaatttgtgtgagacgttgaaactctttgtaagtttcaaaacaaaaacaaaaaaaaaatttttctttacaaagcctgccatgttgatctgaaaattacttcctctttactggtctgtacacagaactcagataatagctattcccgttatattcttcccaggtgtgtttttgttgttttttgtgggggttttttgaggcagggtctcacactgttgcccaggctgtagtgcagtggtgcagtcagctcactgtaacctccaactcctgggctcaagatccccccgcctcagcctttcaaagtgctgggattataggattatgggcgtgagctcatcctggccagacgtggttttttttcccttgaaatagctattttggtctcatgatagcgtgtaccttctgagtaattgggtttttcttgacgtttatttgatagatatgatcgcttgctggagacctgctctattgcccttgtgggcaaatacacgaagttctcagactcctatgcctctgtcattaaggctctggagcattctgcactggccatcaaccacaaattggaaatcaaggtaaggagggtggcacaggtacagccaaaggatgagcagggaagcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagctggaggctcttggagactttgttggcatgtgggctgcctttcctaacctgtgcttatcacttattgcagagtgggaatgacagtattg

SEQ ID NO: 619 - DNA, 2639 bp, Homo sapiens
cagcagctgagctggtggaatggtggggcatggccctgcttgtctgtgggtggcagtagagtgtcatggttaagagcatggatgccgtggctaggcgcgttggctcatgcctgtaatcccagcactttgggaggccgaggtgggcagatcacgaggtcaggagattgagaccgttctggctaacacggtgaaaccctgtctctacttacaatacaaaacattagccaggcatggtggcatgtgcctgtagtcctagctacttgggaggctgaggcaggagaattgcttgaacctgggaggtggaggttgcagtgagccgagattgcacctctgcactccagcctgggcaacagagtgagactctgtctaaaaaaaaaaaaaaaaaaaaaaaaaacatggatgcctgagcccggtgaccagggctcagattctagctctgtcatctacaagcggtgagacctagacaacttacttaaccctctttgtgcctcagtttccacattgttaaaaagggatggtgatggtgccttcctcctagggttgttgtaagaagttcatgaatacaaagtgctgagaattatgcctggcatatggtaagcactatgtcagctgtcgttaaaccctcccttctgcctgtcccctttattccttttcttcctggcccatcagctgaagcttttcaggaagagatgaaggtcagaggtaaagttggggctcagtgctgaggttgttaaacaggccccatgtagctgtccccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaaggcaacggtctccgcctttaaggaatattgagtctcttaggaaggaaggagcacataggagaggctgaacctgctgtggcagacacatgaggaaggcagacttcctcatggagggacaccaggttgggttgggtaggatggagaaggctcggaaggggcattcctgttagaatagatagagcacgtccaagggcttggagatgtggagcagttggaaacactgtggatggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcagatgaagtcacaatgagatagtgacacaaaccccctagagcggctgagtgttagagaggctgtggagctcttaccttgctgccgggagtgtaaaatggcaccaccacactagaaaacagtctggtagtttcttatcaaggtagagacgtgtgatccaataagtccattcccagatactcacttgagagacttgaaaacgtccacaaaaaaagatttttattcaaatggacaaattattcgtaatagctgaaatctcgaaacaacccaaatatttatagcctgtcaatggatcaatttgtaatggtttatttatatagtagaaaccactcagcaatgaaaaggaagaaaccaggctgaacactgactggctcaagcccataatcccaacacttagggaggctctgctgtgggaggatcgcctaagaccagtagttcgagagcagcctggtcaacatagcgagacccccgtctctgcaaaaaaaagttaaaaaagaaaaggaacaaacaactgataaacacagcaacatggatgaacttcaaaaacactaagcaaaagaagccagacacaaaaggttatatactatttggctccatttatatgatgttctataagaggcaaaacgaatctgtgatgatagaaattggatctgaggttgtttggggtaggaggtagaggggcacattctgggaagatggtaacttatgttttgttttgttttgttttgttttgttttgttttgttttgtttgagatggagtctcgctctgtcacccaggctggagtgcagtggcatgatcccagttcactgcaacctctgccttccaggttcaagcagttctcctgcctcagcctcttgggtagctgggactacaggtgcatgccaccacacccagctattttttttttttttttgtatttttagtagagatggggtttcaccatgtttgccaggctagtctcgaactcctgacctcaagtgatccacccgcctcggccttccaaagtgctgggattataggtgtgagccaccacgcccggctcattctatatcttggtgtgtatgtttgacaaaactcttcaaagtatgcacttaaaatgcttgtattttattgtatgtgaattatgcttcaatatggtagaaagaaaaagaaaaaa

SEQ ID NO: 620 - DNA, 1038 bp, Homo sapiens
ccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagagttcaagaccagcccaggcaacatagggagaccctgtttctacaacaaaaacaacaaaaccagctgggtgtggtcccagctccttgggagatcaaggctgcagtgagctgtgatcacaccactgcactccagcctgggtaacagtgtgagaccctgtctcaagaaaaaaaaattgtgaacaactcagtaccaaagatagtgcagtggcagtattacaattatgtatactatctttttcacttgcaataagcatgttcttaagttactaagaaaagtccatagtttcatatgcagtttctaagttgatagtgtttacatacaattcattgtcacagtagcacaatgtatggggttaattcatggcttcagtgtcttggtaatggcccgttaggcgattattgcaagttggactggtagaaaaggggaattgcctttgtggtttgttcttttgtgcagtggagtgctggttccaggaggatttggtgttcgaggaacagaaggaaaaatccaagcaattgcctgggctcggaatcagaaaaagccttttttgggtaaggagctctgcagtgcagtcttcacttaagagtaggaaagagtggggaacggtgccacgtgggagcctatgaacaaagtggggggattactgaaacatgctgtctttgtggataggagctcaagtagaagccttcatgttttctctttagagacaaattcagtcttggaaagcttatttatgcttatgagctacatgtagatgtcgtggaattttgagagaatgaattgtgaattcctgtccatttaatgaacccagctgtttgtagcacacgtgaggttgagttttatatctgctcacttggcacaacagctgactgtaattggacaaaatgatttt

SEQ ID NO: 621 - DNA, 1033 bp, Homo sapiens
gcctggaaaatagggaaatgctcagataatatcagctcttcgcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggactccaaaatgacaggcctgttatgcaggcacttatcaggcctgctgatgtcccgttggccaaaacaagtcacgtggccaagccccgagccggcaggggaggagaacacacatgggtgtgaagactgagcatgctgcactggggccaccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtggccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccgccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctat

SEQ ID NO: 622 - DNA, 1615 bp, Homo sapiens
tggactgggccatcagtgcatggcccacccagtcctcagatgcttgctaagctgcagggtgctagccctgcatcccttgcctttgagcagtcatcaggctagctggggcgatgacagacatgttatgacacatccagtccgtgtctgtgctactgtatcagtctttctaaggaagtgatgcttaccgtccacagtgctggggcgggactagcctgaggaggggctgctgtggtcctgtctgcagatcaggaggacaggctgaaggacggagcctccacccaaccgaggttacaaatgccaactgggaggcattttcttctgtgacaaaatgtctcataaggaaagcctggagaattagagcttacttacaagcctttgccacccactcagcgagggaggtttctctctagcggaagcagagttctgtagttggtgtctgttttctgaacatctccaggtcgtagacatgccagaacacaacccagggcagatgggcggaaccatgaggctgggcaagaggagaaccctgttccagaccaagaactcagtcatgagtaagagctgcctcacgctggcccagcctttggctctgcgtgcccaggacgcgtgtcttagggtgatgctgtggcttcgaggagcaggctggctttttttggtttcgttcttgcttttgaagttcattctttcctctcttattcatacccttttaggatgcactgtgatagccatagaagcagtgtgggtcttagaaaggacactggcagtgcagtcagactcctaggcatgggcgcctcaacagaatgaggcagtgaggttacattcatccttatcggttactttcctattaagaccagccatatcaattgctgatgtttggcaatttttgtcacacaaagatggcaatttcatatgattcagcctaagtagattctgttctaataaagtactaatagatgctgaaggtttagggtagttttcggaggaaaatagttaagaaaatgactattacacagatttccttcttgtctactgggaaaattctgcctttactgtattagcagaggcacccttgtgtctgtctgggcgttctgtagcagcatagctggagtcacttgagtatcggatctttctcttaccaactctgatgttctgtggatttggggatctcgaggcaactgtgaaatgagtcagtagagcagcccgttcgcaaatgtccagcttgttcacatgcagccactgagggctgatgacctttgatgaccatgattggaactgaatgatcatcagaggtcatctgtgcagctcttaaaatgcctcccatcctgccacgttcccagggccttgccgtttcgtacatcctgatttgctttccaaggcagttttctagcagcaaagtgcccatactttgcaatcatgtgtttgagggtggtggtgagagtcttgtttctgttacagctttctgtagtgttgtcagaaagagtcaaaagcccaagaattagtctaaactgtgttgttaagagcaggtgaccttagcagattcatagaaatagccctcaaaagacctggctgtgtggatgatgaaaagtaaagcaggaaggaggatgtctttgtgaac

SEQ ID NO: 623 - DNA, 1029 bp, Homo sapiens
ctctatttcagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtgaaagtttcctctcctttcccggagctttctcacggtgtttccctggcatattggccaggtccccctttctgcagcatctgagctctggtggtgctgaccagatcacacttggcgtaggaccctctggtccatgttaaggggaactagtttttcctgggaagtaagccacaatgggtaggtttatgtcccattgccacctttatccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgaattctacagggacacctatagtgacaggagtggaagcagctcccctgactctgaaatcaccgaactgaagtttccatcaataaatcatgactgatcttgtagcgtaagtggtactttaaagttttagtttttaaaaacatggtgataacacactgcgattgcaagaatatcatggaagtttagggctgaaaatttttatctgccaggaatgaaagtggtgaggtcttgaatataatccagaggttgagagagaaaagaaagtagtgaggtcattgtgggtatcaaatgggcagcccttcctccaagttgca

SEQ ID NO: 624 - DNA, 2944 bp, Homo sapiens
tattctggaattccttcaaagttggaacaattgccaaatagacgtcgaatgtttgtctattaagtgacagggtttgtaggttcataaagtgcaataactgtgggcactgccacgaaatgtaaatgtcctttgagataactgtgtggactgtgttggcagaagtacgcattctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagagacatgctttgcttctcattctctttatgtcattggccagatgggaagcgtctgagcacgttgctggcttgcttgtgtgcagtcagctgaattgtcagtgccgggtgctcctgcaggtgagcagccttgactcagcagacaacctgagagtttgtttaaaaactaagaaatgaggctttctttttaataggaaccagaatttttcataaagcttcaaatacaggttctcagcatgtagagcgagatgaaaaggtgcatgggtgctattatggtgctatttatgactgagaaaggggagggataagcatgatttaggaaggtggtcctttcctctgccaggcactggacgtgggtaccccatatacacagccagtgagcagtgggccagactgtcttcaccagcagaactgcttgttatggtactttgaacgtggctgattgagcataattctaacctcttctcccacctggtggtaccaggagattgtcttcattttaaattttatttatttatttatttatttttttgagtcagggtctcactctgttgcccaggctggagtgcagtggcacaagcacggcttgctgcagacctcctgggctcataagatcctcccacctcagccttccaagtagctgggactacaggttcacatcaccacgcccagctaattaaattttttttttttttaatagacagggtctcgctgtgttggccaggctggtcttgaacgcctggcctcaggcgatcctcccatagtgcagggattataggcatgagccattgcacctggtcaatagtcttttttttgagatggagtctcacactgttgcctgggctggagtacagtggcgtgatcttggctcactgccacctccacctcgcaggttcaagtgattctgtttgcctcaccttcccaagtagctgggattacaggtgcctgccaccacgcccatctaattgttttgtatttttagtagagatggggtttcactatgttggctaggctggccgtgatctgctcatctcagcgtcccaaagtgctgggattacaggcgtgagccaccacgtctggcccgttttttttcaaacattccccaaactgagggtctgacacgcccgttgttgacatcatggt

SEQ ID NO: 625 - DNA, 1008 bp, Homo sapiens
acacataaaagagtgcctggtctgccacagtagatgttcgaacacatctgttagataaataatgatcacagataatagttacttgtatatttttctttctctccaaccagactatgtctctattgaggcagggtccttgccttgctcacgtctgtatctacagcatccagaggtgccttgttgcaaactatcaagtggcagagctaacacacacctgtacactgagtgcagtggctcacgctgtaatcccagcactttgggtggccaaggcaggaggatcgcttgaggccgggagtttgagaccagcctgggcaacattgcgagaccctgtctctacaaaacaagtaaaaaaatcagctgggtgtggtggtatgcaccaatagtcccagctactcaggaagctgaggtgtgaggatggctttagtccaggaattcaaggttaacagtgagctatgatcataccactgcactccagcctgggtgacagagtaagatcctgtctcaaaaacaaacaataaacaaacaaccacccccctcccccaccgccaccacacacacacacctgttaaagtaaaagggcctaatatttaactctctccggcaaaggctaagaatctcctcccatttgccttcattctgggtcccgggcctaaaaagtcaaagtacactttgtctggcctggcctagtccagccccttttggagcagagattctagcatattgtcttttcaagcttatagttgggcactggggagaggtatgctagagccagcaggggctgcttagagtcacagaaatcccagtggctttttggaggtgttaacagatggaaagttggagggggctctgtgagccagtcacttctccctgtcttaaaagtctactgtgatgctaagagagaaaccaagtgcagagaggctctggagaacagagagaagatatggggagagagtgtatatgcaagaatgtgtctttcttggaccaccttagataattcctctaatcaga

SEQ ID NO: 626 - DNA, 1050 bp, Homo sapiens
cctagctactggcctccacctggcactgcagtggggaaggggtgcagtgggcacaggagaccgaggcagtcctaacagagttgtctctggagttgttctctcctcaggacccacagcaacctggtcagcaatgacattttctcctccatctgctttccagcttcccatttgagtagcgggtactattctttcttgtgtggttgtggctcactagctgaaggggtagaagggcaaaagtctctttgctattaaaggtagaaaagataagagcagtaattgtgtggcccgtggatggactgttgttctccttgggtctcaggttcaccacctgaaaaatgaagtgactgagccagatgctctctgaggattctccaccttcataattctaattctaaggagaaccaacatggacggaagaaatggaaaacagaaagtagggaggtgatatgtggaaagtgacaggagaaacataaaaacaaaaagaagaaaagggtaaacaagatgaattgaacgaatacatttaactctgttctctccaaaaactcactaaaatgagccagataataagagaggagatgacaataagattaggaaggtggaaagcggactggaaacgtagcgactgactcaacagacccaacaaagctgtataccctaaagctggagtggggagtgatgagaaccacgctctcataatttgcaaaaggcctaataatcggcagagttggtgcctctggaggtgagtgtgagggggatctaataaaagaaggtttaactgaagtcttttaagaaacaggattttcacatctagtaatgtgactcttttactgaaataactaaaaatgcaggaatccagagagataagaagagtaataaaaacaagtgtctatgaaaagacacctataagaatgttcataatagtttattcataataaccccaaactagaagcaacccaaatatccaccaaaaagagaagagatacaaattgtggtacagtcatatgccacataatgacattttggtcaatggcagactgcatatatgacagt

SEQ ID NO: 627 - DNA, 1076 bp, Homo sapiens
agaacacatttcccccaagtgtgtcctgcactccccatgccctggcttactcctccctgtagatgtattcactgtcctcaagggtacagagttcagatgcctcctccaggaagccttccctaaaccctttttagctagcttaggactcccctttctctggccctctccctgctggtagcaggttttagtcatttgtgttctgtctcatttcccctctctaccctgcttttggaagacagtggcagtgtcagaaccattctgtgcccacagcacccagcatacagtcttgacaccaagaagccaccagtgtgtgtctagtgaaagagtagggaactgagtggatggtgcaggatgctgaggcaggggacagtacattgggccagagtggctgggagggcttcttgcaggacatgtagctccagctgggcttgctgcatcaggcagcatggggaaagatgggaagagggaacatgaggctggaagtaagcagagaactgcagttcattgaaggtcttggggccaaacactgtgagaggcaccttgacacatctgcctttaacgctctcagcagtccctgaggtggttttactgtgaccaaatggtctccctccagggtctccaaagccggcattggccccaggtacaaggaaggccctgaggcccgtatttaggagtgaactggtcacacagttagtagatgggaaagctggaatccagcctacatgtgtctccctccagggtccccaagcacctctggaacagtgtcctgctggcgggggggtgggggggtgggagggacacactgaaggctttgaatatgggcaggtataaatcctaaaacgtgattgagaatatgcttggagatagtttagacccatgagttcatttcccagacggtgagactgaggccctggaaggggataggagtcttgccaccggcatcactgagcagcaggccttggatgagggcccaggcctcccgcctgcccattggatgcggtttccacagcaccacactgctagggacacaccgattctccctgtgcctgggctcccagtcacgggctgtgtgttgg

SEQ ID NO: 628 - DNA, 1029 bp, Homo sapiens
tctattttaaaacttcttttcctccctctgtcccaccatttccatccattttatccccctctccctttttcagaaatgacataattagaggggtttaatgttctgctgctgaaatcttcattttcttgggtaatttccactatttcatcaaggaataattaattgcattgtctttaatcaattgtttgacaaatccagcagcgggaggaattctcccaccatccccgcagctgctctcccctcctgggtgaggcgccagctcatgccaacaggagcgcttggctgccagcgctggggtgggtgagtgtagaggaggggcccccagtttccccagcctcctgtgggggaggggagcccaggcagccaggaatccacccagcagccacacggggagcacccagctgagctcaactgtgagctcggcctcctcaaagcccagtcaggtcggcggcggtggggggtggggggatagatcccatttagcagatgcagaagctgaggcttgaggaggatcacagggactgagagatggagagggactcaggtctctcgggctctgagacgcaagacagggaagataagatccaaaactgaatcttagagatggaggctggttaccagtaactggtaaccgggagagaggaaagaggagaagggaaggacgtccccaggcagagggggaaagtgatagtagtaatagcgaatgtttttatggtactcatgaaatggcaggtcctgttctaagtattttatcatctcaataaccctgggaggtggcccctcttataacccccgacttacaggtgaggaagctgaggctcacagaggttaagtgatgtgcccaaggtcacacaactagtgaggggcgtagcagttgtgcatttattcacgaacagtgctgcttcccccagccaccctgtgacaacagacgaatcctatttcactcgtggaaagcccagccccactgtggccaaccacgtgccctcatgatctccccttcaaatgcctctttctcctgtccttcccact

SEQ ID NO: 629 - DNA, 1091 bp, Homo sapiens
gtaccaggctgggcacagtggatcgtgcctgtaatcccaacagtttgggaggccgaagtgggaggattgcttgaacccaggaggttgagagcagcctgggcaatgtagggagaccccatctctacaaaaaaaaatagaatcataaaaattagtcaggcatgatggcatgtgcctgtaatcctagctacttgggaggctgaggcaggaggatcacctgagcccagaaggttgaggctacagtgaactgtgattgagctactgtactccagcctgggtgacagagtgagactctgtctaaaaaaaaaaaaaaaaaaaaaaaaaattcggaacctggatcccttgaatggagtggtcagcgttgaggaaacactatctaataatataatttagttccttaaaccttctcttgttcctctccaaaaggacctgtggccatatttcagaataacagtgtactggcgaagatcctagatctcttgaaaattaaccctgaattaatgctaatttctaaagacccagattacccagagatttaccaatgagagtgggggtttacagggatcagatgctgaatggaatgttgatctgagtctgctccctgagaggcagcagtactatcagtgggtacttccccaggttctcagtacagagttagaatagatactctccggattggcagatttactgcatggttccctgacccatagagcaaggacaggccaagggaaagccactataggttcccaaatcacatcaaaatagtaagtcaagggcactaatgcatattaaacagaaccacaaagataacatgactgtgaaagaaacatgcagggattgtgcttccagttaactttctagtttggccagcgtgtaaattggatgagtcttgaaaaatgaaaatggatgattataattaatcaggtggtgattccaattatagttccacaatgttccaaaagcggtctcatgattggaacaaattaatgtagatttgacacccagaaactattttccctcctatatcctgatcaccagagaacatcagaactactttattttctcatggcagggacaaacaacagcacacctgc

SEQ ID NO: 630 - DNA, 1025 bp, Homo sapiens
atataactctgacttcacatttcagcaagtgaaaaagtagttaaatgaccccagaattattagtcagaaaaatgcatcgcagccctctccaccttccaaaacactccagaaagtgaggttgagggtagcttgccaagacttggcccttctggtgtgaatgacattctggactcttgaacataaactgctggcagtgttagcttgctttgcattagccaattgttgcttctcaaagaagggcagcaggatgtggatctttgcctcattacaacattctagttgcagtggcccttttgaaaggaactccctgcaatcttatgtatctctgggatatgaaggtgcagacagggcttggctgtgttctcacttactgtttcaatcagcaccctttagactgcaagtgatagaaactctgatcaaacataaacagagcaggatatacactggcttatgtaaacaaaaagtccaaggactttcagtcatggctgcatctgggtgtttaattgacatcattaaaactctttctttccatctctaatttatgcctgcctatttttgcctttttttttttttctgggcagattttcttgttgtgatgcaagatgtccaccagttgctacaaactcatccttacagctcacaatctcgaaagaaaaatttctagagcgcactagaaaaagtctcagggaagactcctattggcctggcttgggtcatgtgtttatccttaagccaataactgtgcccggggatgggtgctccagtggccagtcatggctcaagagttccccctgcctggctgtgtggggaggctgccccactgagccacacacatgaacagagcaggatttatgtttgtttgtttttgcttttttttttttttaaggtagggtttcactctgtcacccatgctggagtgcagtggagggatcatagctcactgcagcctcaatctccagggctcaggggatcctcctgcctcagcctcccaggtagctgggacctcaggcctgtactaccatgcc

SEQ ID NO: 631 - DNA, 1069 bp, Homo sapiens
ctttggtcgaatgcataaacccatcccattaacccattgataaagtttgttatctgttgtactgaatggagatacttcaagagggatgtaagttcttgtccccatcacagaaagctattgtcaacctcactgaatgagtttatatgttggtgataggaaaaaaaaaatcacaatcactagttattatttcctaaatcaccatatgagtataccaagtccagtgactaataaagaggcttagacactgtctggcacttctttcattgatagtcattgagcatttccaggaacagattatgtgttggatgccgggaatgtagagatgatgagagagcctttgccctcaggtagcacgtggtcccataaagaagacatgggccagttgtggtggcttatgcctgtaatcccagcattttggaaggccaaggcaggagtatcacttaaagccaggagtttgagaccagcctggacaataaagtgagaccccatctctacaaattttttttttaaagttagccaagtgcagtagcacatgcctgtagtcccagctgaactcatgaagctgaggtgggaggatcctttgagcccaggagtttgaggctgcagtgagctatgattgtgccatagcactccagcctgggcaacagagtgagaccctatctcttaaaaaaaaaaaaaagagagataattataagataattgtgataaagtgatgtgttggtgtcaaatgctagattcaggttgacacactactaagtaccttacatgttatctcattttctttttttttcttttcttttcttttttttgagacagtcttgctctgttgcacaggccagaatgcagtggcgtgatcccagctcactgcaacctccgcctcccaggttcaagcaattctcatgtctcagccacccgagtaattgggattataggtgtgtaccaccacacctggctgatttttgtatttttatttttattatttatttatttatttatttatttatttatttatttatttttgagacagagtctcgctctgtcacccaggctggagtgcagtggcacaatc

SEQ ID NO: 632 - DNA, 1026 bp, Homo sapiens
ttgttgcccaggctgtattgcaatggcgcgatcttggcccactgcaacctccgcctcccgggttcaagtgattctcctgcttcagcctcctgagtagctgggattataggcatgtgccaccacaccctgctaattttgtatttttagtagagacggggtttctccacgttggtcaggctgagtcttgaactcctgaccccaggtgatccgcccacctcagcctcccaaagtgctgggattacaagtgtgagccacggtacccgacctctagcacagttttaaacctggggagtggggtggggttttgccccctgtgagacatttggcaatgtacgtaagcatttttagttgtcacaactagggatatgctactgacatatagttggtagagatcagggatgctgctccatatcttaatatgcacagaactgcctccacaacagctcagaatgtcagtagtgccagggttgagaaactctgtcttaacacatcaacagttcatttttttgttctgtcactcttgcttagctgtgtacatttttacatagttatgtacattttgcctttctttttcactttatattttaaacattttttacattgctacagtgttttcaacttttgaaaaaagtatactaattttatttgggaattgaaaaactgtgcataatatgtattttatttaagatgtgtgtgagttttaaattatatttgtgtgaaaggagtggaaaatagaagaaagaaaggttacagtgaaaagtcacctgacagcatatttcagtttttgtggctgtgctatgtactttgttccctagagtcactcaaagactttggaatccaaagctcagcctttgctcagaggcaggagatgtgctatggcgtaagatagggtcctggcccctgcaatgcagttggagagtacctaccaggagaaaaaacaaggagactgcacccattctccttgtcctcttctcgtttaaaattctttgtctcagtttgctttaccaccttattctttacatctag

SEQ ID NO: 633 - DNA, 1067 bp, Homo sapiens
cttttagcactttgaggtatttgcttccagtcttttctttgtgtgtctggtgtttacatagttataataatacttttgcattgtgctttttctcttagcattatcacatatttcttagcatttttccatattgccaaatagtcctcataggatgctatgtattcttagtatcttgggctctctgctacccaggactaaaaccacaaataactgtatgatgctcaaagaccttgtagggagaagggggaagatatgagtggggaccaggtgaaggaggtcgggggaacagaagaaaatttttagttatatgtcatgaagaggacctacagaggtgcaggattcagacttgggtgtttttcatcagtatgagtatcagctgataattaaaaccatttatcatctataaatactgttgatgtggaaatggtaagactctagaaaacttagcaatcaaggagaaaaataataaaaatatggttttgcttttaaaaagcaaaatagtatatttatgtggactgaagtacaataacaattatgtctgtcactgcaatttgggtcagattaacttggttaaaagttgtatttgattagaacagcaagtcctattaatagttagtggttttaatcacttgaggtcaggagttcgagacgagcctgaccaacatggtgaaacctcgtctctactaaaaatacaaaaattagccaggtgtggtggcacacacctgtaatcccagctactcaggaggctgaggcaggagaatcacttgaacccaggaggcagaggtacagtgagctgagatcacaccactgcactccagcctgggcaacagaggtagactccatctcaaagaaaaaaaaatagttagtggctctagtaacacagatatcacttcatcgatcagcagatatttatctttcatatactgtcatactgcaaactgttatgtcatgattacttgcaacctaaaaaaattgatattgatagcaggcttagaccaagaagttgcagaaaagaactgaattaatgagaagtcaacataaattataagacatattctgtgagtaaa

SEQ ID NO: 634 - DNA, 1023 bp, Homo sapiens
tttcccagaaagatgattacttattatctgggtttgtttttgtttttgtttttttgcgtgtgttcaccatttcagaggtgattttaaacatggatttccaacatactttgtgttcatcatttttcaaaataactgctctgaagggtgtaaagctgaccaggaaggtaacctgaaaataaatacatgtgtttctagtaaaacttctttcaagtataaggatttgggtcaatacataatgtcctctgactgcctcagtacttgttgtacacccctactacagagctgataactttacagggtaacttatctgcttgcatatctgtgctttcccactgtgacaatctactaggataggaccacaggggtatttgtaacacagaaagatgtgatcaagcaactttagtttagatgttgggagcacactttggaaacagtctgcctgggttcacatcctagctcttatcaactacattgtgaccttgaacacattacttagctctctgtccttaacttccttacctgtaaaatgagaataataatgtccctaggactcagcaaagaatgaaggcatattttgtactcagtaatcattgagtgaattaatgagtaaacatacaaacaaatcaataagaagaaaggtgattttatttaacaggataacattttctttagaattactgaaggaaactattgtacacatgtaacactacagtttttaaaaggtcaaatttttcaaacaaaacataaagaaaagcagactgaatctcttatgcaaatctcactaacctcccattcttccttcccacattctaggaaaaagattaatgatgttgagtattgctccttcctgtggtgtctgggaaggagggtagttgtgttttctaatcttttaacctcatcttctctactctttctttttttttctttttctttctttctttctttttttatttttttgaaaccgagttttgctcttgtcaccaaggctggagtgcaatggcgcgataccgactcactggaacc

SEQ ID NO: 635 - DNA, 1036 bp, Homo sapiens
aaccttgtctttaaactatggaaacataacaaaggccacttctgttcttctatggccattatgtatttacagaaggaaattaaattggtctggttaagtctggtctttataaagtcattcatccttcttaatgtgacaaatgagacaccttcatatatattaaatttaaagcaccaattcatggattttccattttttaaatggaaaaatatactttaaatggaaaaattttaaaaaaaattattttgaggtaattgcaggaggaagggttccttattacagctggtgaggatgggaattccttttctccagtagcctccacttacagcacatggctgagaaggggaggagtgacttgtgacttctctccccggggccgccactgataccacaaggcaggtgggtgggggtggcttattgtgctaggtggtggcctcctctgacaccgccccagtggaaagggagaagtgtgcctcctcccttccaggtgggttggaattctaaactcaccacctggtctcccctcacactgcagggtaggggagctctttattattcggcagggataaaagtcccttatccctacttggccttctctgacaccaccccagtcagggaattggaatcccttattacagcctggtgagggtggaaatctaggctcccaatttgggctttgctggcataagtggaggtgaaggcacagttttttctgtgacgttcagctggagtaggtaggtgtccaaaattgtgtttcttccttggccttttctggtgctttggctaaagatggcagacttttgtttggacttttttgttttttttttgttgttgtttttgtttgtgcttgttgacattgtctgggttgctgtcttcttcagctacaactcagggatctgtgaggcaaaaagaacacccaggaaactcacagccatgtcgttccttgggtcttgagttccctagctggtctgccttcttctttccacctttcaaagtcttttaatgtttgttttatatataatgttcagagttttta

SEQ ID NO: 636 - DNA, 1033 bp, Homo sapiens
aactatgaccaggagggtggtatcatgttgtacatacagactgccaagagctcacccaccctcttagatagtttaggggaatggggtggtagtcacttaagtgggtacttttatgtgactgaaggcatgagagtcttcaggaatggcaaggattgagtatgtgatcaccttgttgctgttccctactttgtctgcatcttaattgatcgttctagaggcccagctgtgacctcttttatccagtctataaaatgctccagccagtctttgtgggctgtaggtaccttatataaggcttgatctgattgcagggtggggtcaaataggtgcagcttccaagatgaccaacaagagtaagagtagactttaaagatgtcatgctttaggtgcgacagtgttcttcctccggtttccagggacccaacactccaagtcactaatacttcccttctctctgctcagggagatggtactggagtcgccagtatttaccgggggccatttgcagatgaaaattttaaacttagacactcagctccaggcctgctttccatggtaagtgaggtccaatcaaggttttgggttatagccagctggttcctgggcccctcttgaggcccagtgctgtctcttgggatggaagcaaatgctttccttctcttgcttggcccaggactcacctttaccacctcctttcttagtctggtttgactgagaaaaccagtaggtatgctggctcacgcctgtaatcccagcactttgggaggctgaggcaggtggataacctgaggtcagcagttcgagaccagcctggccaacatggtgaaaccccatctctactaaaaatacaaaaaattagccaggtgtggtggtgggtgcctgtaatcccatctactcgggaggctgaggcaggagaatcgcttgaacccaggacggggaagttgcagtgagctgagattgccccactgcactccagcctgggcaacaagagcgaaactccatcttaaaacaaagaaaagaaagaaaagaaaac

SEQ ID NO: 637 - DNA, 1073 bp, Homo sapiens
gtctcaaactcctgatctcatgtgatctgcccgccttgacttcccaaagtactgggattacaggcgtgagccaccatgcctggtctgtacaactttagttatagaaaccttggttttatctcagtgagttctgggagagtttttttttttagacagggtcttactctgtcacccaggctggagtgcagtggcgcagtcacagctcactgcagcctcgacctccctggctcaagtgttcctcccacctcagcctccttagtaggtgggattataggcgtgcagcaccacacccagctaactttttagagatggggtttcaccatgttgtccaggccggtctcaaactcctggcttcaagcgatcttcccacctcagcctcccaaagtgctggaattacaggcatgaaccaccgtgcccagcccttggaaaactttttatgatgaatttggttatgtatagcataaatgaacctctacactcaggattctcctgctgtagtctgaatgggttgtttgctacttacatggacatgggagagggtggcacctctcttttgaaagcccgagttctggcagctctgctagtctgatatgcttaccctcttccctgtgatcctcaaacctggtaccagtaccaaatggtagagagctttccttaattcattgttgcctagattctccaacaggtaataatcattttggggcactcgttaaacctacgaattcctagatcccttccctggagtatttgattgagtggctttggggtgggaccaggatgttatgtttgtaacaagtatctcacatgcttcttaatagagaagtgtgggaaacactactttagttagtggtgggatgactgtcttttattttaatatttggatcttaggaaaaaatacggaattagcacaatacatcattttacagttattacagcttatagtgaggcaatattgaagttcaaatagtgattagcttaaaaaataaattgtacctgtggatgatagatattgtaacagttgtgaagatgctatttgaatgactaaggtttaggaaacactgtgtttcattcta

SEQ ID NO: 638 - DNA, 1024 bp, Homo sapiens
gagataaattttgtcttagcacagctttgaccagagagaactgtttttatttgctcatccagtaaataatatatttacaagaaagtggttttttttccttcttccgttcttatttttcattcttccttgtcctagaatcataactggttaagtcgatttctgttagatccctggctgtagcttattagagtggccatagtcactggtaacttgacatttttcttcctgtttgaaggcaaagctgcagacacgtctttaggacttacccttcgggttgtttgtaggagtggtggtggtaacgtgcagtagacgcactgtattccatgggctcccttgtaagccgggcatcattttcaagatggctgccaaggctagtagtgctagttacatgggtgcagagcactgggtatgccagtagcaatcttggcctcacaggtatggtacttagtgccatctcagcattgtcttgcttgcttactgtagaagacctaagcagatgattaaaagaacaatgtggaatggacaacaaatgggcaaaatcaagcttaaggacagaatcattgcctgatgaaaaactgttcattaatcaatcatagagtattgtggaaacactcagagtaagagataagcatttggtgatctattctctacttttgcaattgtgggaaaatattttgtttcttccaaaatcttaggattttccatcttgttatatactgtttgctttcctggctggccgaaactacgtttttcattaattttttgataatggcttactagcaagaaggaagggaatgcttatatataattggcatactgatagctttttaactgatctctctgaactttctagtgttttagtttgtatttctgtcttactctgattatcgttactagtctaacccttaaaccagtggttttcaaatttaagtgtgcttaccttgggagggtgtgatgtaagtggtgagttcctccttctgagccttggattcattaggtctgggtacatttttaacaggaatga

SEQ ID NO: 639 - DNA, 1049 bp, Homo sapiens
aattaaatacagggaagatttgctttaattaaggaaaatgtatgtgataaaagaaatcactttggaagctagcagttggttctatatgtagttcgtgtagtggaacaaatagacttggctggaggcacctgtctcttatgagggagggagacagactgacacataacgtgctgttttctgtataaaggagagggtgcagtgttcgggatgactattgtgacgacttttaattggggtttttggatgcgctggattatatatgctaggattgtaaggaatttttataattacaatattgtatgtaaattttctgcctttaaagacataatttcattgtaaatgtgtttattccagcctgaattaccacctgatgaattgttacaaccttgttagaattaattcatgaaagggcttctccctgatggttatattgtgaagaaggtgctaagtaacatgagcatagagcttttaaaaatagcagaagttttggctttattttgttagactgtgtaatctagaaattctaagaaattcattgagttattcttttgtgaactgtgtctacaaaacataatcggagaatgtgactagaggggtttattagctccccccagattactgttgaattttgttagtggttgagtattgatccatattcaccaaagattaccatgaattggcaacagtttatagtgaccagaataggaatatttttctgtttccagagtacttaaaatgtttaaattaataattcttaatgttttgaggtgaaagaatttggagcagaggtcacaaatttgtgaccttctggctaaaactactcccagatgctttgattagacagtacagtattttttaaaggaattgggattaattactaacatttataattcaggagataacaccaagtaatccagattattatatttttaagatctgaactttagctggctttgggggcctgtatttccacataagtaaaaaccacctggccatattgtcaccacatttaggtggggtatactttttttacgacagccttcacgcct

SEQ ID NO: 640 - DNA, 1119 bp, Homo sapiens
agtaggtcccactccctgtgtcctcccaaagtacaatcctttactcttgaaatctaggatagagaactagtatccagtttgactcgtgaacaatgtgagtttgaaccacacaagtccacttacacacagattttttttgataaatatattggaaaaatgtttggagatttgcaacaacctgaaaacttcagatgaaccacatagccaagaagtatcccccaaaataaggaaaagttgagtatgttgtagatactagtctgttttattatttactaccataaaatgtacacaaatgcattagaaagttaatacagccatttgcagttgagaaatgtaaacaaacataaagattcaggcagcattaaatcataactgcacgacattcactgtagtaatattgtactattataatatgtagccactgcctattgctactgcagtgagccccttaaaatgccatgtgacgctaatcatcttcacatgaacagtttatctctccagtaaattgcatgtcagtaaaaagaacttgtagtacacaggtattgtggtttagtgcaatactgtaagtcttcaatagcaccatgggacccatgcaaagtggcgctagtgatgctgagaaaagtcatggcattgtaagaaaaagttcagttgctcgatatgtgctatagatgaggtctacagctggaattacctttcagacagatgtacacttaccgtatcgataagtgcagtactgtacatgtattttctcttacaactttcttagcattttcttttctgtagctttattgcaagaatacagtatataatacatataagacagaaaatgtgttaaggatttatgttaccagtaaggctttccagtcacgagtaagccattaaattttggaagagtcaaaagttacaggcagatttcaactgtgcagcaggttggcacctcaaacttctatccaccctcatagatactgagttattcaaggatacactgtattaccttcctgtccccctagtcctggggctgcagttgctgagtttgctaccctccagtcttagcccttggaaacatacagtttgtccgaaggcagaatcatagacaatatgtgggaaacagaagtgagt

SEQ ID NO: 641 - DNA, 1033 bp, Homo sapiens
agcatatagatggtaaatcctggagtttttataaccacaggattgtaaattagtgtatgcagttacgtgaattaaggtgttagactagtgtggtctggtgatctgcaacaaagtagtagtataagagcatttagttacggataaatttatgtataataagtcttatttaaggcaatactgtggattggcaaaaaagttttctaaaatttagcttattttttatgtagatatacagctaggataaagatagttatgttttaaaaggagtgggaggggggtcaaacatggtgaacatgctggagtagagtccgggagtttggatggattgggccatgaaaagcaaatgctagaattcctagttcctgtggcatggagaattatctggcaagctgtaattgtcttttgacttactaaaaagttttccagggaagttaaatttttttgcctttgttttcccattttgagttgcattttgtctatttttaagacccttaccaatctggataggccatagtataggagtggtagcaattagattttaatttagaaatctggctagtattagtgaatagtaaatgcccaataaatactaaaaagatttgagtacctaccttagtaatgtaagttattaagtgtttagtgtagtttttctcattttgcaggtaaaaaagccaatgaggcagctttcctaggttacacagctgttaatagttgagtcaagactaaaaatctagcagggcgtggtggtgcatacctgtaatcccagctactcatggctgaagtgcaagaacttgaaccccgaaggcagaggttgcagtgagccaagatcgctactgcactccagcctaggcaacaaagtgagactccatctcaaaaaaaaattgagtactgttatttctttttcttttctttttttttttttaagatctgcaaaggggtttaataatgcaaatatcacatatatttccatttttaacaccatatttaagttttccattttcttaacaatagaaagtgataaaaatgtttttcc

SEQ ID NO: 642 - DNA, 1051 bp, Homo sapiens
gggggttctcatttttatgatctcaaggaaagttggtagttgggagatgcaggataaggtgagaatgtaactactacttctgttggtaaccatgctctagaggtaagaggagggtgtgctagaacagttaatgtttaataggataaggaggggcagaatatattttgctagtcattgctaccctcttaattatggctcagtaggtcacactttaatttcttagacttttttttttttttgcctatcttacgggtaatgaggctacaactgtttgcaactgctgaagtcttgaaagcagagagcatggtggcttgtgttttttgatttttgccaaatttcctggtacctaattggcagccagagagtctctgggaaaattaatctttgacaacatgagatttatttcattttctaacttgttcaacttggttctgtcttgcaggaatgacaccaaggaagatgtatttgtacaccaggtgagtgcttgtgtagatatttgcacttctgattcaaggattgtaagaagaaaaggttagatatgttctcagcttttgttccttataaaaggttaagtccaaccaccagtttatttacttacgacaggagtagtagcatgcttaaaaatgtatacgtggaaatgtgttagagttgacttaattatcctagacatttcaaattggaattttgtcaacagctgtggctttctcaaatgttgagtcaaactcactgcattaaatatttatacctaatttcagatgaacagattattccatgattctaaagttgaacaaataatgttgctataaatacacagaaactttggcaagaagttttcaaaggcttttaggtgtacctgtagggacaaatctccataatcaagggtaaataagacagacctgcaaaacatagtaattgaagtgagtacttgaaaagtagcataaagagccttctgcttactttaaatcactttgaatgggtattgggttttttttttttttaaacctttggagagttttggctggcttggaaaatgaaaaaatttcactagttt

SEQ ID NO: 643 - DNA, 1033 bp, Homo sapiens
ttcctaccctaacacctgtgtcaggcctcgagacactcctgctcaaaatccttcagaggcttccagtctcacttttgagcagaagccagcatcctccaggagcctccacaatgtgcccccacctgccccatgccatctactctctcccctggtttactccacccaacctcacaggcttccttttcatggcactcttccacctcaaggcattcacacctgtttttcccttctgactggaagaatgttctgccggataagttagtggctttcttcctcagttctttaggtctttgatcagcagggcctcccctgcctacctgtttaagatggccaccccttcccatggccagcccccaattcctggccttcctgattttcctccatggtgcatgtcatctgctggctacattaacttgcttgctaactatcttgctctgataggagttaagctacataagggtagggatttctgtctgttttgttcactgctgctatatcccagcatctataatggggctaaaagagtacagaacaaaagctcaatacgtatgttgaaattaataaattatggataaccatgaagaggcttggcagctgagtgaaggaaacgagggctgctgctagaaagggactgtggaaccatgtcttagcctgcttgggctgctgtagcaaaataccagagactaagtggcttaagcagtagatatttatttctcatggttctggagactggcaagtccaggtcaaggtaacagtagatttggttccggtgagggtcctcttctgacatggattgcacaaagccaccttcaccaccacctcacggtgtcctcacatgagagaaacttggaaagcaactcggagtaagaaaacctgagctctagtcctgccaatgaaacttcatcttaagtcctaacgatcacctcctttgccaataccagaagccacttgcctccggaatccaggacatgggagaaaattaaacacctaattaaaaaaaaaggggtataaatagtactcacttcctaaagtt

SEQ ID NO: 644 - DNA, 1069 bp, Homo sapiens
aacagtgagacactcttatcagttggggaaagttttatgttggtctagggaactgtttactattcaagtttccagccatcagccaagggccagccttgcaagaaggcctttctgaggatagcagtctcaggcctgcacgtaaactcttttctgcatacatatcatactgcattggtcgttatcacatgttaaatttaaaacaatgaggaagatttttttttcctaacaagggtttttggtttttgtcttggtttgttttgttttccctaacaaaggcaattcagatttattattggctggaacttctgatgtgaatttgacacagtggaacctgagactgcattgggctatacttctctagttacttacctatctctattaaactgaacttgaagacagggctcctgtctctttctgtttgtttcttaggcactgtgggtgaaaagtaaagaatgggagggtggggacgggagagtagagggtagaaagcatagaagacagcttcctagaaattgagtgtctgcactttttgttcttccaggtgtcatcatgctgtttttctccccattgtctctgtctgctttttactgcctgatgtggtcgctctcgtacatcttctttccagatgctctgtggggcaaggcagcctgtctttcgccacagcactgaggaagctaagcagctctaccagctcctgccggcctctgtggggtttgtgtcagcatattgggtcaagcctgcactaaagctttgtatgtacctgtgttgccatatactagatatatggtatgtctgttgccatgaagttagaaacccaaagcagggtcagtgaacttcacttctttgtctttattcagggttctgactcccttgcggacaatacttgtttatgtcatgtagagcagaatatccccccgcctcaagctcaatgtgggctgggtttgggttccagctccattaccagccgggtgactgtgtgctactaaggtccatcccttggaaaggagtgagagccttcagaactggtattggcctcagcctcagccctgcctggtggggcttcctgaag

SEQ ID NO: 645 - DNA, 1043 bp, Homo sapiens
gaatcaaccttgtgacagtcctcccctggacaaagagtctcaggagctccccaccgagcaccatgtgacccccacccctgcccgcaagagataaccacctttaactaattttccactacctacccaaatcctataaaactgccccacccctatctccctttgctgactctgtttttggactcagcccacttgcacccaagtgaaaataaacagccttgttgctcacacaaagcctggttaggtggtctcttcacatggatgtgcgtaacgtttgatgccaaagaacccgggacagggggactcctttgagagattggccccctgtcctcaccctcacttcatgaagagatccacctatgacctcgggtcctcagaccagcccaaggaacatctcaccaatttcaactcaggtaagcggtctctttgctctcttctccagcctctcttgctacccttcaatctccctatctttccaatttcagttctctttcctttctagtagagacaaaggaacacattttatccgtgaactcaaaaactctgacatcggtcatggatttgggaagacagtcttcccttggtgtctgatcatagcagggacgcctgccttgatcattcacccacattccattggtgtctgatctccatggggacgcctgccttgatcattcacccacattccactggtgtctgatctccacggggatgcctgccttgatcattcacccacactcccttggtggcaggtcaattgcagggatgcctgctttgcctgttcactcacattacagcccaggactcagtcaaggatgcctactggaagcctggtaggtgcccacctccatttctccatgtctctaccttcctctttaaacttaccttctccattatgggcaactttccaccatccattcctccctcttcccccttagcctgtgttcctaaaaacctaaaaccccttcaactaacacctgatctaaaacctaaacatcttattttcttctgtaatactgcttgaccccagtacaaacttgacaatagtt

SEQ ID NO: 646 - DNA, 1058 bp, Homo sapiens
aagacaacagattttaagagtaggtcaagatattatcaaaaagacagattctggctctatgtgaggacattcccaactctaccaactaaacaggtatgggcaaaaaaaacaaagaaacaacactgaagtgaatggctgtgcaggacttctgactcaaagaagagaggtaaacagcaacactttgttattactaatctgtgcatttatacacgttactttttacaaggtgctttcacacatcattgggctagctggtatttttacacaggaggaagctcacccagagtcttagctgtcaaatcacaacactttctttctgtaacactgttctttctaaaacaaagctaatggaacataaagcaaatctgttagaacccccatttgcactcccccagggttccaggaacaataaagaagaagatactagtgaaaatgtggtaaaaacgatgtttgtggaagcaaaggaaaaactccaaaaatagaatagcttaccttgtccataaatgattgaaagatgaagtgaataaaggacaggaactcttcgtcaacaaaaaccatgttgatagaagagtgaaaaattagaaattattggtaacaaattaagaatagctggaaacagaataaatacagcttgtgagattagttttccttgttcatacatgtattcaacagttattattagaacacttagtatgtcttggcactgtgctaggctctagggttacagcaagaaacaatgtataggccaggtgtggtggctaacacctgtaatcccagcactttgggaggctgaggccagtggatcacctgaggtagaagttcgagaccaggctaacatggcaaaaccctgtctctactgaaaatacaaaaattaactgggtgtggtggcacgtgcttatagtcccagctactgaggagcctgaggcaagagaatcacttgaaccaagaggcggaggttgcagtgagccaagatggcactgctgcactccagcctgggtgacagagcgagactccatttcaaaaaaaaaaaaagaaaagaaacaatatgtagacatggc

SEQ ID NO: 647 - DNA, 2038 bp, Homo sapiens
catatagtatgggcattcttgtgtgtcactaaatattctttgaaaatgtgatttttaatgtcctgttaacttactgtttcatcatatcttaccatatgtttagccagcccctacttggccacttgagttgtctcagttttcattattctaaataatatgaataggaacatctttctcacctttttatggctccagttctgctcgttttccttcccatgggcctgtagagtgagacaatgtcccactttcccttttctggctcgcccgacccacttatccagttgggaacagggagtaaaaaagtagttgttccatggggtcagggtccgagagaagtgggcatgtggggcaggttgtacgagtgtgatggggaaagaggggtgagatcctgagggccaccgcagggactgctgggtctatatacaattttaggatggggatacttatttatgtttgaagtagaagaaaaggagcccatggagaaagaatgaagatattagagagacaaaaggctcaagattagatggacagattagctacagggaaaaagagaaggaagaggaatccttgcttcagcaccttgaaggaagaacaaagacacagatgtaaaccttcagtagactttgggggtgctttcagagagttagagagtagtgtaccctccagtttggggtaagcagggcgttcctattgactgacttgctttctctttgaagagggcacagggcaggagttatctgctgagggtaaagggaaggaaggagcattcattagggggataaggagaggattttgagcgtaaaagagagaaaagtgaaggtctacctagaatagtcagacaagagaaagaaagaaaggtcatccaaactggaaaataagtcaaattatccttgtttgcagatgatatgatcttttatttggaaaaacctaatggctccaccaaaaaactattagaactgataaacaaattcagtaaagttgcaagatacaaaatcaacatacagaaaatcagtagcatttctgtatgtcagcagcagacaatgtgaagaagaaatcaagaaagtaatcccatttacgatagtttaaaataaaatacctaggaattaaccaaagaagtgaaagatctctacaatgaaaactataaaacatcgatgagagaaattgaagtggactccaaaaattggaatgatattccatgttcatggattggaagaatcagtattgttaaaatgcccacactgcctaaagcagtctacagattcagtacaattcctatcaaaataccaatgacattcttcatagaaatagagaaaacaatcctaaaatttatatggaaccacaaaagacccagaatagccaaagctattctgagcaaaacaaacaaaactggaggaatcacattacctgacttcagattatactacaaagctatagtaaccaaaaacagcatggtactggcataaaaacagacacatagaccaatggaacagaatagagaacccagaagccatatatctacaatgaactcatttttgacagatgccaagaacatacattggggaaagaacagtctcttcaataaatggttctgggaagactggatattcatatgcagaagaatgaaactagactcctatctcacaaaaatcaaatcaaaatggattaaagacttaaatctggccaggcgcagtggctcacacctgtaatcccaacactttgggaggccaaggcaggtggatcacgaggtcaggagttcaagaccagcctggccaagatggtgaaaccccatctttactaaaaaactacaaaaaaactagccgggtgcagtggcaggtgcctgtaatctcagctactcgggaggctgaggcaggagaatcgcttgaacccgggcagcagaggttgcagtgagccaagatcgcgccactgcactccagcctggccgacagagtaagactctgtctcaaaaaaaaaaaaaaaaaaaaaaaagacttaaatctaagacctcaaactatgaaactactaaaagaaagcattggag

SEQ ID NO: 648 - DNA, 1081 bp, Homo sapiens
agaagcccaagctttaaccttgagagcttctcttctccctaaggccccggggaagaggaggatctatacagacaggctgtcctgaacagagcacaggtggcagaggcaaagactcacacagtgtctaggtggtggtatcccagtcccagcagaccgtgagcccttgccccatctccacgtgacatactctgggcttccccagccgccttcacctgtgtgcatccaccaccagccaccatgaactgtgtactccctgaagactacagcttccttggtcctgtgctgtcttcacactcagtccacgctgtcagcctaacactgatgggaaggtggcttatgctagtgtgcagtggccacatcatgaggtcctgccaccatttaggggcttttctcccaagtcggtgacataagctgggcttatggttccatccttctggattcagctttaaagggctacacagtctgtccctgggctcagtcatccaaatctagccttcatagtggaaacagtttttgcctgtgcttcaggctgggctgtagcctcaaaccactgctgtctctgactctctgaacggagtccacccatggttttgtttgctctttggagtttgtaccctggtcctctgcaaatgctcctatagtgctgtccttcctgtcctcaggtgctctccctccagcccagtggttctgactcatcccatgcccagtttgctgcctactggaagccagtgctgtccatggatgcaaattcctggcagcgatggctgcacatgcatcgcctggtgctaatcctggagcatgacacgtgggtgcccttagggctgggccatagttggggtggagtatcggggtcagggggatagggaatgatgggaaggggagcagcagatgagctcttaccaactgtggccaaggaaaaactatagccttttccttgcctccctgctcttcagtccccataacctcaggcaaggcctagaagagagtgatagtagtctattccttttctccaagcctggggcctggaggtctaacctcagtccacacccctcttcctagaccaatccccaagcacttgcac

SEQ ID NO: 649 - DNA, 1053 bp, Homo sapiens
ctctcataccatcccagtaaccatgagatactccctctcattgcactgtgctagcattagtgatatactagtgacccagacagagggacgctgtaactctgtggagcttgtgtagaatgggggacagttgaacaactgaattacacaacttacttcaattacaattgtgaagaatcctaaaaggaacagtagaagctgctacgaaagcatgtaacagggatctgaccatctgaagtatcagggaaagcttcttagaggaagtgatttttaagctgagactcgacggatggtgaacagattctggcaccaaaggggcaagtgttcctgactgagaatcactctcagaggcctgagctttgacctctctgtgatgactgatattcttgttgacctccaatccccagtgatagtggtcattctctctggcatttgatcacccctgaccaccaccacccacttaggaggaggtatttcagttccctgacctcatgctccttctcccagcgactgcttcttcaagaccttcatgacagccacgtgtgtaactctcttctggtggccgagagtgaagaagatctgtggcgcagtgagactcccttccactcccgtcagcgggcaccactgcccagtgatggtgagatcccacccaggagcctccctcacaaggcagtgctgccgccctttcttttaccgaatactctggtgaaagctgagggcagagtcctcattacttggtcatcagtgccaagtactagagagagagcaaggaggataggacaggaaaggatcactggccttggctgctgctgcgagttcatcagtgattttcatggaagtaatttcagtagagagatgggaatagaaagcagatgaaatgaaaagtgaaagagggtgataggtggggcagagaataactactcttacaagtagcttggcagtgaagagacagagaaaatagatacggcagtaactaaaggaagatgggggcaaggaaggagctttaaaataaagtagagacttgagcttgtttatattctatagggaaagagccag

SEQ ID NO: 650 - DNA, 1050 bp, Homo sapiens
ccactggccagtactgacaggtctgagtcttgggaagtaggcagcccgtctgttgccacctccatctcccctgagctcagggacaactctgcagccaccttttcatccactgtcaaatctcagattcccgtgtttgtggcccctgctctatgttcctctccagattctgtgttctctgccctttcccagtggctgtatgcgaaaaatgagctgttcaccttacacatagctactttcgtgtctccagatttgtgagtttatcaaggcatgttctccctcctctctgttttcagttagaaccttttcaagccagtagtccagaaatgccagttccaactctctcatgtttctgtgaccagctccccactccccaggtttccctctcttccaggcattaggaagagaaggcgtgcctgcccctcctgtgatcccatctcagaggccaggctggcccctcctaccctggggaggagctgcccagcttgctatcttgacagccagttcccagctctaggagcttctctaaaggactttagtttgcacacttgccataagttatgctctttcccccaaatctgaattcctttagacactgggttaaaaaaaaaaatgtttctacagcaaaatttaaagccaggtcttcccttcccaccaatctttaacaatcaccaatcactaagtcttgtcccagtttccttgaggtttaaatgggacattttttccaccagaggttttgacccccagcaagaattctggcagtttatagccccttggcgtgagtgggtccccccaaccccttctgttctgtcccttcttcccagtccctcccctgcttcccttctcccctatcctctgcactaaactgtaacgagcagtaggcctctgaaagcctggaactgccatcccccccaatcaaaagacagcagctttgccctttcagaggaaggtacctaaccaggcatcaagcatctccttgaattttcctaatcaaattgtagacaggcatcaccttcccccttctctttcctgcccagcacacaccctctcagt

SEQ ID NO: 651 - DNA, 1062 bp, Homo sapiens
cctgccctctgagtcacttctgtcccatctcagtgttccacaggaatgcaggagctcctaaggaaagcagacccactctgcctgccagtcagagccttaaagactcccatccctgtgccccaccagaccagtgtgtctgtcctaggcttagtgtctgctgtctcctgttacttatccctcagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacaggtaaggctgagaggggcatccagcatgcacgctgcaggagctggggttgggacatacttgcagtagggagaccaatgttttcttgggcaggggtgaggtttgttttattagaaccccagagttgacatctccccaacccgtcctgcacagttctggctcctacctggactctgagggacttcgacaccaggatgactttgatgtgtctctgcttgtctgtcactgtgctgcaccctttgaggagcaaggagaggctgagcggcacgttctgcggtcagcagatcccctaccttgaacatgcccatttcccagcctgccccaccctgccctgtgtgtctcttgctacaaccaccactctcctgccctgctccccaccccaggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagag

SEQ ID NO: 652 - DNA, 1033 bp, Homo sapiens
aggcagtggcattcagcactggcaaggctgggagacaggaagaaatttggcacatttgaggatcagaagaggaagttcccgttctggcaggaggagagcatgggcaggtagggctgcagaggtgggaggggccgactctgcttggctctggggtcatgctgaggagctgggccacagagtctactgctgaggtcagggacttggtctgtgtggctcacagctatatggctggtgcctggaaggacgcccagcacatagtaggtgcttagggagtatcaaaatgaatgagcgagggagtgaagggaaaagatgggcatttttaccagatggggatggttctacatgaacatttccataacctgcttttttttctgcataaacagcaaatttttaatgtctttctgtgtcaatacatatgctgttgtgatgaaattcttgatgttttctcatgctttcctttctgtccaggaaggagtggaggccctggtgcccggcccttggtgctgagtatccagcaagagtgaccggggtgaagaagcaaagactcggtgagtgtgccccacagagtggccaggagcaggggtgcacaggggtcctatggaccaggctgagcagcttggatttgatgcagggtcagtggagagctatagagggggtgtcagcagggggcatgacatgatccagtgtgcactggtgagagattgtggaggcctggaccagggaggcagtgacagaagtggagagaagggatgtgagtgctatttagggaggtagagtagacaggacgtggtgaaggattgaatgtggggcatgaaggaggggaggtgtcaaggatggtgcctgagtttctggctggagtggatgatagaggtggatggggaatgacatacagctcgtcagctactgtaggtgtgaaataggcttccgggtgatgtcctgggacttacaccaggatctttcttctgcttctccattcgccacgtttctgtagaaaagactgttcccatcgactgtaggttgtcgtagaaagagc

SEQ ID NO: 653 - DNA, 1114 bp, Homo sapiens
ggtgtccctgccctggggtcctccagcccttagagggagggagggatttctgttattagccggcttaatgataatagttaaggcatattgagtttcttggtgggagacatcatgctagcaagcacagttgattttgtttttttctgttttaccctgggagataggtgctcttattatttccatttttgaaacgagggaaccgaggcacagagagggtgtatcacttgccccagggtcacataaaaataaatgacagagcagggacttaaacccagtgtggtctgaatccatatctcaccctcaccactacatagtaccagaccttcaggtttaatagcctcccagcaagaagggtgtggtaaaatagtaggggaaagtgtgttctctctgccctgatacctggggacaggcacacatgtattacacatatgtcacatatatgtaaccgattctggccaggcacggtggctcattcctgtaagcctagcgctttgggaggccaagttggaaggattgcttgagctcaggagtttgagaccagcccagttaacgtagtgagacccccatctctacgaaaaaaaaaaaaaaaaaaaaactgggcatggtggcacacacctgtggcccagctacttgggagggctgagacaggaggatcacttgagcccaggagggtgaggctacagtgacgcagtgagccatgatcacaccactgcactccagcctgagtgacagagcgagaccctatgaaaaaaaaaaaaaccagattccttcctggtctccccgctgcaattctcaacagcctctgatccattatctgttttgcagcttgagtgatctttaaaaaatgtaattcaggatcaagtgactcccttttaggaaagggagaaacaccttccagtggcttcccgttgttttaggatacagatcaggatcctcactgtggtctcccagggccactggcttcccaccctgtcacgcgccagctgtccagacacatgctgctttccgtttgccgtgctccttgcctggccccttctgtcactggctccatgtacccttccaggcctcagcttggtgatgctttccttccctcatcaccgcatccaaggagatt

SEQ ID NO: 654 - DNA, 1288 bp, Homo sapiens
cgaactctggcctgggctctgagtctgggcctcgggagagggccaggtaagtgcctcccagtctgtccagtccaggcggctgctgccctccctgctccctgcccagcctcctgcccctcctcccgcccatgccccacacactgcccaggtaagttctgtgtctgtgcctcatctccgcccccactctgtgctggtcacactagcttagctgatgggccatcctcggtgggtctgccatgtcccagacctgctttggcggctgtttctcctccctatggccccgcatctcgtctccccatcacccacattcccttcctcatactccccatgaaagttacctgagagccatgtgatcaccctgagctgactgcactcggggacaggtctgagaatgcggccatgtgacccagcctgcccacgtgtgccttgaattgtgaccacgtggccgtgcaggggactgtctgcaaggctgtctgtgtgagactctggtgttgtgtgtgagagactccgatgctgcagctgtgggagtggcactgcccatgagtgtgagtgtgtgaccacacctgaccagctggctgtgcagcacctgtgtatgtgcatcagtggatcttgggcatgacccttgtctttgtgggcgactctggcctgatcctgtaaccgtatttgtgggtctcggtagccccccagacagtagactgtgtgtgtgtgtgactctgtggttgctgctgggcgtcctgtgtgtggtcacacagccacagtcagctgctgcgtgagactctgtgtgatagggtgtcatggatgtgactggctgggtagcattgtgggattgagatggtgaccacatctgatgtggccatgtgatgaccagaaacatggcggtgtctgaagtggtccttatgaagtgggttatggtcacaaggtaagccaccgtgcctggctcttccatcctactttacacaaatgtcattaaaagctcatttggaggccaggcacggtggctcacacctgtaatcccagcactttggggaggccaaggtgggcggatcacctgaggtcaggagttagagaccagcctggccaacatggtgaaactttgtctttactaaaaatacaaaaattagccaggcgtggtggtggttgcctgcaatcccacatactcgggaggctgaggcaggagaatcacttgaccccagcaggcagaggttgcagtgagccgagatggtgccattgtactgcagcctgggtgacgagcaaaactccgtcttgaaaaataaataaaataaaaaag

SEQ ID NO: 655 - DNA, 1024 bp, Homo sapiens
tactccgtggcctacgaggcggtggacggcgaggaccgcgggcggcatgtggtggatggcatcagccgtgagcactccagctgggacctggtgggcctggagaagtggacggagtaccgggtgtgggtgcgggcacacacagacgtgggccccggccccgagagcagcccggtgctggtgcgcaccgatgaggacggtaggcagtgccaccggggcgggaggggaggcgttctgcctcagacaccacccaccaagctccccagggccttcctttcctgaacacaggcccaggtcaactcatctttctggttcaggtgtaatggcctaaagtggggggatgtcacttacgggataactgaggcccaaatcccagcctttggggctgtctccaaagcagctgaaaccttcacaggctaagatgggagaagcagccctgtctaagatttgaaaggtcaagattgggcagattggtgtaaaagatactcaaagtagaatcagcaagactccacgttggctggacattggcatgattggggcctaggaggagtcaggacaggttgtgctgactaggggtggtcaaagacctggtgccccacctccacctgttcccccatgtcgaccctccccaccaagtgagaggcctgggccagaggggtgggcagggccagtcctgggctcttacccgtggcgggcagagggagccttccgtgtgcctcaccagggacagatgatctaaggaaactgtatcagggcctttcctgggggagtggggtgctgaggcaggaccctcaagtttgctgtgcccacctgagctagggttgatacctccaggcctgacttccttctctacctgaccccccagtgcccagcgggcctccgcggaaggtggaggtggagccactgaactccactgctgtgcatgtctactggaagctgcctgtccccagcaagcagcatggccagatccgcggctaccaggtcacctacgtgcggctggagaatggcgagccccgtggactcccca

SEQ ID NO: 656 - DNA, 1063 bp, Homo sapiens
tggcagctgaatcctatggtctgtctctgaccctgtccttgtagatgggaaaactgaggccagtgagagaggactctgcccagctagggtgacgcctttcccgtccctcccctgctgccctgggcatttaccctgatactctgagggccaaaaagctggggccctgtctcctgtgctgtttgtgtattttatgtgtcatttgcatgtttgttcccggtggttcctgctactcagctgggtggccttggagatagcagtcactgtcctgcagtgacctgccttctatccaaaggagctgctcgcccctgcaaccccttcctccctgctgcactgcccctctgctcacgccacactcctgctctccctaccccctccctgccctgtgttctctcatgtcaaggctgttctggccctggctcctccgcgctcagagatcctgggaagaggtggggcagtaggaggacagagccgtggacatgggggctccttggcagccagccatgccatgtgtcactgtctcagcctggacctcaggttctcaccagcctcccttctgtctctctaggaaaaggacccactctccgtcctctaaggatgagcagtcgatcggactgaaggactccttgctggcccactcctctgaccctgtggagatgcggaggctcaactaccagaccccaggtagggcactcctatggcctgtgtgcccccagcccagacctagcaggcctgtgggtctgttctgcaggtctcagggtcgccactgaagttcctgggccgcatgcacttgttcctgctccttttcttcctttctgcccttctccctgtgctcatccactttggttggaatgactggggagcccccatatcctgcagctggacaggtgccccaggccaggaccctcttaggtggcaaagccacttagccactgccttgtcttcagtcaaggcctctgaatatgggctgaggacctcccagagcccacgtctctgccacagggtggccagtgtctggcgcacgctctgacgcctccacatgaaagaggggcatgttagcagtggg

SEQ ID NO: 657 - DNA, 1290 bp, Homo sapiens
gggagagcctggcaaggcattcctcatcaccatcgtgtttgcaaaggttaaaacaaaaacaaaaaaccacaaaaataaaaaacaaaaaaaacaaaaaacccaagaaaaaaaaaaagagtcagcccttggcttctgcttcaaaccctcaagaggggaagcaactccgtgtgcctggggttcccgagggagctgctggctgacctgggcccacagagcctggctttggtccccagcattgcagtatggtgtggtgtttgtaggctgtggggtctggctgtgtggccaaggtgaatagcacaggttagggtgtgtgccacaccccatgcacctcagggccaagcgggggcgtggctggcctttcaggtccaggccagtgggcctggtagcacatgtctgtcctcagagcaggggccagatgattttcctccctggtttgcagctgttttcaaagcccccgataatcgctcttttccactccaagatgccctcataaaccaatgtggcaagactactggacttctatcaatggtactctaatcagtccttattatcccagcttgctgaggggcagggagagcgcctcttcctctgggcagcgctatctagataggtaagtgggggcggggaagggtgcatagctgttttagctgagggacgtggtgccgacgtccccaaacctagctaggctaagtcaagatcaacattccagggttggtaatgttggatgatgaaacattcatttttaccttgtggatgctagtgctgtagagttcactgttgtacacagtctgttttctatttgttaagaaaaactacagcatcattgcataattcttgatggtaataaatttgaataatcagatttcttacaaaccaggactctgtctcagctgtttctggaaccaaagagtctgggccaaatcagtagctaggatgggttctggagattccctgctcctgaggagacggggagggtaccctaagtatttgtgccagtgtaggctcctggcatggctacccactttcagaaaggagtggttataaaccctgaaaaccaggccaccaagagccagccaggccagagccaccagtgcatgtgaagagcaccctaggccggggagcataccctttgcctctctttccctttaagattctgtgggttgcactatcggggcattgggactgcccctctcccactaccttggaggagagggatggccctgtggcagtagagactgaatgtatggaaattggttagtgagatctcctgtaattattgcaatgtggata

SEQ ID NO: 658 - DNA, 1023 bp, Homo sapiens
ctcggaagctgcccctaagggccccgacacatttccacgttaggcaaagaggatactcatcccaagaaaactttggcctatcctttcgttagcgacatcctatagtaacctcaccgcccttacccatctaccggaccggcccacttccaggtactagcttctttcaaccctgattagttatgggtgaccaggagcccgcctatgattggccagcttcgcgatccagctagaggctcactggccgcggtccctagtggtacagcgtttcctcccggcaacagcccgagccggcgctcataggctgagcacactgaggtcgggactgggaggtggctgcggcgcgtgctcattggctggtgtatggcttgcagccacccttgaattggttgactctgtacggctgcgcagatgccgactttagaggaggcggagtttcggccttcgcctgctggaaaagcagtaggatcggccagtggcgacagcaggagctgagcctaagccctggcggggctttgggctgtaggtgagaactatagggttttggaattctcgaggatcattgccgctgtagcagtgaccgtgagttttggtgggggaggggcggtgggggtgggtcttccagcggtgagtgatcggcatgtttctcggccaataggagaaggagcttccagaatgggttctgagattggtcctttccaatcttcaaggccaatggacctcgggagaggggggcgggtcatctgggccttattttcttcttcctgcggccgagcttcactcgccaaggcggcggggccgggaggggccgaacctgtgcgcggtgaggttcggggacggtggggagcagggtgcgctgcctttggagtgatgctcgcgggagcggctgcgagggaagggtgcgggagtccgagggggttgttagcaacagctagctttattgagtgggtaagtaccgggcctagtgcttagtgcttcgcttgcatcatctgagctaatcacagcgaccctgcagggcagggggtt

SEQ ID NO: 659 - DNA, 1056 bp, Homo sapiens
cccggggaagggccccaacattgtattcacatgattgtatgtttttataaaatgtgcaaaagtaagatattttggattcatttttctttttaagagggtcttcaaaattaaataaacttcgggtttctccacacttggagctgcccttgcagaggacttagtccaggtggagatgagtatgtaagcagtatagagcagtggaaggtgcacttaagagtgggctgtgggcaaatttcctggtatgtaaaacagggagaacagtatacctgccatgcaaagtttctgccaggttcatgaaaagcgcctgtttagaaacacgccttatttttgataggaagcctaggagatacgggtaactggatttgccttctctcctaccttacacagttgtgctccgtgttctgctcccaggcctgtaactagatttctggtggattggaggcgcttttctcctttctgagctctccaactctcaaagagagtcttggagctgaaccgccatacctttgggccccagatagggggtacggaactgctggaccctcagtgaggagggtgggtaaaggaaaggacatactggtgttccttctagaatggcctattttcattgatatgctttgtcttttttcagttgaggtggtctattgcgttaccgagctgtggggatgcacccacttagctgaagttctcatctaaaaacaaagtatttattttgctttctccaatcagttatgaagttttccgtgtattgccagtttaaattttgtcctttgagttctgggtacagtgcaactgaacttgtctgtagcttgatttcattaagtactgctgaaactgcatcttagtttcaacagaacagtttcactttagggttttaaaattatgttactaatatcaaagggcttttaaatcatgttactaatatcaaagtacttttgaacccttaagttttgttatcttgtagccacgtaacttttattaggtatctggtttagctgtgccctagggaggagccttggcctcccaaagtgctgggattacaaggcgtaagccacc

SEQ ID NO: 660 - DNA, 1024 bp, Homo sapiens
ccacacccccaccctaaattacttttctttctttctttctttctttttttttttttttttttgagacggagtttcgctcttgttgcccagtctggagtgcgatggcgcaatcttggctcactgcaacctttagcctcccgggttcaagtgattctcctgcctcagcctcccgagtagctaggattgcaggtgcccgccaccatgcccagctaattttttgtatttttagtagagacagggtttcactgtgttggccaggctggtctcaaacttatgacctcaggcgatgcacccgctttggcctcccaaagtgctgggattacaggcgtgagccaccgtgcccggcccctaaataacttttctagaggtagattccaggtgtgaagtcttaactgtgtcttttgaatttctatattatcttttactgttttcagagttgatgtttccagcacttaattttaatttttatattattttatactcttaatgtgtttcttcagattcctgtctgactaaagggacctcaaaaaggagggaaaatggcttctgagtctgaaactctgaatcccagtgctaggataatgaccttttatccaactatggaagagttccgaaacttcagtagatacattgcctacattgaatcccaaggagctcatcgggcagggctagccaaggtaaggagctgggattgttcaaatggttttgttacctagggcagagcagtaagatttttttcctacatttgggccggaactgtgttttactgaaagttgggtggggtgatgactttagtgaatgcggttctatttgcaagttaattcccgttgttaacatcagaagcatctctgcttttaggtaggaagagagctacttggaatcttcagaaagggggaggtaaagagctagtgtctccaggcctggctgctgttgtgcctcagccctcttggtggagctgggtgctgtggtgttattgaactgccagtgagtgcttatgccatctgacttctcttgctctcatttc

SEQ ID NO: 661 - DNA, 1026 bp, Homo sapiens
agagtcaagtttttgtgggaattttttggggtgggaggtgcaggaagccaataaataacacctgtcctttttcctctcaattcggaactatttaattgatgatacaagagtcaggcatatggagctcagaatgtcgctttatttacaagttaaaatgattgaagaaagtgacttttaacctgtgactaaatggccctgctactttttttttttttgtggggggactgagtctcgctctgttgcccaggctggagtgcagtggtgtaatcttggctcactgcaacctccacctcctgggttcaagtgattctcgtgccccagcctcccgagtagctgggattacaggcatgcaccaccactcctggttaatttttgtattttttttagtagagatggggtttcaccatgttggccaggctggtctgtaactcctgagtgcccgcctcagcctcccaaagtgctgagattacaggtgtgagccatcgcgcctggcctactcatttactcttgatgtctccaggcccctctagaggcaaagcatttccatggaagcactcagcttccatgtggtgtggatgtaggccagaatgcactccctctccaaaagacagatcctagtgaagtgaagcacagctttcaagggggtggggagaagaaaagccaggactccttccgtgtggaagtgtgctaggggaaggggtcttctctctgacatgtctctctttttcagtcctctgctcaaaaacccttgagtgtcttcttggttcctttttatttcggtatgtacttttcaggccgagcctgatgataataccctaataaataaccctctctgctccatcgccaaccatccctccacctccaacatgtgctggcttgtttgtttgaactacttaaaagtctctaaaactgtcttggctgccctgccacttccctctactttctaatcatttatggcatgcctactctaggccaggactgtgccttcaaggagctcacagtctaggatagataggtaagagcaaa

SEQ ID NO: 662 - DNA, 1044 bp, Homo sapiens
aggaaattggggggactgatgagttagtagttttttcactgatttattcttcaaatgtttattgagcatttactatatgccaggcacagttttaggtgccaggactataccattgaacaagacaaaaaagtccttgcccttctggtgcatacagtatagttgaaggacacatagaagcaagtaaatacacagtatagcagatggtgagaagtgcagggataaaaattaagtcagataaggggaatggaagatgaagtagtaaggaatgacatcaataagttgacactgggatgggagtcagtgtgcaagtaactggggaatggcatctcaggtagaagaaccagcagtgtcgaagccctgggtggcagcacatatggcacactcattcagggaacagcaaggggggccagcatggctggggcagagtgcctgggcaggctagcaggcgtgcttggaaatgaggccgtcacatactttgtgatcctgtttgcatcaagggcaagttcagaatgagaagggcatggttgagggcaccagagatggcaatggcagggcccttggaatgggggacagtttgttgtgtgtagctggagacatctgggaaacctaagtctttgtgccctagccctgagggtaatgctgcaggtgctaagatgtggtgcagctttgcctggcggcccaggcctcagggcacctattgagtctctccttcgatactttgatgtcagttcttggcaagatcagaggtccatgttgttgttcagagagttctgggtaagataatatggtataagggccagttgtggactagctaaatttatgggaagagctaaatttatggaggaaatgtggtactggtctcttccaatgtcctggctgggatggtgggtatctggaaaggcttgttttagctcccatctcttctctcctttttacttttactttcccatgcttatctttccctgataaggaggaactaattgatcttcatctccatatgccaggcctgcaaactccacgtgtgagtaaccaaagcctctgttt

SEQ ID NO: 663 - DNA, 1023 bp, Homo sapiens
tgcctcagcctcccaagtagctgggactacaggcccttgtcactggcgcccagctaattttttaattttttgtagagatggagttttgccttgttgcccaggctggtctcaaaactgggctcaagcaatccgcctacctcggcctcccaaagtgctgggattacatctgtgagccaccactcccagccaagggaggtattttaatagtctttcaggtaattgtgtttattattctctgatatccaccaaaactcaatggaagtaacaactttttttgtttgtttgtttgttttaagagatgatgtcttgctttgttgaccaagcacctcccgagtagctgggactacaggcatgcatggctatttgtagaaatggggtcttgccatcttgcccaggtagtctcaaactcctgggctcaagcgatttcttttgcctcaacctcccaaagtgctgggattacaggtgtgagccactgctcctggcaggttcttaaaagttagttgcagtgtggaatctgaaaggtcagtgaacgtttcatactgttaacactaaaacccattggtctcttctgaatggatctttcacccatgcatccttttataacatcatactttggtcatttagaaaatattggtgcactggcctatcgacagcctccaaatgttgttaaatattattataaatttaatttttttttttttttgagacagagtctcgctctgtcgccaggctggagtgcagtggtgcgttcttggctcactgcaacctccacctaccgggttcaagcgattctcctgcctcagcatcccaagtagctgcgactacaggtgcacgccaccacgcccaactaatttttgtatttttagtagagagggtttccccatgttgtccaggatggactcaatctcttgacctcgtgatctgcccgccttggcctcccaaagtgctgggattacaggcatgagccaccacgcccggccataaatattttaaaaattacatttgttagtatcactaataatc

SEQ ID NO: 664 - DNA, 1034 bp, Homo sapiens
tgcagtgatatgtcttctcttaaaatagttttatttttactaacatctaccagataccagtatagaactcacttgagaagagagtcagtctctaggtacaaggtgaaagtgagctgcagtgagtgggaagaagcaacgggcaattggcctgctgttgttctaagaccctaacatgggaagtattacagtgaagtagctcatttatttctcccatggctcaaactactgaggcagtttcaagccagtttttaaaatatagtgttatatccttaatttactgttttatatagaatatttaagtgccttttaaatgcttagcttataattatcactaattacttgtgtttcaaaagtttacttaaatttctctgcactgacttatttttaaaaccaaggagactacccaggataaggagtgtttgtatcagtgaaatgcagaattctgtatttagaggcattcattgtctgtattggtagtggtggatccatctctatcaataatttagatggaaatgtgtgtgaagaacaagggtctccttttccgctaagggctgctgacctgtagaagatataaccaaggatcagataagattttcctagatcagtagggaagggaattaactttatggaagactcattgtgtttcaggcattaggctagacaatttacaaatataatttcatttaatgtaattcttactgcagttttgtgaagatgccattattatccccattttccagttgagcaaactgaaacactttaatttaccaaggttatattgttggaactggaattcaattcctgtctttaaaacctatgttcattattttattgaaaaatataataaatactgaaggcagaacttaatttaatattctacctggtaaaaagagagagagaaaggggctcagagaagtaatagtagagagtgtcaggaagggggtgtgaaaagaaaaggagggaaagagagaaagttatcaaaagaagacagagaggcttattaggtttgaaggtgacaagctgctattcacttg

SEQ ID NO: 665 - DNA, 1032 bp, Homo sapiens
catcagtcactgcgcctgacctagatatgttttgatacgcaaataccattgtgttacaattgcctacagtatttcagtacaatcacatttctaaatacactctatgatatttgcacaatgacgaaattgcctaacagcgcagttcttagaatatatccctgtcgttaagtgatgcatgactatatctgagaagctatcagaagaaataaaatggaatactaaaaaatatttagtcagtcccaaagaaggaaggaaattttgacacatgctgcagcatgggtggaccttgaaggcatcatgttaaatgcgtaagccagtaacaaaaggacaaatactgtaagattcctcttatacgaggttcctagagtagtcaattcatagagacagaaagtaaaacatggctgccggagactggaacagaggggagcggagagttcaatgggttcagagtttcagtttataagatgaaaagagttctagggctgcatggtggtaatggatgtacaacagtgtgaatgtacttgatgccacagatgtgtaaacttaaaatggtaattttttttttttttttttgagatggagtctcactctgtcacccaggctggagtgcaatggtgcaatctcggctcactgcaagctccgcctcctgggttcatgccattctcctgcctcagcctcccgagtagctgagactacaggagcccgccaccacatctggctaattttttgtatttttagtagagatggggtttcaccatgttggccaggatggtctcaatctcctgaccttgtgattcacctgccttggcctcccaaagtgctgggattacaggtgtgagccactgcgcctggcctagtttttgtttttttttttgagacaagtctcactctgtcacccaggttggagtgcagtggcgccatctcggctcactgcaacctctgcctgctgggttcaagcaattcttttgcctcagcctcccaagtagctggtactacaggcatgtgctaccatgcctgactaattttttttgg

SEQ ID NO: 666 - DNA, 1050 bp, Homo sapiens
gtgggagcatcccagtttcctgaggacatacactccattgcatgtttacatgcacaccccatatattcaaatacagacctcttccaggagaggagtaccacactgtactgtgtactcatgccaaaatgcatgtaggtggacacactccttctcttccctgtttacagtgcaggacacacagatcagcacacctgccccaaattcacccagacccagtggagcctggctctgccatgtctagggcagtttacctgttccacatcactgtgcctgttgacaggaagtgggaagagactactttgattcctcagcttgctgccattgggtccctatgggagcctcagaatgacgtgactttgagggaagagtatctctgtgtttttaggtaaagtcaggtgggcctcataccatgggtactgccagtgaatgccagggagactgctggcctgttgagggcagttaattcattttgccgtccttagatatggtagattgatgattcacaaaacagccatgagggtcaggcagttgtagtagagtggacaagaggaaagacattcagagaatatgatcacagccaccactatttactgagggtctgcctgttttactgtgtgccagcactgtgctgagtgcttgatacacctctcagctatctcttacaatcgctttttatttttattttttttatttttaatgtttatgggtacatagtgggtgtatatatttatagggtacatgagatgttttgatacaggcatacaatgagtaataatcacatcagggcaaatggggtatccattatctgaagcatttacggtttatttgtgttacagacatttcaattacactcttttaattatttcaaaatacacaataaatttttgttgactataatcactctgctgtgctatcaaatactagatctccttacaacagctttgatatctttaattatagataaagaagctaatgctcaaagacatgaagtaacctgttcagggccattcatatctgtctaactctagagcccatcctctctcccttagc

SEQ ID NO: 667 - DNA, 1028 bp, Homo sapiens
catccattcagtacattatggaataccaactctgtgccagatgtgatattgggtgcagaggtgagccctgccctttatgagaacccaaatacatgtaagctaggatagtttaattgaaagcaacaaaaactgactggggataactgtttttaaaaaggaatttaccagaaggacatgggtacccacagaatccaattggaagctaaacatcgagccctcagaaagaacatgaagggcagccccaggaatctaggttgcaggaacaagtggtccccctcttcagcacattatttttctccctcgtgtcgctgagtttagggaagaaattgtcccactaacctagcttttgtcaggtgcctacactttggacataaatcccatcgacagtctcaccacttgcctgcaatgggagaagagcagttccctgaaggaaacccaaggggcttgtttctaaaaggacagaaacaacagatgtgcattgcaggttcatgaataagttctggaagggctggagagcacagataaggtgcatttaggctaacaagttagatcagagaagatgttgttcgttcaacattccttccacatgccaagcatagtgttaggtgatgcacctgtgaggaaaagaagagtcttagtggaacttctagactagcagaggagaggcgtctgtcggtaaatgtataatcacaaactggagaaagtacactgtggcacaggagcatttgaagggtgaggtctacatagggaggacaaggaacgctcttcttttttttcttttcttttttgacggagtctcacactgtcaccgaggctgaagtgcagtggtgcgatctcggctcacggtaacctccacctcctgggttcaggcagttctcctgcctcagccttctgagtagctgggattacaggcacgcaccaccacacccggctaatttttgtatttttagtagaaacggggtttcaccgtgttggtcaggctggtctttaactcctgaccttgtgatccgcccaccttggcctcccaa

SEQ ID NO: 668 - DNA, 1040 bp, Homo sapiens
atggatggatggatggatggatggatggatggatggatggatgatggtaggatgactgcgtactttcctatttgacaagcatgccttgagttgcagctctctctactctgtgtgttcatgtccctgcaagcctgctcacatggccgatgctcaataaatccttgcagaaccaccttactacctactgtgattcctttctattgttagtcatctttgtgcacctgtgtcccctgccctgtaccaggcggacatcatgaaggatcagaattgtgtctctttccttttctgtcttgcataagaccttttccacagttgactctgatgacgatggccacacctacgtacaagacatcaaaccaggggctggttggttttcccactgaatggtctggcgtctggcttcttggctctggtgcctcatactatgagttcaggcattgtaaatctcccaacttttacacattatgaaggcaactatgaaggaaaaagtgtgtgttctgtataccaggctagtagagagatgtcagcctcatgttaacatctagggaatggggtatttgattgtggtagaaagccataggcttcactcttagaaaatccttaatttagtactctggaaaaaaacaaatcaagtataagccgtaagcaagtgaaatgccaccagaacggaagagatagagtaattaccaagttgaatcacactgatgaacaaaaggcatgttctctaggacatactacagtatttaaactgtcttcagcagtgaaaggaggaggatgaggaggacgctcatctcctgctgtcctgacagttgggtcctgcagagtaggctgttgtgtagctttctgttgtgtatcaggccagttctttgaactatgtgagttaacttggtctttagcacagtaaattggcttggcctcatttgatttaactcacaatctaaggtacaagctagaactgtcctgcctctagctgcaaaggtttttctagtccagtgctgtcttcagaagtccagtgctgtctctcctgtctcacagatacc

SEQ ID NO: 669 - DNA, 1033 bp, Homo sapiens
ataagctggggcttagcacatattagagacacagacggtagatgctggtcaccaacaggaccgtgcctttgggctttgggttatgtggcctctgcagacaatctggccatcaaccaggctcttcctgaggcaggggcgcctgcctgacatggcagcttctcagcacacagtttcctcccctacgttccccacttccctccctccttcctctacacaaggcacaggctgtcagcagagtcagtgggagcctgtcagcaggagcccaggcactgcccccttgagggcctctggctcagcctctcctctcctccttcagcacaggcctccctgcctgtcacacatgtcatgcatgtggctccagcttgtctggacacggatgtggccacagttcctaggcaggcggggtgggggcagtagctggcagtatttcagaatggggggtgggggtgtctgtgaacattggaaacatcactggaagcctggtgctttggaacagggagatcaaagtgtccatgaggatcacacagaggcggtccccagactgccacaggtgagcaggaattggcctggattagccctggaagatccacatggtggaggctgtcaccccaagctgctcctgtctcttgcagctcacaggcatttgctgagcacctgctatgtgcttggctgcaagccggggggtgctacacagcctgcgggggaactgggcaataacattagcatgtgctaagaggtcactgtgcacaaagaacactgatgacccagaggagggtttggtcagccctgtgtggctcagggaagacctcagagaggtagagatgctgcagtccagtcttgaggaatgagcagaagttcagcatgtgaatgataaggagacgagaaccccaggcagagggaacagtggtatagaggcatggaggcgttaaagagcctgatagactctggaaattatacatagttgtacggggctaaagcatagggaaagggaggagaagagggggtatctgaggctggagaggtagacaggagc

SEQ ID NO: 670 - DNA, 1020 bp, Homo sapiens
agagagctgatggctgttagagtcaccccaggagagttggtggtccgtcctaaggcagtagcagcagggagcataggcgtggacacatctgcctactcttgctgtgaaagcctaccatggttaatctctattcccagacctgtgagcacaccaggaaacattctctcaggagcctggtggggaaagtgctttcttcccagatgttttccccattgctcctggatgttctgacaagagcagaacaggttgcatcagcaggagtctggcagcttcacacaggggagctgggtccagacttgactgaggcagggacattcctgaaggaggagggatttgacaaggaatgcagcccacagctggccttgaggagaagctggaccatgccgggccagcagcactggctggctttgtaggcctctgttgtgtcctgtggattggggaaatgagatgtgagaagccttgggccagatgtggacacttgcaggcagaggccttgtggaataggactgtgtgctggcagcagggctggcagtgtctccagcagcaggcagacctccccaccgggagccagggggaaaggctggctctcccattcaaatgcatgtacgtgtgcaggtatggatatgtgaatgtgttccggcctctccggtggctgatgttgctgaccacaccctccgcttcactctcctggcctctgtgacactcactataatcataataagtaagatttattgagcttgctgtataccagaccccgtgccagatgctgtaaaacgcacagcatctctaatccttacagctatctgggaagtaggtcttctcagccctattgtatgcacaaggaacttgaggcttaaagagaggacacaatgtgcccctggtcacagagatgtggagctgggattaagcctctgtttttcacactcccaaagctgcagtggtacacagatgttctgtgtatgtgcctgtggacgtttttctgagaagaggagttacagcttttttttttaggaaacaggc

SEQ ID NO: 671 - DNA, 1027 bp, Homo sapiens
caaacggagggagctgggctggcatcgggtggggaatgggaaagggagggggtggtgactgcgcccagcagcttcttgttgcccaagaagttcacgtgtagggctggagttgaagggtctggggtacactgtccccgtgctcctgccgggaactgcctgcctcagtgcccccagcctgctcctgagaggtaggctgggagcagctccaaagcgaggggctgaagaggaatgtgcgcggtggagcccagagttgggctgttggagaggttgagctgctgctaggaggtggagtgcaggctccatgctaggatgtgtttgcattttgtatgtgtttcagtgtgtgagaccttattttgtatgttttgagtttggtttgggaagggaacagaaatcacctgtaagtagtatgtgaattgtgttgggtgctgagatgaatgtgtgccttgatgtgtgctgtatgttgatgtgttgtgtgttttgtgttgtttgttgatgtgttaggccttgatggatttagagcgtggacgtgtgttggaggtgtgtgtgttgggttgtcggagtgtatattatggaggataggagtgtatgttgtggcattggtatgtctgtatcagagtatggtttggagatgcatgttgggctgtgggggtatgaagttagtgtgatgggggcttctgtgtgttaggggatcctagcacgcagaccccctaacctgtgaattggggtaaatggagtgtttctttgcttaatcattccacagatatttattgagtgtgtgatacatgctgtactttgctaggtactgaggatatgatagcgagcaaaaccaggcacagttcttgctctcctggaacttacaagtctagtttctgggggatgggtagggtgggaggagggaagaatagggagtgttctgggcctggatggatatgtgtgtgggtgttttcaaaggtgtatctttgatgcggagggtgtctgaatgtgtatttgtggatgggtatgttggaagagtgcacagggggactgt

SEQ ID NO: 672 - DNA, 1617 bp, Homo sapiens
tcctgacggagacttcgcccttcatgtggtccaacctgggcattggcctagctatctccctgtctgtggttggggcagcctggtgagtattggggtggtgggactgggggcaggggctgagtcatggcaggtggtgtcactggggtcttaggcatgctgagggcagtgacagcttgggctctgctcatcagttttttatccttccaccaggggcatctatattaccggctcctccatcattggtggaggagtgaaggcccccaggatcaagaccaagaacctggtcaggtaagtgtcagggtccttggacttttgtcagaaccagctgtgttggcgctgcctgtgtgtttgatctgacatactgtttctgacaagccaccttgtgggatgggatgttataggggaaagattgctggggacttactgggcaggaaggacggtttctttctcatttctttctcctttccactccttacccctaatctctaccactaccagcatcatcttctgtgaggctgtggccatctacggcatcatcatggcaattgtcattagcaacatggctgaggtatggaaggccagggtggtggcgggaatccattccagtgtgttctacacattccttagagattggatggggtgcatcaggatggtttctgattacttttcttcttccctcagcctttcagtgccacagaccccaaggccatcggccatcggaactaccatgcaggtgggtggatgggcgtatgaatgcaaaatgctgggacttcatgcctgcttccactctcccccatcccagcttgggccatcattttgatattctctcacctactttttctgctttgcagagtggggatggtgattggccccattagcccatatctcccccattcctggcttagcctcactgcacccctctctatcctcccaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcct

SEQ ID NO: 673 - DNA, 1025 bp, Homo sapiens
cacctggaactcccaaagtgctgggattacaggagtgagctaccatgcccagcctcaattttgctttaaaagtccttggtgaagcagtacaattattattattattatttttttaaaggcatctgttttttgtttgtttgttttatactttaagttctagggtacatgtgcacaacatgcaggtttgttacataggtatacatgtaccatgtttgtttgctgcacccattaactcgtcatttacattgagtatttcttctaatgcaatccctcctccagtttcccaccccacgacaggccccagtgtgtgatgttcccctccctgtgtccaagtgttctcattgttcagttcccacctatgagtgagaacatgcagtgtttggttttctgtccttgtgaagcagtaaaattattgttttgtggtttcatgtatcagtagttattttatttttattatggattggtatttcatcatacagatagataatttgcttaaatatttacatgttgatggacatttaggctgttttccgtttcttggtattatgaataaaattggtatgcacattcatgtgcagatctctgtgtggacgcatattgtcatctctcttgaattaatactttggagtgggattgttggagcatatgacaggtacttttataagaaatttccagtttcccaaagtggctgtactattttgcattctgatcagcaattttgagacttctagttgctctacattctcaccaacatttggcattatcaaccttttaaactttagcaatggtaataagtgtactgtggtatcttattgtggttttaatatgcaatttcctgatgattaatgatttgagcatcttttcatggactttttgccattcatgtatcttccctagtgaagtattcattcaaatcttttgactgtttttttttttaattaaaattctttttgagacagggtctcactctgtcctttaggatggagtgcagtggcatgaggctcactgcagccttgacctcctgg

SEQ ID NO: 674 - DNA, 1035 bp, Homo sapiens
aggacagggaatatgtgtcatccttgatgggagggaggagatgggacatcgtgggagatggtgggaccaagagggtatgacacctctaagagctgagaggaccaggcaagtgtgatttttgcaagatattgttggggagagatcaagacattgtaacagtctgagagttggtgggatggggaggggactgctctgatttgggcgtaggatggtgttcctgggagtgggtttctgtgcctttacagtgtgtcagtttgcctgtcattgaccctgtaggtgctgctttgttcagggattgagctggactaaagaattttcaggaaagggtctaggttgtggttcctttctgtggtttccttcctcagaaaaaatccaagaagtcctctgagacactgactttcaagaggcccgagggcatgcaccgggaagtctatgccttgctctactctgacaagaagcaagtattggagtcccaagtcccccaggttttggcccctgattcacctgccatgcccctaactcctagttttctctaacaattttctcctccccagcaagggctcctgcttgcttagcaggatgcaggaggacctgaagtcttttgctccaggacatgactttcttgctatagggtagggtagatcagctccctgggacaaaaagctctttaacacaccttctgattctaacctcgcatctccctaaacctccctgccagggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataaggtaagctaccttcattcggacacaggccaagattgccctcccactttgagccatttgtgcgagctctccagtctcctagggttggttctgggggcacgcttatgcccaactgtgattaccc

SEQ ID NO: 675 - DNA, 1069 bp, Homo sapiens
ttagacacttaactacaaaacaaaagaatgacttttttttttttttttttttttgtcacccaggctggagtgcaatggtgtgatctcggctcactgcaacttccgcctcccgggttcaagcgattctcctgccttggcctcctgagtagctgggattacaggcgcatgccaccacgcccggctactttttgtatttttagtagagacagggtttcaccatgtttgtcaggctggtcttgaactcctgacctcttgttccgcccgcctcggcctcccaaagtgttggcattgcaggcgtgagccaccgcgcccggccaggaatgacttcttaaaccaggatttgattttggttgaactttgctttcagaactagaactacctgctatccaagacttgttaaccacgttttcatgggcaaattacaaaaccctttcaaccccagtttcctcttctataaactagtggtaatattattatctccagaattaatcttaggagtaaatgaaattatgtaaaggcatttagtctcataaccgggctcctagaaagcactcaggaatgttagttctctatccatttcccctgtttatctttgtgtttgatgaattataggatgatatgaaatgatctgaaatgaactgtaatataaacatcaataaaacaccaataaaaaattttattctcacatctggatgctatactaggccttcacctcctccaaaagttacagttttattaatattcatttattatttattattatagtcaaagacccagagaagcattccaggaacaaagcagcaggtaagatttttctgggaaaagacagagattttgagggacccaggatttgggggtcatttaagcagcagtggatgtcagtcttcaagctttgcccatttactcttggtcccttttggttcaggaaaggaagaacaacaagcacgaaaccattcactgagacctttgcgggtgggggaggagggatgtaaacaaaagccaacgctctctttagttcacaatggctcgcgaccccaagacttccaagctctttggtgagggccagcag

SEQ ID NO: 676 - DNA, 1023 bp, Homo sapiens
gtatcggcattgtgttggttcatttgattttattttagttttcatttgtccagtgatgtgcaagtgatcaaggctagttataatgtgacctccagccaaaactgccttgtgttagggtgtgacagattccgcccctttttttctccaaatacaagttgaaaatgaaatcttctcttagctaatatgccacaaagtaacatctggagattgagatctctttcttcttacctaacagatccagcttgtctccatttttctatctttttagcccaaacctgtatccgactccagagcaggaggaagcttgttagtcaagtcagaactcatagacgtggatatccattcccctctgagtgtcaaagccataactcttctgtttgcctggtttgcattgtgtggtggtggcatcccccatggagatggatccctcacacaggagtacgcctgggtggagaaaaattaaatgagtctgtctcccaaagtgaaatggaattctgaccttgaaattaatgagattctgatcagaagggtggggaaacttctttatttccaatgcggtgttatacaaattggagtccctttcctcttttattcatttaaaatagtcttcccttatagagtaccctgtgttctcctttttttttcttgtacacaagcataaaacctataggagtgtctgtgaggggagggtgttcgtacaccctcgttattatccagagttgcatttgtgactaatctttaataaaaaacaaaggtgcaaagtgaaaaggaggctgtgctaccctgtggtcaccctggagttgtgctttttactcccttccttaccttaggtggttagcacatccctcactgggtcatactagatagcgtttgtgcttttgattgcgaatttttggaaggcaggagaagtatttttctgtaaggaagggttgaagaggcactaagacaaagtctgcagcagctttcttggctcctgtcatatgccgacgtgtgtcggaatatttatggtctgttttatgtaaa

SEQ ID NO: 677 - DNA, 1035 bp, Homo sapiens
atcatttaaattgtggcatgtatggttgaacagaatgtgttgttatcctttgtaacttcacatgtgtgctacagggtaggaatttgtaagtatctctttctttgcagcaagaagaattttctgcgaaagaaccttcttacaccttttccaagaaaagatcctggattgggactacatgttgagcctggagaaatgataggctgtagtatgaatcagaacacctggtagatgctaagtaaacagaaggaatttatcatcttccagccttacccaatggattggacttttctgttatcttaatcacactactttagttttagtgtttaaaaaaattattattttttgtctggtaccaatcatctaaaagggtttagtgttcattgcatattgaataccttagtggtggcgattataatctagtttttactttaagttttcatcatcttaccactcttcagcattgcacagaacagcatctgtaagactatgtatgctatcccaaaggcgtagaggtttgaggaaagaaaggaagaacttatttatgccttgaggtttcatgatgatgaaggtagggagggagttttccaagaatttgtgaaatcacctttctcaaatatagacttattttattacttggggtactattaataaaaaatcgtttataacttaacaaaaatttaaatctacttttttctcctaacccttagaaacctaagattggagcctatcccctttccaaatgttttcccacagcattacatcccctatcgtggagtccacacatacggatctgcttttggtgtgtattttagaaaaaagtttccacctagatcctggccaaagttgcaaacagtcaagtgatgtggaggttttgtagacacatgtaaccatctggcaattcagatatgtggctgtcagttttctctgtggaatgcgttctggtttaagatgacctagaagaaatgaaagttgtgtttttgctggggagacatggtgctgtgtccagtacattctgttaacagatctgaagcttta

SEQ ID NO: 678 - DNA, 1055 bp, Homo sapiens
acctccgcctcctgggttcaagcagttctctgcctcagcctcctgagtagctgggattataggcgcctgccaccacacctggctaatttttttgtatttttagtagagacagggtttcaccatcttggccaggctggtcttgaactcctgatgtcgtgatccgcccaccttggcctcccaaagtgctgggattacaggcgtgagccaccacgcccagccaccaaaagtttatttttaaaagatgattcagaagactgtattatgggacaggcttataacctagcatttatgattgaatcttggagagatgaattgataaaactgaatgattcctctggttctgtaattactacttggttctatttcttccaaatggtcaagtggatgggattacagtcacaattgctgggaaagtgtctgatttgtgtgtgtgcgttgacaaaattagttttcttttctgaatttgttttttcttctgagttagtttgtaaaaaaggttaactgatggttatttcagttttaccgtccaaaaagcacagactggtctaggagctatatagtgaaggtagtttaaaaatgaaataagacggccgggcgaggtggctcatgcctgtaatcccagcagtttgggaggccgaggtgggtggatcacaaggtcaggagttcccagcctaaccaagatggtgaaaccctgtctcttctaaaaatacaaaaaggtagccaggtgtagtggcctgcgcctgtaatccaagctactcgggaggctgaggcagagaattgcttaaacttgggaggcagagagattgcagtgagccgagatcatgccactgcactccagcctgggcgacagagcaagacttcatcgacttcatctcaaaaaaaaaaaaaaaaaaaagaagtggtcaaatgcttgctgctttcttcaagtgagcaagatggggtaaacagcagatgtgagtgctaaatggaattccatttaaccagctctgtttgtggctatatctatgaaactttttctccacttaagttggcgctagagccacataggagtgggc

SEQ ID NO: 679 - DNA, 1101 bp, Homo sapiens
gcactttgggaggccgaggtgggcggattacttgaggtcaggagtttgagaccagcctgaccaatatggtgaaacctcgtctctactaaaaatataaaaattatccgggcatggtggcatatgcctttaatcccagctactcgggaggctgaggcaggagaatcacttgaaccagaggttgtagtgagccaagatcgtgccgttgcactccgtcttgggtgacagactgagactccatatcaaaaaaaagaaaaaagaggaaaaaaaaaatggaagaaacctttggataggttagggttagaatcttttctctcagctcagttcttccctctgattttaggaggagtcaaatccctctccttccatttccaagtttaacagaatcgtcctaatgtatatgcctccttgacacacaaagtccctgaagcaagtttccacttttctctgcaaaagctccctggagcgcagggagctcttgtcttgtatctagttaaatgcctcgattaaggatgtaatcatagttgtttggctctgtaaatcatttgaccctcacctaaagcagcctgggcctctggggggcccagcaatgaccattctgaatctgggaggacagagtggagctggagatggctttcacccttagtggaaagacagccagttttagggggggtaatatatttttctttttccctaggttttcttgtcgagatcgtgtgtgtgctcacacacacacatgtgtgagcaaaagagagaataaaaagaaagaggaaaaggcccaacagtgtacagcaactgctagcacaaaggccaggggagggacttgcagagaaagacaaggaagtgattttgcccagtttaaatcccacttgaaccatgtggtttctgagtcctgaaccttttgaggttcaagttgagtgcactcttgacaaaacatgattttctggttcacatcaaaaaggctttaaaagacttcgaagtcttttccttaggacatcaaacagtccacaacaaagcagggtgctgatgagatgcgtgcaaatgaacagattaaattctctcctgaggattagattctccttaagaagcatgtgaagttggaaa

SEQ ID NO: 680 - DNA, 1051 bp, Homo sapiens
ttgtttcctttttttgtcaaactagtctgcaacaatagaggatgtcaaccaaagttaaggaatgcagtgagctgggccagcagggtgacgggatgggtgcgcgtgcctgtggctccctgccaccttgcctttctccctctgatccttcttgccttttgcttctcggcagcactcactttgccctaactaggtcacatacgttccggacaggatgatattcatgtctctagaccatactggaaggttctggctttgaggttttcctgggctgtgaggtgtgtgtttccccacgtcctctgctttcctgggactacactaggcagggcaggaggaggcaggtgggcagaggaatagcagccgtttgttctggaggccccttccttctcccgtcttgactgcaaagggctggaaagtcagcttctattgtgattaagttataatttaaggcagtgaacatgtgctctgctggcggctataaagattcaaatcataaagttttacagtggaacggtttctgtaaaagcatcgttaggaagtgggaaccatgcctttaattcttatgacatatgggactgcctggtttgttttggtttcagtggagtttagtagggtgatggtctgactaattaaagtcagaccttcttcctctccacaatgcggtgccccatcacaggacagtgtagaaaggtggaacttttctccccatctcagctcatcagggatggcgggggcggggggcggggcgggtctcagaaatcaggagtaactctttgaaaactaaatagtttaaaatctcttccaacttactaggcttcatttcttggggagtctatgtgttcctctgttcctttctggccaggggcaaacctcaacagtgaaccaagcctgattgaagataatttccttcagaggggtcagctgagaagataattgggctctgtaactaggtcaatggtagaaacaaagagaataataatatcgtagctatctcatccaacttccacctaacttacatgcctggttaaccgacactctgtatatcctgtataaa

SEQ ID NO: 681 - DNA, 1096 bp, Homo sapiens
gctcacgcctgtaatcccaacactttgggatcacttgaggtcaggagttcaagaccagcctggccaacatggtgaaaccctgtctctattaaaaatacaaaaattagctgggcatggtggggcacgcctgcagtcccagctacttgggaggctaaagcagaaaaattgctggaacgtgggaggcagaggttgcagtgagctgagattgtaacactgcactccagcctgggcaacagagtgagactccgtctcaaaaaataaagtaaaataaaataaaatagaaaatgatgagttacgtcaaatgctcctgggagatcaaggacagagatgtacatgtcttcaggatttggcaatatggagggcaataggtcactttgagaacagtttagtggaatgacagggcaaattcaagttgacatgaattgaagagctaatagggggtgagaaaatgtatgcagcagatgtagacaacaccttggaggtgtctggggataaagaagagcagaagactgagcgtggtggcatacgcctgtaatcccagcacgttgagaggctgaggtgggaggattgcatgagcccgggagttcaagaccaggttgggaaacatagtgagactccatctctgcaaaagaattttaaaaattagctgggtttgatgacgtgcacctgtagtcccagctacttgggaggctgaggcagggggaatcacttgagctcaggaattcgaggctgcagtgagctgtgatcgccctgctgcactccatcctgggttggccatcatcctcagcaaactaacacaagaacagaaaaccaaacaccgcatgttcttactcataactgagagttgaacaatgagaacacatagacccagagaagggaacaacacgcacacagggcctgttgggagctggaggttgagcggggggtacttagaggatgggtcaataggagcagaaaccaccatggcacacatacacctatggaacaaacctgcacgttctgtacatgtatcccttttctttggtttgtttttctttagaagaaataaagggggaaaaaaagaagagcagaaaaatatgatggcaagtggagagga

SEQ ID NO: 682 - DNA, 1023 bp, Homo sapiens
ttggcctcaccctggaggccatcttcactgaattgtcccctaactcagtactactcagtacttgtgtcctgactcagtactactcagcacttttgtcctaactcagtactatccagtacttgtgtcctaactcagtactcatccttccacctgggcccatcactcctcctccttcaatctggcaccaccatctcttctctcacattttaaatatccctcttcctaccaatgcctttctctctgccttcacacaccctcaaatctcccctttaaatcttcttttaatcttaacttccaagcacattactctcccctcttcctctttccctttactgataaacttgttcaaaagacatctcactcacattgcctccacttccccacctcccattcagtcagcccattcactcaatgagctctatcccacttcttcactgacattctgatcacctcttctttcttcaaagccgctcttcccttagcttctctgactcatctctttggatcttatctacttctactcctgctcattctccttccccagcttctgcttgatgtgccccttcagtatcgctgcttcccagagtacactgcttcacttctctccttacttacgcatcttcccggggtgagctcatcatgcctgtagtttcacctgccacctaaacactgatgaataccatggctgcaacttcagcctcaacctctctcctgagcttcatgcccatattccagctgccaactcactatctctccttgaatccttgcagagcacctccagactcaacatattcaatactgacatcattatattcttccaagcctgcaacttaaatgatccatcagcaccatctaaccacacaagcagaaacctagtttgacctagagtcttccctttttctttccccgttatctgtcctctttcaccaaaggaaggaggaaaggaaggaaggaaggaagggagggagggagtaaataagtaaaacttgggaagtaggagagaagtgagttccttgccttgta

SEQ ID NO: 683 - DNA, 1060 bp, Homo sapiens
ctcatccccagggaatacccagcaagaggtcgggaggaccacaggagacaaccactcccaaacaatgatctcagttgcccactgtgaactggagcgggggtgggagaagaacagagcaggagcagacaggaaaatgcttgatctctgccggggccccagaaccatctgagccaaggactgctctccatccctgtcttctgaggctgtagattatagtgggtagtcacttgtgctctggagtcagacagacctgggatcaccctgttcctcttgttcttggccctgtgatcttggcatgctatttaacctctctgagcctcagtttccttataggtaaaatgggactaataccagtactagccagcacgaggttttaatgagttcatgcatgtaagtgctgagtgcagagtctggcacacgataaatcctttataaatgccactcagcattgctctggggctagccaaccttttcctccctgttgccctgtgttttaagattgactgagggctctatagaactgtcctccggagaaggagggaagtgcatctctagctcacctttctggaagttatcctttcaatctccaaaggctgggcatggattagcctaaagccttgtggaactttgccttccaagacatgtttgtttctagcagtgggctgcaaggagaagccttgtggctgtgattctgctccatgcccactccacggcggatgcctgaccagtgttccaaggacattttgaaggaagagaggatttctgatttccaggaggggttgttgtatgtcctggaatgcaatctctccattctcccactgggtacagagaaaaaccacaggaaaatggtgagaagatgctgaatgagttaatgcaaccaggaaatacttattgagcatgtaccaagtgtcaagcatggctctagaccctgggaatagagccacaaacaaagcgggctaaaatccttgcccttgaggagcttacgccgtagttctctaggaaggcaagcgggacacctcggcgttgcctccaccccttccatgtggccatggtccattgt

SEQ ID NO: 684 - DNA, 1285 bp, Homo sapiens
aaacctgccttccttctctgagaatttgcagatgaagcccagtccattggggtgctttccagggacaacaagggatcatctgctggcctgtgtgtcctgagcaaggagcgcatccagtattgtgcctttcttgaccattccatgagattcgtttccttagtcattgaacattgtggtatcatcagcaccttcttccccagggaggcattcccttggtgtaggcatggtagggaggaagctttgtgttggcacactgctccttactacacttctagaactctcagggtcctttgctcaatgcctttctgatgtttcacgtccattctccatcccagccctggctctagagtgtcaaggctacctaagtctgagattccaagagttagggcagccaaaatgaagagttctcgatctgtgtccacaaagtcaagtgaggcactaggacacagtcatgtcacctatagtgaagacacaggaaagtgaagagatggactgggctacagaccaagtttcctcaaactccatgcccagttctggcaggatggtagctttccttttggtttgggtctttctggggttgctctgttttggagttggagtagctccctgcctcaggctcacaacaggcaggagctggagccctagcacactcactgggaccagtctttgttgatgctgctcagttaggaggtccccttgaaacaggagggcattctaggttgtgaagtcagttctggtttcctatcttgcctttgccactttttagctacttggacacgtaccttgatctctctaagctttgggtttcttcatctgttaaaatgggataatgcaatctagcttcagcaagtggtagtaaatgagctaccttgggtaaggtacttggctgtgagcctgacacacggtagaagcttaaattgtaacatagcagctctcacctgtgttcccctcctagattgcattcatgagcttcccgttagggtcactgtccatgagaaagttcttcctggccctgctttggggaacctttccctcctttgctggctctccccactccccatcagtctggtcccagagtagccatctctgatcctgctgtggcattctggaagggactagagggaagagagtttcttgttttgaccccttcctgcttcagtgacaggagggctacagagagggattagtgagctaattagaaatgattgcattgctcagcattaattagcagtgttgtgggcttgcagtgtgcactttggaactgagccccctgtgggacaacatg

SEQ ID NO: 685 - DNA, 1022 bp, Homo sapiens
tcccattaccactcacatccagcaatgacaggccacctgtaagctctcaagcttcctgagccaattgtctcccctaaactgcagaacaggtgcccccaggagactgtccttgcccaaagtccacgtcccttatgattcccccgcctcagtccagcctctgcttcctgattgagtacatctgtgaaacctgagctgttcgtacccccactcttccagcatcctcagcagcttcctgctgtccacgagataaacttcagctccttcaggtgtggcatttgaggtcctcttgcatgccatctcctttcttactgtagcactttgcctacatgtgggccttctagccagactgggctcttgggcctcttggcctctgtttctgctgttcccttggcctggagccccacctcctcctgggtgtagccagtatagtcatggtcaatcacacagttattagttgatcatggaatcagtctgccaggtttgaatcccatctccctgactctgtggggaccttgagcaagctacttaatctttctgtgctttagtttctttgtatataaaatggagatattagaatcttatggggtttttgtaaggtgtaaataagataattatcaatccctcagtacaatctctggcatttagtaagtgcttaataaattttagctattttatttgtattatcattattattccctaaggccagtctcctataccatcttttctacttttccaggaagcattcttctccatctgtgagctcccctggatcctgttcatttgttttaggagggtgggaaggttccttgagagagtcctagctattccctgttcagcagtgcagcccaaggagtcctggaaatgcaggagggaccttcaggtgcagggcttggcccacacacaggactaccagggcatctgatatatctaggaagtaacaaggagccctggaggcaggccagggctgtggcaaagagacctagatcatgtgggacacgcctagtccctgcatctgtccccct

SEQ ID NO: 686 - DNA, 1024 bp, Homo sapiens
tagccacgtcctctgctctccttcccattatgagagtgtccctggttcctatcacaggccctctcttctgcttattctctgaagcacattccctcaaagacttcccttctgtagctcacctctccctttttctctgctggaccatctccattgacgtgcaaatatgctctctatcttccattgttaaaagagcccctctttgagaatttatggattaaaagagacttaaaagacatgtaccaaaaaggtaaaattatagcatttagggatgtacacccctccttgaccccaagttgccccccagctattcatttctttaccatttccttcctacttgacctcccagctgctttcgacccagttgatcactccctcactttcttttgttggcttctgtgatagaagttttcctcccaccgtctggttttgccttagtctcctttgcttgtttctcctgtttctctaccagactgttaggtcaccctcttccttctcatctctgtatactttttccctaagtggtttcccatgtggatgtctaacagacatcttaaatttatggccagaattcttgagtttcttcccaaagcctgtccttgttttccctatctcaggcaggcgcggtggctcacgcctttaatcccagcactttgggaggccaaggggggcggatcacgaggtcaggagatcgagaccatcctggctaacacggtgaaaccccatctctactaaaaatacaaaaaattagccgggcgtagtggcatgcgcctgtagtcccacctacacgggaggctgaggcaggagaatagcttgaacccaggaggtggaggttgcagtgagctgaaatcatgccattgcactccagcctggcaacagagtgagactccatctcagaaaaaaaaaaaaaaattatctgagcatggtggcgcgcacctgtagtcccagctactcagggaggctgaggcaggagaattgcttgacccaggaggcggaggttgcagtgagcccagatcatgccactgca

SEQ ID NO: 687 - DNA, 1033 bp, Homo sapiens
tgaaaccccgtctgtactaaaaaaaaaatacaaaaattagctgggtctggtggtgcacacctgtagttccagctacttgggaggctgaggcaggagaattgcttgaacccaggaggtggaggttgcagtgagccgagatcgcgccactgcacaccagcctgggcaacaagagcgaaactcctcaaaaaaaaaaaaaaaaaaaagattcataatactttttctcaaggacttagattaggtctctctctctccagaaatgttttcaggatagctataggttcctgtacttactcaagacagccgctctttgtgggagatatccttgccctcaggagctcctagatttgcacaatgtggacaaagaggttttggggttactggtacttggtctttctaatttttcctttctaaggaatatgggaagttggcgagcccctttcctggtagctgggacctatttcaccttgtacagaaacttggaggtttgcccctgaccaccctcgagatcgtgcagcactgactggctactgctctcggttctccaggtcttcgaagccgctccactcgcatgtccactgtctcagagcttcgcatcacggctcaggagaatgacatggaggtggagctgcctgcagctgcaaactcccgcaagcagttttcagttcctcgtgagtaacgaatgtgcccccaaccaccatgtttgaggccctggagcacattgcttggtccctgtgctagaatatcctgagattcatccattcccccagcttcagaactggtctgctcctgccctaccaacacggctttcttatttggaaatcatctcttttttaaaaaaacttaattgaaacattacacacacataaacacagacatgaacacatagcattgagtatttagttctgtgaatttttgtaaactgaacacacttatgtaactaacatgatcagagcattaccagtacttcaaatcgcctgagttcaagccctgtttgtcacatgggggcatgttttcctgtggccatggaatcagt

SEQ ID NO: 688 - DNA, 1100 bp, Homo sapiens
agtcacagtggctcaagcttccttccccgcttccacatgcaggcatctctcgggacaactggcacaagcgccgcaaaaccgggggcaagagaaagccctaccacaagaagcggaagtatgagttggggcgcccagctgccaacaccaaggtgggtgcgagcgtgggcctgtccgcctgggaggtcgccttcccccgctctccagcgtgctcgggtctttccgtgtgacagttgtgcgttctttcttgggctctgatttctctgtagtagggcctgggtgtcctgtccccctttagctgttggataagtaagtaccaaagagggaatgctccctcaggcccccaaacctggagcttaggatttcagagagaaggatactgtgtggggacttgagcttctggagagggtggcgcctcgcgtcatagtcagaagcctagtcttgttttttttacagaggcttaattttcagcatttggggtcaggctttcctcttggaggcaagtagggtgatgaaaaagaatccttaggcgtggttgtggccgtcttggtcacctgtgtgccacttgccaatgcaaggacttgtcatagttacactgactgttgcctcctcccggcccaggttcctctccctcacttgccttgctctccttggtaacctagttcctgtaaccttgtgttttccagattggcccccgccgcatccacacagtccgtgtgcggggaggtaacaagaaataccgtgccctgaggttggacgtggggaatttctcctggggctcagagtgtgagtgaggccctttgggagtgggtgggaaaacgcacctaaacggtcttaagattcaccaagtgggcctggcgcggtggctcacgcctataagcccagcacgttgggaggccgaggcgggcggatcacctgaggtcaggagttcgagtccagcctgggcaacagagcgagactctcagtaaaaaaaaagattcaagtgcttttagcaagtagtctgtggcttagaccaaggcatttgaagtttctccttgctgaaagatcttaaggtagctggggagttctctccacccaggctgtcctgctccaatctctttttt

SEQ ID NO: 689 - DNA, 1655 bp, Homo sapiens
gggttacgggcgtgagtcaccgtgcccgacctgctctgatctttctgaactctgcagcctgagagattggggctggtaaagactgcgggttgccaaacataactagaaacgtgggttagggggttgtggaagacgaactgatgccccatggcttgtaaaggctgagagttcccttatttctccttaaggcctcatggggctgaagaacctggaggagtgtgccagggccatttgtcctccagtttacttgatgccaaatttctcctgtgagcaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctggtgcgtgttacttccctgtaggggttgtggggagggcagcctgactccagccttctcgtgatgaaaactctgtccagttctgctactgaagggagagagatgagagccttttaggctgaggaaggccagcactggggtgtgcagggttcgagaaagctcccagggcctgccttccttccctgagctcatatatttgtatccccttttcagactcctgaggaagaagagattttaaacaaaaaacgatctaaaaaaattcagaagaaatatgatgaaaggaaaaagaatgccaaaatcagcagtctcctggaggagcagttccagcagggcaagcttcttggtgagaaggctgttgtgttggaggtggggagtcgcagagattgagtgtgccgaggcacttttcccttgtctcagttcctttgactgccagccatgcagtctaaagggttcactgataacaggctgcgagcacaaaggggaacgtttggtcaccctattcgtatgaagctgaaatgggaagcattgggtagaagagtctgcataggcccgtgcttggagtctttgtatttggggaagtctctgcccaggctgagggggctgtctcagtgatgaaaactttgtccagttctgctactgacagtaagtgaagataaagtgtgtctgaggagacagctggcttcatgcttgcccccagggtacctgaacccacagagattcttaagcgggtggagaggtttgggtagggccaccttgtcgttgtgctaaggatcacctactctcttgcagcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgctttatttccttgccctgcaaaactgatctgggtgggtggctgcaaccccttgccttaacctctgcctcctactgtcctgagccaggctcaccacactgtaaagtccctgttctcaactccatgtccctgaaggccagatttattatgtgggctatgtctatagtgggaacatttctcaccacattttggtggggatagggatgtggcagaggctatgag

SEQ ID NO: 690 - DNA, 1077 bp, Homo sapiens
tggaaggtctggggtagacaaaaggaagggtcagtctggcttctgtgacaccatctttctatccttctctagtggaccctgatgacatacatggttgagggtggtggctcaagcaccatggctcaggccaagcgctggctctatcagagacctcaggctagtcaccagctgcttcgcatcctcactgatgctctggtcccatatctggtaggacaagtggtggctggtgcccaggtgagtcctgagagagagagaaataggctgggatttggtctgtaaggaccagaagcaagagtgtcctaaacctgagagggcaggggtcttaatgccagggatgaaagaaccttggcctccagtgatctagcggagcagccaagcccatcctgacactgacagtggggcttaatgctctaagtattcagacaccaaagttagtgctgggatctgaggaaagtaaatttttttttttttaattactgggtttttagggtcaggcagtatcagggattgaagtcatttggggaaaattgaggtggattttgtatgtgggggaaacttcctctttgtgtgttacatatttttcttcaccataccctaactaggcattgcagctgtttgagtcccatgcagggcatcttggcccacagctcttcaacaagtttgcactgccttacatccgtgatgtggccaagcaagtgaaggccaggttgcgggaggcaggcctggcaccagtgcccatggtgaggattgggatgggttgagtgaaggtggtcctgtggagctttcaggctaagtcctgcatggactggagtgaccactggagggcagcagaagtacagtcaagaaagattagtggttgtagcaaggccctctgtagcctgagatctgcttttttctagatcatctttgctaaggatgggcattttgccctggaggagctggcccaagctggctatgaggtggttgggcttgactggacagtggccccaaagaaagcccggtaagccatggaagggtgaggccttgaggttgaggtgggggtgttggctgggggagctgccatgtatgcagttacca

SEQ ID NO: 691 - DNA, 1024 bp, Homo sapiens
ttcttgggcagcagtcatattagatatgttagattgccttatagttcccccattaataatcaaacggtactatttatataagccttgtcatgatggtatcttaggccatttggctatgaggtgtctgttttgtggcatggccaacttcctctgaaagcgactcttttctaacctggtcacacagcaatttggacagcaagagagtgctacagagatcagctgatgccaaagaggaactggcagggcagcagaaactcaatcacacaggcagaaaatgggtcagtacatatggccctaaaaacctgcattcaagtgactaaaaatcactgaactcctgctcttagctaagaactacatcctggggccacaggaaagaaaactgataggcccctatactgccttgactgctgtcattcctataaggcaagaatttcttaacccttctcatgtcatttgctcctgtaacacatattcaggagattgaagttaaacatgaaggctctcaagatgtatgagttggctgggcacagtgcatgcctgtaatcccagcaccttaggaggctgaggtgggtgactgcttgagctcacaagtttgagaccagtctgggtaacatggcaagaccccatctctgttaaaaatacaaaagaaaggctgggtatggtggctcatgcctgtaatcccaacactttgggaggccaaggcacgtggatcacctgaggtcaggagtttgagaccagcctgccaacatggtgaaaccccatctctactaaaaatacaaaaaattagcgaggggtgatggcaggcgtctgtaatcccagctactcaggaggctgaggcaggataattgcttgaacccaggaggtggaggttgcagtgagccaagatcactccattgaactccagcctgggcaataagagtggaaaaaaacaaaacaagaccaaaatacagccaggcatggtggtgtacgcctgtggtcccagctattcgggaggctgaggtaggaggattgcttgagccgatgg

SEQ ID NO: 692 - DNA, 1340 bp, Homo sapiens
gtggcacaatctcagctcactgcaacctctgcctcctgggttcaagtgattctcctgcctcagcctcctgagtagctgggattacaggcacctgccaccacacctggctaattttgtatttttagcagagatggggtttcaccatgttggccaggctgacctccagctggccaggctggtctcgaactcctgacctcaggggatctgcccacctcagcctcccaaagtgctgggattacaggcgtgagccaccgcgcccagttcatcttccatcttttcacctccactgcatagatgtgcctgttatatttctgagcccccttcccccagcattgaccttggggtggtgacagtagaaggctgaaaccaacatagctgaaacctctgcttctctcacctggcaggtaaaagcagctgttaagtatgcccttagcgtaggctaccgccacattgattgtgctgctatctacggcaatgagcctgagattggggaggccctgaaggaggacgtgggaccaggcaaggtaaggactggggttgtaaatagaggtgggataagagaacttagaagctgaagctagggctggggcccagctggagggaatctggcatcagcttccttccagttcctctcccagagttgagggtgggtgagaccacgtgctcatggctcttctcactgtgggccctgccccctgcactaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttcctaggggagaggagatatctacgtctaggaagaggagggggcataggcattccatgtaaacttaacacc

SEQ ID NO: 693 - DNA, 1028 bp, Homo sapiens
agacatcattctgtttatagcactctgtttttagtaatggttatttccatttacaaaatagggtaattctcgattgctgtaaatgtcaaatcctagaaaacgtagcattcctatgtatgatgttaacatcattctcaaatggttgttggccaaagattcatttgatgaatccaatttttatgaaataggcgattctgatattagttgtgtttagaaataactccggccaggcaggtggctcatgtctgtaatcccagcactttgggagactgaagtgggctgatcacttgaggtcaggagttcaagaccagcctggccaacatggtgaaaccctctctctactaaaaatacaaaaattagttgagcgtggtggcgggcgcctataatcccagctactcgggaggctgaggcaagagaatcacttgaacctgggaggtggaggttgcattgagccaagattgtgccactgcactccagcctgggtgacagagtgagactgtccccccccaaaaaaaaaaaaaaaaaaaactccgagaacagttttatatttttattttcatgctgaaagtcagatttgcttcagcttcaaagaacatgtttatgtaaaattaaatgagtgctggcaatgagctgtacttttttttttttctcttaaacgggaaaagggttaaaataagtcttatgaaatactgcttggctgggtgtggtagcttacaccagtaatcccaacactttgggaggccaagcaagacctccatctctgagaggatcacatgaccccaggagttcgagaccagcctgggcaacatagcaagacgccatctgtacaaaaaaaaaaaattttttttttaattaactgttcgttgtggcacttgcgtgtggtcccagatactggggaggctgaggtaggaggattgcggaagcccaggaagtcgaggtggtggtgagctatgatcctgccactgcactctagtctgggtgacagagtgagaccctgtctccaaaaaaaaaaggaaagaaacaaaata

SEQ ID NO: 694 - DNA, 1093 bp, Homo sapiens
ggataaacctgctgttaccttaacataaatcaaggcagtggcaacaaatagtactagcaattcttgtgttcttcactatcaccttcacttagaaaatgtccatgatgaagcgttacaaactgaagtttattaattctcagtccttgactacatggttttaaggtaacctggcaaaataggaattatggatggagcgcttcagcatatcaaaagtggctaccatggttttctttatgaaaagcccttgtgtgattaagagttgattgagctacttttttcatgtaactttactggcttttattcgaaagaatgttttatttgaaagttttatttttgaaagaatgaccaacagacaaacttttatttagacttgatacttagcagatgttttctccaaaatgaatacagtgagcctgtcactttaagggaaataactgacagtattgggtgctagtgatagaatgtgagctttcacatgaaaaataaaaattttggataagttatatatcaactgctgttgtgagactgacagtatcctaatactttgactgttctgatgaaattgatttttaagttgtggtaaaacacatataatataaaattttccatctttttaagcgtgtaagtcagtagtgttaagtaaattcacattgtcgtatacccaatcttatcttgcaaatctgaaactattacccagtaaacaactccctctttctgtcttccctagcccctggcaaccaccattctgctttctgtctctgaatttggctactttaggtacctcgtataaatggaataatagaatatttacctttttgtgactggcttatttcacttagcatagtgttcttaacgttcatccatgttgtggtgtgtcagaatttccttgctttttattgtgagtactgctgctgtgacgttgggtttatgtaatcgttcataagtagaagatctagaatacaagatagactggtttttaatgtaccagtatgagaagttcatcagtgttttcagattatacagtacaactaacctttaagaaattaccacttgttggtcaagtgctgtggctcacgcctgcatcccagtactt

SEQ ID NO: 695 - DNA, 1024 bp, Homo sapiens
aagtatattcagaatctaaccctctctaatactcctcaggttcctgtctagatttttacggtttctttcctttttttttaaatagagaaagagtgtttttgtttgtttgtttgtttgtttgtttggacatagggtcttgctctgttgcccacgctggagtgcagcagtgtgatcctagttcactgcagccttgaattcctgggctcaaacagtcttcctgccttagccttgcgagtaacggggactacaggtgcataccgtgatgtcagctaatttttgtattttcctatagagatgctagtctctaactcctgggctcaagtgatcctcccaccttcgcctcccaaagtgctgggactacaggcatgagccaccatgctcagccttagactttttcttttcttctcttttcttttctttttttgagatggagtctcgccctgtcacccaggctggagtgcagtggcacaatctcggctcactgcaacctctgcctccctggttcaagcaattcttctgcctcagtctcccgagtagctgggactacaggcacacaccaccacgcccggctaacttttgtattttcagaagagaggggggtttcaccatcttggccaggctggtttcgaactcctgaccttgtgatctgcccgcctcagcctcccaaagtgctgggattacaggcatgagccactgctgcccggccagactttctttccaactggttttctccccagttctgttcttgttctatcttaaagtctatactaatgtgatgctgctctctccctcttcctcacctttatttcccataattcttccccagcttactctagccagaagagttttctgtttctcaaatattttaagcaagcttcttttagagctttgaacttactattgcctctgtcctagagtgcttttcctctgtattttttttttttttttttttttggcttgccttcttaagttctctgcttcaatttgacattgtccctgtggtcttagctcattcttgttataa

SEQ ID NO: 696 - DNA, 1033 bp, Homo sapiens
agtttcgctcttgttgccctggctggagtgcgatggcgcgatgtcagctcactgcaacccccgcctccctggttcaagtgattctcctgcctctgcctcccaagtagctgggattacaggcatgcatcaccacgcctgcctaattttgtatttttagtagagatggggtttctccatgttggtcaggctggtctcgaacgcccgacctcaggtgattcacctacctcggcctcccaaagttctgggattacaggcgtgagccactgtgcccagctgtatttaggtatttttatttaaaaatgcatggttgtcttacaacataaaatgttacctaagtttttaagcacacataaatactttctcttaggttatttttcccagattactggagaggtcagtattcccactttcctgccattaagggtatttaggaggaaaatttgagatgtcttattctaatctagtagactacccttaaacatgacctccatcacaatttactgcttagattctctagttactctcaatagactcttaggccattagttggcctgactttgcatgaattctgccagtattttactccatgaaagccagtcttcttaccttacatagagaagtactttctccttttgttcattatacttacgtaatttttgtccttcttccttctgtctagatattaatagctaagacttaatacacagtgctatttgttgtctaaacattgttttcagtgcttttacatacattaactcatttagttcttgcaatagctctttgaacaaacagttattaacattcccattttacagatgagaaaactaaggcactgtgagaataatttgtctaaggtctcacagctagttatgggttaaaggtaggatttgaatccagttagaagaactccagatattctgcgctttacatcatgcctttccatgggccttaatcatcctctaggtcccagccaaaggtcctttaactattctgatccatactgacatccatcttttagcaggaggaataccta

SEQ ID NO: 697 - DNA, 1028 bp, Homo sapiens
aggaagaaggagaaaaaacagaagatgaatctctggtagaaaataatgataacatagatggtatgtggagttgcatgtgacattcaagagatgcgacgttgtatatttcttgtatacagtggtggaaacggggctctacctgtcctggatggtctctcctaagatgcttggggtgatgatgcctgcatctggtggagattgcagtggggatagctgtttactgaagctgacagcagatttttgaaagagaataacttattttctcaagtaaatccagttatttcgattggggttttttaaatcaaaaagataaaagcaagattaaattggtgttttaaatactattacaaccttaagtgtttttctgatgcaaatttttttaaacagcctgtgcagttcagttattttaatagcagtacttttagagcccttgtacattttttatgtgtgcgaaaattatataatttctaagctgaatttggctgctatagttttacatatcagatgggggagaatgaaaagcttggcatctcttacctaactggtaatcagaatgctcaagtaaaacaatacctagtgtaacaagcttgggtttcttttgcagtaagttgctctgctagccgggatgctccctttccttttctctagggggcagataatttttaggccatctgctgaaacttggtaggctttttgagggtttaaagggaatgtatttttagtttccatttatgcctttatcattaaactcgaagacatgtttatgcttcatgttctttaaccatgtagaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggagga

SEQ ID NO: 698 - DNA, 2091 bp, Homo sapiens
tagcccagggagctactgagaaatcacctgaagacaaagttcagatagctgctaatgaagagacacaagagagagaagaacagatgaaagagggtgaaggtaaccgggatatgcaagagctgcagtgggtggagtacattctggatttgactcactaattatgggtaaaagtcagccttccattcaggattttccgtctgcctttggattaggaaagggctaaatgaaaaggggggtagtttaacaaggtcgtgatagtcaagtaagttcaatcaaaagcagcaagtcttctttagctggcttataaactaacacttttactaactgcaaaataggccttctgtgtgatttctgagacttggctagctatcagtaacttgttgcagcatactagccaataaagtgggatggaaaaggtagatgaggggtggggtaggtagggaaatagtgggctaggctggcagagaatgctgaatggatgttcacttgcatgcctctggattttaaaattattgttcacatgactccttttctgtgcgttgggaagcagctacagagcagtagaatccactgaattggtacactgaagcaggcatgccatttaaatgaaggcagttaaccttgactgttgtatcaccagagttaaagaattctggtgcccctctttaagtcttcaggaagtgtttagaggcttattcacattagttaaaacaggccccccccaccttccccaaggcaacagaaaacataaccattagctctcttcctgttttccttcctcatttcatgcttgcttcggctgctaaactgaatttttgttacttagaatattataaagtgtggatgctttctataatgctattggtctaagtgtgattaaatttcattaaggtgtataagcctctaattattacataactggcacgtctgacttttgctatcatttgaggattctactgtatataagtttcatctaacattggcattaataaccacaggtatattccaactaattgttacttcttgtaattgccagactacttcaagagttctcgtaagttttagattttcagagacccatcttcaatactttgaactcattctggtaaacttccttctacctatgtgcaggtccctgtactccagccaacacaggctcagtaactggaaatgaattggctaaaatggtagcaccattgggtttcttaatggagctttaggagttctttatggaaaaaagcacagaactaaattcctcaaaaaacaaacaaacaaaaccacacacacaaaaaaacaaaactcccatgtcttgatcttaatgattgtgagcaaggatggtaaaaagctctgctggctgacccctaagaccttgaatggtaagctacaatacagatatcacagtcccttacagattgttcgaaaactcgttggatcataattaacattgttagaactctcatacattacatctgatcctaaaacaatactatgtgataggtagtattgcccaagttacagtgatgaggttgaggtttaaaggttacatgacttgtttagggtcataatactgaatctgaacccagatctgccttgaatatattattcttcccaagttaccacacattgaagaagacagtgttcatccttttcctacacccactgcttagaaattttgtcgtgggctgggcgcagtagcttcacacctgtatcccagcactttgagaggccgaggtgggcagatcacatggtcagaagtttgagaccagcctggccaatatgttgaaactttgactctactaaaaatacaaaaattagctggacgtggtggcatgcgcctgtggtcccagctacttgggaggctgaaccagaagaatcgcttgaacccgggaggcagaggttgcagtgagctgagatcatgccgctgtgctccagcctgggcaacacagcgagtctctgtcttccaaaagaaaaaaaaaatctgtcacttatttaaaaagttaactatattttaaaagccccaggcttttcatatgctgcattttttggtgttgtatatcagatactgttctgcttgtaaagacaatacagttt

SEQ ID NO: 699 - DNA, 1945 bp, Homo sapiens
acctggtgatctgcccaccttggcctcccaaagtgctaggattacaggtgtgagccaccgcgcctggcagccattgccattactttaaaacctttcccaacttgtgcccaggtatcaatggcaatgccctgatgtcctcagtaaatttgttaaagtatcttttttttttttttttttttttgagacggagtcttgctctgtcacccaggctggagtgcagtggtgcgataatccgctcactgcaagctccacctcctgggttcacgccatgctcctgcctcagcctcccaagtagctgggactacatgcgcctgccaccacacctggctaatttttttgttttttggtttttttttttagtagagacggggtttcaccatgttcgccaggatggtctcaatctcctgacctcgtgatccgcccgcctcggcctcccaaagagctgggattacaggcgtgagtcaccgcgcctgaccctgttaaagtattttctaagcttctttgaaaacggaatctctttgtggttgctgctgataaaactcctttgacctgacgattgctctaagtcctaattgccatatttatattcccatagtaagagtgtttggagatagtgtttgagcttttttgctggtgttaaaaatgcataatgaaagatggcagagagaggcatattatatccaattcatgagttgtttgtgttaacagaaagcttattttaatcacttaacattgttgatttgtctaatcacagtagcgctattgattaggagcctgacctttagatggttgacttgtgagtgtattcaatatggtgaaatatggtgttgatatatggctgcagattttagaggtgtcattagcaaaggtataggagtaaaataggggttatagtattccttactcaaattctgtatgtgctagagctggctggagtctgtggcatgctcattggtgtaagtcggtaaggactatgctttttgctccacatctctgttgtgggaaagctagtctcttgagcattcttgatcagaatggactggaataatttaactttcgtactttcccaggctattagtattatctaatgagtggcttaaagataccagaaacactgactgaggtctccacctgcttctggctgaatgaatgggagcttctagccattgaataagaggcagtagccaatgtttcttattctgaatggtccaggttgacttttataagagaaacactcagccttttaattgctgaaggtctgacccatagactaagattgcacattcttagtctaggttacacttgaactagactgcacccactgacgatatattcagttcaggtgttaactcacttggattagcatctggcctgtcctatctgaatataggttgagacgtgtattggaatctctgactagtcagaatacgttcttagttatattctcaatactgaggaatttttacttgtagaaactgaaggctcagaagaggatgataaagaaaatgataagaccgaagaaatgccaaatgattcagtccttgaaaacaaggtatgttgttagccactcagtactgttgtcagcctttttctgtttttgggagactggagctcactcttgttgcctaggctggattgcagtggggtgatcatgatcatggctcactgcagcctagacccgggcttaagtgatcgcctcacctcagcctctcaagtagctgggactacaggcttgtgccaacatgcccagctagtttgcaggactgtagcttacctagtttaggcacgattattatttttttaagagatagaatctctgtctctgcccaggccggagtgcactggcatgatcagggctcactgtatctttagcctcctgggttcaaggaatccttctgcctcatcttctcagatagctaggtctccagatgtctgccaccatgtc

SEQ ID NO: 700 - DNA, 1080 bp, Homo sapiens
accacgcccagcctcagtaggtttttaaaagtcattttgactttctttatagccaagggtcctggaaataactataaacaaaaatggaatgttaaatatgggtgcattcccataggatgggtctgaattctggaagtattttatgttgaatgctgtccatttacttgctcttctttttctctttgttagaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatgggtgagtgaagacgagctgcttcatggtgatgttggatccagcaattaacaaggaagaaaacagttcttttttgagccattactaatcactttattctttttagctgtactaaacgagcaggtgaaggaggctgaaggatcgtctgctgaatacaagaaagaaattgaggaactaaaggaactgctacccgaaattagagagaagatagaagatgcaaaggagtctcagcgtagtgggaatgtagctgaactggctctgaaagctactctggttggttccgttaacattttgataatagcatgtttggtaccatttatgttaatgttctatttgccaggaacttttcatcatgacttggtttccagggagttggtgggctcatctaattattcctatcaagtaatgcagtggttaagaggaaataccctggagccccagactatctgggttttaattccatacttacgtgtggccatgggcctttctctccctcagttgaccgatttgtaaaatggggataatacaggttgagtatccttacctgaatgcttgagaccagaagtgttttgcatttcaaatgcttttggattttggaatatttgcatcatactcaacagttggatacccttaatctaaaatctgaaatgctccagagagcatttcctttgagtgtcagtcagtcctcaaaaagtttcagattgt

SEQ ID NO: 701 - DNA, 1042 bp, Homo sapiens
ataacttcaataaagattgtaagcaaaggttgaggctttgatggtttttttcttaattattggctgaatctgccttggagcactgctggttttatatattagccaaaggttttgttctggccttctgtactgatctgtgttcctgatcctaattcctatctgtctaacgtggaggtgatcaagtgtggctgtaggcctttgttttccaatggtgctatattctgttttcaaacacttcactgaacccagctgtcttgcaaactttcagtggtgctgtccctggatgggggctacaaaaacaagaattggtgaagatcttgctcttcagtgctgaaaatggatgatggactttggctgtgagccaggcctaggatggttcttgtcctatatccacctagtcttcacctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggttgagttttgttattttctgtatagaaaggttgagatatatcaacacttggaattgttacccatctgcagaattgacttctcaaataaagatgctaaaaatctccttgtctggaattatgtttaaagatcttaagtggggtcttaggctgcttttttgagatgggatcttgctcttgtcgcccaggctggagtgcagtggcgtgatctcggctcactgcaacctctgtctcctgggttcaagagattatcctgcctcaggaggctcccaagtagccagcactacaggctaatttttgtatttttggtggagacgaggtttcaccatgttggccaggctggtctcgaactcctgacctaaagtgatctgcccactttggcctcaggaagtgttaggattacaggcgtgagccacttcacctgactgcctggagcatttctgtgtgcgatagagggtttcaaaggcagaaacg

SEQ ID NO: 702 - DNA, 1051 bp, Homo sapiens
tgggaggccaaagcaggcggatcacgaggtcaggagatcgagaccatcctaacatggtgaaactccgtctctactaaaaatacaaaaaatgagctgggcgtggtggcatatgcctgtagtcccagctactcaggaggctgaggcaggagaatggcatgaacctgggaggcgaagcttgcagtgagctgagatggcaccactgcactccaccctgggcgacagagcaagactccgtctcaaaaaaaaattggctgggcatggtggcgtggcctgtagtcccagctccttagagggctgaggtggtaagatccctcgatcccgggaggtcaaggctgcagacagcggagagcacgccactgcagtccagattgggtgacagagcgagaccctgtatccaaaaaaaaaaatgttacatcaaccctatgaattagtatccatatttcaaaggtgaatgaactgcaccataacaagattaaataatttgttcaaagacacacagctaataagtagtggagccaggattccaaccaagtttgacaccaaagtctgcactccaacaggctattctctctcagtactaagttaatgaggttattttgagcattaaatgagttaatgctcaccgggcgcggtggctcatgcctgtaatcccaacactttgggaggcctaggcagttggatcacctgaggtcaggagttcaggaccagcctggccaacatggcgaaaccccatctctcctgaaaatacaaaaattggccagacatggtggcaggagcttgtaatcccagctacttgggaggctgaggcacaagaattgcttgaacccggtaggcagatgatgcagtgagccaagatcgcgccactgcactccagcctgggcgacacagcaagactcttgtctcaaaacaaacaaacaaattaaaaaaacctaaattatattggttggtactatcgttattttgagttgtgaactcttaagccccaaaataggaggaaaaaaggaaacagaagctatgaccttccagttttgttttggttttttttttaatt

SEQ ID NO: 703 - DNA, 1052 bp, Homo sapiens
gctgaggtgggacccctggaagttgaggctgcagtgagccaaggttgtaccactgcactccagtctgggtgacagaatgagaccgtgtctcgtaaagaaagcaaaaaacaaacaaacaaaaaacaaaaacaaaaccacacacccaaaaagaaactcttctgcaaagttgtttttccacatgggatcctaggaggatccttaattgggcttcaggaaatctgtgaatgtcctgaaattccagttctcaaaattctgtggtttaaaagtgaaagcttaggttccaagagatcaaatgcaaaaatgactggaaagcacataataagtaggtgcttaataagtagtcttatctcattttgtttctgtaacatattgtttgatccattcctggtcatataaagtagatgctgaataaatatttgctgaatgaaaggatgaatcagtgttttagcactttcaactttctgtgttcatttgtatttcatttttgcttttaagttgcatgttattgaaggtaagaactatgtcatcattttgtctaacaatgcagagctaaaggctttgctcacaataggtgctcagtcattatttattgaatgaatgaatggagaatgattcaaatattttgaattttggtaatttgagtaataatggttatatgataggagtagacaaaggaaatagaatatttttgaggatggcagaagatgagttcaactttagttcctaaaataccctcagtgtgacagaaattttaaaaaattattttaatggaaatcagaacctctttcctctgcattacagggttagtacattgggaaaagcatagggcagaaagcacacagaagggaagctgcgtaatatatatagggaactataatcggtttgttattgccagacccagagctttacgttgaaggtgtaaatgctaggttagagattaaagaagccttgattgttgagggtctttagtgtgatataaaaggataattggctgggtgtggtggctcacgcctgtaatcccagcactttgggagaccaaggtgggtggatca

SEQ ID NO: 704 - DNA, 1031 bp, Homo sapiens
tagatcagtttgatgtgttacttatctgtatttgttacagcttccttcattgacatataatagatatacctcatcgggctgatttttttcgaaagtttcttatttattataatactcctgattaggtgggtgttggcttaaaaatgtctacatgttgatgatattattggacactgcttactgaatgaggagaaagaggtgttggagtggaatgggaaggttctgtcaatgttttgtattgcctgtattttctgatagtacttttatactttgaaaacctgtatttagctcctcttataggcatataaagaaagctctaatattaattttagcattaattgaatgttagagatatttctgactttatatgccaggtaaagtctaccatttaatgattttttttaaactaaaatatgcttttctttattggatataggaagggtatgaataaaaggataaacataaataaacttaactaagaagtgtactcattatgaatactatatcctgtcaaaatgtctgtcatcccatgacctttctcacctatttttcctttggcattttaataatcaatatcctgtgtcctttacagcatacctagcttttactaagaaatatgtttctggttttagctatggagggggaagtataatattttggcacttttaaattgtagtgaatgctgtagagatgtttaatataaagtttttatacttcagaggagatattaaagactcatgttttactctttttctctttgaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaaatatctgattttgttgttttaagaaatgtgggaccatgtggtcaatatttaagtgtatattaattgaattggcatcttgacagtttcttctctggtagtagtcttgtatagaacat

SEQ ID NO: 705 - DNA, 1031 bp, Homo sapiens
gagtctcactttgttgcccaggctgtagtgcaatctcggctcactgcaacctctgtctcccaggttcaagtgattctcctgcctcagcctcccaagtagctgggattacaggcacttgccaccataccccgctagtttttgtgtttttagtagagatggggtttcaccacgttggccaggctggtcttgaactcctgacctcatgatccacccacctcagcctcccaaagtgttgggattacaggcttgagccactgtgcctggcccaattaagtctattttgattgccctctcatgctgtcagtgtcactggtactaattgtatagtgagggtcaaggaaaagattctgtaaggttgtaacttcaatgagtaaattttcctgggaaagaacattctttttatagaaatgattctaaatctggtacagttgtgctgctttggtttacagctctgtggtatacatatttagtacatgaggacagggaacttgtttggcacatcatgggtacttaaagtatatgtataagaatgagggccgggtgcagtggcttacgtctctaattcctgcactctgagagtctgaggcaggaggatcgcttgagcccaggagttcaagactagcctgggcaacatagttgagaccttgtctatacaaataataataatcataaaaaaaaaattagccgaggatggtggggtgtgcctgtagtcccagctactcagaaggctgaggtgggataatcgcttgagcctgagcagttgaagctgtagtgagttgtgattgtgccaccacactctggcgacagagtgagaccttgtctggaaaaaaaaaaaaaaaaaaagccttttgtttgtctaggctttgtgtgataggcagggccttacaaaattaaagctgtgtagcctgggcaggttgctttgtttctgcctgttgttacaaattatacccttttatcctcaaacttgcttttgtaccaaaggcacccactggctttctgctcatctcacactgttccctctatccttaggt

SEQ ID NO: 706 - DNA, 1031 bp, Homo sapiens
ctttcacttagtctaatgtcttcaagattcatccatgttgcagcatgtgttcctttttgttgccgaatagtattttgttgtatgtatatatcatgttttgtttagctgttcatcagttgattcatttccttcattcttcaccttcattttctaatgtttattgagaggatttatctgagggcttatttttcccatatatgtagaaatcatgatcctaattagtgattaccagggcatgttctaaaaaggatcatacaatcgtatcattatatgtgcctagggatggaggagaacttaggtggaatattgttcaagattagttcttcttcttcttaaaaaaaaattacatagagtgaaaatctgttgttaacagtgggttgtttctgccttttggctattataagtaatattgctatgaacattcatgtacaaattttaatgtagatatatgttttcattcctcgtggatatatatctaggagagaagttgctgagtcatatgataactgtatttaatcatttgaagaactttgatttctctacatccttgctatcctggtgggtgggaagtgatatcttgtgtctttgatatgcatttctctagtgactcatgatgttgagcatctttcatgtgcttaccggacatttgtttgtcttctttgaagaagtgtctatttggattattggccatttttaaaattgaatgtttcttttattgtaagtttgtaaaataattgtttctttagacctgaatccaatttcttctctttcccagggaactgctttttgttttctcttgtgctttttttttttcctgagctacttatttacctactgtaacttcaagctagctcttctcttcccattctcccgcctaaagattttcagttgaatattttatgttaggtggcacatttgctagttggtattaaatacctatttctgctttgaccacccatactggaataaacctcagtgtctaccctgcttctggctgtgacatttctgaaaaatcttaactagaatgtatt

SEQ ID NO: 707 - DNA, 1028 bp, Homo sapiens
tctgtcatccaggctggagtataggggtgtgatcttggctcactgcgacctccgcctcctgggctccagtgatcctcccatgtcagcctcccaagtggctgggactacaggcaccatcacaaatttttttttttttttttgagacggagtctcgctctgtttgccaggctagagtgcaatggcatggtctcagctcactgcgacctccgcctcccgggttcaagtgattctgctgcctcagcctccccagtagctgggattacaggtgcctgccaccatgcctggctagtttttggtatttttagtagggatggggtttcaccatgttggccaggctggtctcaaactcctgacctcgtgatctgcccgcctcagcctcccaaagtgctgagatcacaggcgtgagccaccacgcccagcaacatctggctgatttttgtattttttgtagagatggggtttcgccatgttgcccaggctggtcttggactcctgtactcaagcaatcctcctgccctggcctcccgaaatgctggcttacaggcatgaaccacctggtgcccagtctaggaagactcatatcatgaagatgtaaattttctccattaagctatagatttaatgcagtcccgatcaaaacccaggtagtatttttcagaaaatatcaagctgatttcaaatgtgtattgaaatgtaaaggacctagaataaccaaaacaatattaaaaagaagaccaaagttagaggaatcaaacttattttatgactttgtataaaggaacagtaatcgggtcagtgtgattattggtataaggatagatatatagatcactggaaccaaatagacaaatttgccaaggcaatttaatgggggaaaaggtagtcttcataacaaatggtgttgaaacaattcacacaaaaatatcaacctctatacttacctcatgctgtacaaaaattaacttgaagtgggtaattgaacaaatgtaagagcttaaatcataaaatgtgtagaggaaaacgagaaa

SEQ ID NO: 708 - DNA, 1041 bp, Homo sapiens
tcttttaattaggctgttattgtcatgtgttgcttcgcactggtatatttacagtgctgagcaaagattgaaaagcagtgctactggtgcattctatcatatagacaatataattactagtgatagtttagttgcaatagagaactaatatttactagaccctattcctagtttaacgtatgttctcctttattttctccagaacattgagttgtcattcttcatttttgcaatatgtcttatctatagaatgtatagggaacaaggctggtttcagcatgtgtagactggtggccttaagagatagcaatgttaagaaatagtagtagtgtacaataaaccattaatatagcagtcctgagactactatccttagaaaggcttgtgcggaaggccgacccttggctggtatctggaaacttgaatggtaaacagtttcctacactgataaaaatttccttgaatgataagagtgacttactgtgcaaacaatgtgatttatgctgaacatttacttaccttctgggagtctgaaattttggtatgtagtaggcaagagggtgcctgtgtgagcagctccattaaaaactttggacactgagtctttggtgagctttcctggtagacaacatttcatggatatagttactaggtgttgctggaagaaataagtgtgtcttatgtgacttcactgggagcgaactctgggaagcttgtgcttggtttcctccagactttgcctcatgcaccttttccatatgctgattatatgcagggtcctgtgagtactcctggaggatcatggaacctggggatggttttggtgacccctgacacaggtagtctttgaaggatttatgaaaatagttaagggtatagccggagtaatcaggcaagagaaagaaataaacggcattcaagtaggaagagagaagtcagattatccctgtttgtagatgacatgattgtatgtgtagaaaaccccatcatcttggcccaaaagctccttcaactgataaacaaattcagcaaagtttcagg

SEQ ID NO: 709 - DNA, 1046 bp, Homo sapiens
caacaacagcccagctgggagccaaatcaggaaggcaatcccattcacaattaccacaaaaagaatacaatacctaggaatactgctaaccagggaggtgcaagatttctacaatgagaattagaagacactgctcaaggaaatcagagaagacaaaaacaaatgaaaaaacacaccatgctcatggataggaagactcaatatcattaaaatgaccatactgcctaaagcagtttacagattcaatgctattcctatcaaactaccaagaacattcttcacagaactagaaaaaacgattttaaaattcgtatggaaccaaaaaagagcttgaatagccaaggcagtcctaagcaaagagaacaaaactgggggcctcacgttacccaacttcaaactgtactatagggatacagtaaccaaaacagcatgttactggtacaaaaggcacatagatcaatggaactttatttccggcagaaataaagctgcacacctatgaccatgtgatctgtgacaaaactgacaaaaacaagtaatgatactgggataactggctagccatatgcagaagattaaagctggaccccctcttttcttttttttttttttgagatggagtctctctctgtcacccaggctggagtgcagtggcgcgatctaggctcactgcaagctccacctcccaggttcacaccattctcctgcctcagcctctggagtagctgggactacaggcgcccgccaccacacccagctaattttttgtatttttagtagagatggggtttcaccatattagccaggatggtctggatctcctgacgtcgtgatctgcctgcctcagcctcccaaagtgctgggattacaggcgtgagccactgtgccccgcccatattttctttatctagtccactgttgatgggcacctaggttgatcccatgtctttactattgtgaatagtgctgtgattaacatgtgagtacatgtgtctttttggtagaatgatttgttttcttttgtatatttacccagtaataggatt

SEQ ID NO: 710 - DNA, 1033 bp, Homo sapiens
atacagggcttggtacacagcaaacttgtaattaatgtttgaggtcaggcatgggtggctcacatccgtaatccaatgctttgggaggctgaggtggggggattgcttgaggccaggagttcaagaccagcctgggcaacctagcaatatcccgtatctaaaaataataacagttacaattgtttgttgagcaaatatttaaatgaataaatggaactaatatgtggcttcttctcatataagaagtctagggaaaaccttttcagacaaggtatagtgtaactcaggttgaaatgacaaatgtgagactatttgcagtcacacacgcagttgcacatgtgattttgacatcaaacatttttgtttatttttgtttacttgcatgccttgtaagtttcatgttttactaacaagacactttattctttgagtgttacatgtcgtttggtttggcttgcttctgtatgttaaaaaaacgttctgtcttttgaaaagataccattatctaattggttttaagttaggagaattctaaattacagggcacagtaaaataaatgagcaattataccgaggaagagcaaaacaaacaaaaaagaatcatggaaccatgttttgtatatacgtggggagaagttatcctttagatctgttttttttttttatgtgagtatgcttgaatgtatatgtcatgagggtagtgggctgggctgagctggggaggagatgtgcatcatatgtagggagtagacttaagctagttatttttaaataatactttagcaagggaattagtacttgtttaagtgttcatattgccttaatattagcatagctttttcatcaatatgttcagtatctcaaacgtcaaatttgcatgaaaatattctcccaaacccctaatccttccctgttttatttttcttcattgcatttattatcttctaacatactgtatattttatgtattcattttttgtttaatgcctgtctacatccacttgaatgtaagctttaagaggtcagggatttt

SEQ ID NO: 711 - DNA, 1035 bp, Homo sapiens
gtcttttttgtggtaaaaattggctttcatcttacatctacttttgaagcatctacacatggagagacatttgagattgaagttccttgtgaattgaaggaggtgcttttatacttgccctgtttcccaatcaactttatgggggatgattttaactttgaaaggtcagggactagccaccataagcaaatttttgttatcaactctcttagtgccataatttccacattatttgcccataaggcacatatagtaatctgtcttcattgtatagacagtgcaatttcccaggttctgaattgaaaatatttgttgtgctgataaaattattgccttcaggcaaaaactaaattgtatagtatttttatgcaccccccccaaccccctgcttgctttttgcctttgctgttcaaaaacgagagtacttagagtgtcattgtttacgggtacttaattattttggaggatatatgacaacataatgcatactgggaagcattattattgagaaagccttgggactttttttattttgcaaattatgactgtcataaattatggtcatcttacaaaatgtgattcagctaatttttagtctttaaaaacaaaatcttcaagaaccaggtagatttcaaacattcaatttcttcttgaaatttcattttaaaaaggctgatgacatggataaaaatgtaacctaattatttgcttctgttgttctacatttccttgttcttttctgtgggaagcttgataaaagaaacatttcagtttgtactcttcagtttttagtaccactaagatattttcatcaagtcagtaaattagatggctttgaaggttaaggaatttatctcactcttgtccctcttctttgccctgactcatgtattcctattctatgttgcagctacaccagtcttgtacctttgtttgtttttttcatagtcatttttttctgacattccccccattcctgagtggttttatcctccttttctacctatcaaccttctgataatccccatgcagtta

SEQ ID NO: 712 - DNA, 1096 bp, Homo sapiens
aaatagagaacagagaaggagcgagactgagtagaaagatcagctgagttttagacatattaaggacaaggtagttgtatgtacaactatagaggtcagcaaaaagatctgggatagagatacaaatttgagattgtaaaatatatagagaaaggagagtgtacaagcagaactaaaaggacagtccccatttaagggtctaaggtgatgaaggatgagcctgcaaagatgtttaaatggtgtgtttgcggggataagaggaaaaacaagagaatgtggcttcatggcaagaaaagtcttccaggacagaagagtgaatgatactatcaggtgctgttgagcagtggagccaaaaaagataggtggactaaaaatgcagtgaagcttcattaccctggcgttatacattacattggcagtgtgccaagaatggtttaaatgggctggtaaggtctagggatatttatagagtgttgaagaatgagtaggaagtgagaaattagagacattggatgtagataactcattcaagaagtgtggttgtgaagggaaataaaattgataaggcagtatttgaagagggatgtgtagttattaagggaatttatttccttatctgaagctggaatagacttgaatgtgttcagaatgctaatcaggaagatcattaagaacatgaagagtcaagagataatgagtagatcagagaaggctgaatggaatgggcttcacctgatattgtaatgtattaccaggtattaccagcctagttgctggaaggttatgagtaaaataatttatggttatctgtctaaatgggagtactcttgcctcagccaagtttcctgattgtgtagcttttctccccaacttgctgtgaatattccctgggaaaaggaggattgagaaatcattgctccttggactacctttatgtggttgggcccttcttgttccactgtgccttagttgtcacagaatgtactgatctggagtcctgggcatcaaatgcaggcttttgtataggtgtaaggaagtcggaagggatggatttccacggatgcgcttccgtgcctctaaaggaatgcagagaggg

SEQ ID NO: 713 - DNA, 1049 bp, Homo sapiens
acagttaaagttccatggtacctcttgtacacagagctgggcaagtctttgtagggagtgtgcagtaggaggcaaagtactgcttagcatttgtagtaaagaaaacaggtaagaaccacaaaacaaatatttgaataagtttaattactacaaaatttgttgtgtggaaaaactgatgttaataaaatgagtgacttaccatttgctccactgtttctcgtcctcatagcctgatctggaaaatttttaaagtttctataattgtcatttaagtcttggtcagaaggagggggcatcatatttgtgtccctgtttgcctttcttagaatggttctcccaagagcgaatcctatggtgtgctcattccaggttataaaggcccgtttcctctgatatatccttcatggacatagagaaatttagaatttgcctctagtttggtgttcttgtcctttgagagagcgtttttgttaattaatttttgaggctttcaattgctgtgcttttcacgtaatatgttagttgcattaaaatggacaggaactcaaatatgagtttctagacttatgtgacaacttggcattatacaaaatacacattcttccactcaacaagtaattcctccaaagtctccaaattggtaagtggaagtatagcataaaaattaacagcttgggtttgcaagtcaggcagatgtgggtttcagtcacggcactattacttactagatgttttttggtaaaatcagttactatatttttgtctttttgcctccattcactttgtcatttgctcaaatctttccatccatgcatccatcatactatattattttagttccagttaggtgtaggcactattctagatactggagatacagtagtgaataaagcagacaaggtccctgtgctcatggagtttccattctacttaagagagacaaaaacatgtatgatatgccatatggtacttactgctatgaagaaaaataaagccagatatcagagaggaggatgtgtgtttctgtgggggtgagggtttaaatttta

SEQ ID NO: 714 - DNA, 1031 bp, Homo sapiens
tatctccccctgttttagacaaccaatgtttcaattgcccattctacttctctatcaaactattactctaaggaggatatctcactctgtccattgttggacattatgggctgtatagtgtgttccttggtctgaagaatgatggtgggccatccaaatccatgcaatatcttccgttctgttttttttgttgttgttgtttttgtttttactctgagaatttttatcttccatgggataagcaaagcccactccagagtcagtgtctattcctgtcaagacccctttgtagctcccagggctaccggcatcagtctcatttgccagccatgttcagggccttcctaccagagaatctgcgccatagccatcagcaatctctgtctctgttgctgagaaacagaacagttctttctggcattttgtacctgaaagggtgcaaaaggatcatgtctagattcagctcacctctgcactgctgcattgcccccatactcactttttttcagggactgagttggccacctcaagggagcacatgggatgtctacttatccatccctgtcaccttaatgcatccctcaaatctccttagggccatgctccatatgggcattcttttaacaggccagatttccattgtcctctcacctgagtatatagccaagccattggttacattgcatgaggtcagtaaagactcaaacacaggggcttctaccattgttcaattcttccatcagtcactgttagaaaaatataatgcaattcagcccaccaagcagatctgtttttaccttctttgatcagaggagtagtcttccaaagcaggatgatggttttcatttaccttggaattgccatccatgaaccaaacagctcttgatcaattttttttaattaaattttatttggaggagatttgctctgctgaagcaatagaaattagaattggccaaaaatatttttcctttcttttcttttttttttttttttttttagattcaggggtacatgtgcaggattgttac

SEQ ID NO: 715 - DNA, 1048 bp, Homo sapiens
gcccggccgatgttggatatttttttcatgagtttgttggtcacttgtcttcttttgtgtctgttcgtttctattgcctactttttagcagatttatttgtttttttcttacgatttaagttccttatagattctggatattagtcctttgttggatgcgtagttggcagatattttctcccattctatgggttgtctttttattctgttgattgtttcttgtgctgtacagaagctctttagtttaattaagtctcatttgtccattttcgttttggtcatatttgtttttgaggtcttagtcataaattatttgcctaggccaatgtccataagagtttttcctaggtattcttttagggtttttatagtttcaggtcttaaatttaaatttttaatccatcatgtgttaatttttatatatggtgagagataggggtccagtttcattcttctgcatatggctagccaattttcccagcaccattcattgaatggagtgtcctttccccattgattattgtggtcaactttgttgaagatcactttactgtaggtgtatggattgacttctgggttctctgttttatttcattgagctgtgtgtctgtttttgtaccagtaccatgatgttttggtgactatagccttgtagtataatttgaagtcgagtagtgtgatgcttccagctttgttatttttgcttacgattgcttttactatgtgggctcttctttggttccatatgaattttggaatggttttttctgattctgtgaaaaacgacattggtaatttgattaaaattgctttgggcagtgtagtcattttcacgatattgattcttcctatccatgatcataggatgtttttccatttgtttgtgttgtctgtgatttctttcatcagtgttctttagctctccttgtagaggtctttcatcttcttggttaaatgtattcctaagtattttattttggttgtggcaattgtaaatgggattgagttcttgatttgattctgagcttgaatgttggtatatagaaat

SEQ ID NO: 716 - DNA, 1058 bp, Homo sapiens
gttacataggtatacacatgccatggtggtttgctgcacccatcaacccataatctacattaggtatttctcccaatgctatccctccctggactttttaaagtttttaatgcagaggtatggattagtgatttcaggtcttccttttttgatataagcatttaaagctatatatgtgcctctaagcactcctttaactgtattccataatttggtgtgtgtgtctttattatagtgtaattcaaaatattttctaattttctttgtcatttcatctttgaccaatagattatttagaaatatgtggtttcgtttccaaatattggaagattttatattttattgtagttgatttctaatttaattctgttgtggttagacagcataatttatggaatttcaatattttgaaatttcttgagactttttttatggcctagcatgtggtctttcttggtgaacatgcaatgtctgcttgattagcttacctgaactctagcccatgcctcctcagcttagtggaactactgtgctctgcttgaactctagctgtctgcccttgtaagaaaattgctcccaggcagctgaggagggagcagcctgacttttgagtttcccttctttctgggttttctttcttgcattacatgtgtcccagtgcctgaaaactattacattgtatattttgtctattcttatggtaatttgtagtagaatggctagttctctttcggtaatgtcatagttacaggtggaagtttgccaatctttaggtccctgcctaaaatcgaaactttttttctttagttctcactgaagacaaagcgtgtactttttacatcaaatgtaaagctataaaattctcatttatttctactttcttgttttcttctttaggtaactcgacagtatgtaaagtttgttgtttaacatgacttttgtccctgttataatctatagaactgaataatatttacttaaaaaagttaggtatctttttctcactttattatcagttaaataaataatttcatttaaggctttatcataggcagtga

SEQ ID NO: 717 - DNA, 1066 bp, Homo sapiens
tgagatcataccactgcactccagccttggagccagaccttgtcaaaaaaacaaaaactaacaaaaaaacacactctggttatagttagaaggccactaggtaagagacaatggttatttgaacccatgatgattcagataagaagtggtcagatttggggattattttaaaggtagaattgatagaggaggaagagatatccaaggattgagctctggggcaagttttagaggttggggcgatagtgaggaattagactaaaatgaattagctattcattcaggaacaaggactaggagaagtatcttagaagccagttgaaaaaaaaatgttaaaaaaggaaagcgtgattgatcagtaggtatttgttaagctttttgttagagaatagtaacctgaaaaactaaaagtttaagtgaaacacaatgtatcacacagatttaagtgacattatttgatacaggagcttaaattccacagacagtttgggacagtgatagactgacataggacaatgttagaggctaacttctctctgaaggcacctcttctagacgtactagcgcttggcgtatgaggctgagaaagattgtaagttgggtagcccccaagatgtacccagtcctggcacatggttttgagtatctcttgatgactatggtctcagaacacacaacctggagcaacatcttacagctttggagcttgttaaatttcatgtttttttttttttttttcatagacttactaacatgtgtggtcactgtattagtgcttcattccattcttcttttgtatccatgccatgcaaagtgccagttcattgatatgacaagattattttagcttgttgtttgctagatatttttatattcctttaaacattcttgagaatctgggatgcagttatttagaaattgtttgatcctttgaaggaatactttcaggctttgtttggtgagaccagggcagcacttgaggctaattttttcttactactgaggcaatactttgagtactctatttgatgcccatgtattgtgagttttttccactcaggctgat

SEQ ID NO: 718 - DNA, 1044 bp, Homo sapiens
atttgatgagtataactattataggctgaattatgttctactaaaatttgtataggttgaagtcctaacccctagtaactcagaacgtcactgtatttggagacaggatctttaaaggggcaattaaggttaaatgaagtctttgagatagatcctaatccagtatgacttgtgtccttacgagaagaggggattaggacacagacaagcacagagggaaggccatgcaaagacaaagggaggtagccatttagaatccaaggaatgaggtcatagaagaaaccaaccctgctaatgcccttatcttggacttctagcctgaactatgaggaaataaatttctgttggttaagtcacccagtttgtgatacttggttatgtatggcaaccctagtaaaccaacacagctattgaggcatttggctgcattgccccagagttggaaaacagtgtccccttgcatcatagtgtagtgaggactagccctgcttaaggtcttaagcctctttattgactgtatcttagggatggtcttaggaccttacaaattgttgcccgtaataatttgaaggacaatgaagatacagtcttgaaatgatacccactctagctctgtaatacattgcgttttatgccttgattggaaggaatgagtctgttataaacaaacgttgatgctagctcttaagtgtctcagatgggtatgatgaaccttaagaggcataataaatttcattgtgatttgggttaaattaaataaccactaacctttactccatttgcatgtcttctaagaaaatgattccagagtattgattggcactcagatgggggtgttgcatttttagagtaagagtgctagattgactttgtgttgtaagtggtgtccttgaagagaggaggcagttgtgtctctggctattcactggcccagctgtaggcctgctggagagagaagtttgatgttaacagcttaatggaacacagaatgacttaggttttgaatcagttttgaattgccatagactttgtcagccctgaagt

SEQ ID NO: 719 - DNA, 1057 bp, Homo sapiens
cctaatgggtaatgatctgagcatcttatctcattgttagccatttgtatatcttttttggtggaatgtctgatcaaatatttttgttcatttaaaaaatctgttcgttttttttttaaatattgagccttgagttctttgtatgttctagatacaagccctttattagctatatgatttgcaattattttctccctgtctatggtggttctttccatgtatttggatggtgtcgtttgaaatgcaaaaattgataattttttattttttattgatcatgcttttggtatctaagaacttacttgcctaacccaagctgttttttttttccattttcttccagaagttttacattttctactcctaaatttaggtttatgatccatttgagttaatatttatgtatggtatgaggtcaaatgtgtgtgtgtgactgtccaatttttctagcagaattcgctggaaagggtatccttctactattgaatcctcttgacacctttgttgaagtcaattgaccacaagtgttaacagtttatttctggactctctcttgccttccattaatctatatgcctatccttgtgctaattccacactatctttgtttaatgtggctttatactaagttttgaaatcaggtggtataattcctccaactttgttctttttcaaaattattttatgtgttttgggtgctttgtgttgctatataagtatgaggatcaatttttcaatttttttttgggggggtggggtcgcaggggacagtcttgcttggtagcccaggctggagtgcaatagcgcgatctcagctcactgtaacctctgcctcctggattcaagtgattcttgtgcctcagcctcccaagcagtgggactacaggcatgcaccaccacacctggctaatttttttgtatttttcctagaaacggagtttcaccatgttggccaggctggtctcaaactcctgacctcgtgatctgcccaccttggcctcccagagtgctgggattacaggtgtgagccaccgtgcctggcccaatttttcaattt

SEQ ID NO: 720 - DNA, 1049 bp, Homo sapiens
gggttttaaaatcgtaggccacacacctatgataacctgatctttgacaaagctgacaaaaacaagcaatggggaaaagactccctattcagtaagtggttctgggataactggctagccataagcagaagactgaagctacatagtacccctcctttacatcatatacaaaaatcaactcaagatgcgttaaagacttaaacgtaaaactatgaaaaccctggaagacaacctaagcagtaccatcctggacacaggaatgggcagatttcatgacaaagacaccaaaagcgattgcaacaaaagcaaaaatggacaagtttaattaaacttaagaggttctgcacaacaaaagaaactatcaacagagtaaacagacaacctacagaataggaaaaaatatttgcaatctgcatctgacaaaggtctaatattcagcatctataaggaacttaaacaaatttacaggagaaaaacaaccccattaaaaagtgggcaaaggacgtgaacagatacttttcaaaagaaggcatacatgcgaccaacaagcataagaaaaaaagctcaatatcaccgagcattagagaactgcaaatcaaaaccacaatgagatctatcatttcacaccagtcagaatggctgttgttaaaagtaaaaaaataacagatgctggcaaggttgtggaggaaagggaacacttacacactgttggtgggagtgtaatttagttcaaccattgtggaaagcagtatggtgattcctcaaagagctaaaagcagaagtaccatttgacccagcaatttcattactaggtatatacccagaggaatataaatcattctgccataaagacacatgcacacgaatgttcattatagcactattcacattagcaaagacatggaatcaacctaaatgcccattaatgatagatgggataaagaaaatgtggtacatatataccatggaatgttatgcagccataaagaacaagatcatgtcttttgcgagaacatggatggagctggaggctacgatcctaagtaaac

SEQ ID NO: 721 - DNA, 1061 bp, Homo sapiens
ggttcagagtagtgggagactgtcaggttagagagtggaaggcattccatggtgactgaggtagttaggggtatgggcatgattggattcctcctgatggtttcttaggggaaaatggttatcatttctaatgataatctctttcttgagattgatctcattccttccatcagccctacagagtctggctgtggccttccccatagcttctataacctacttctttttctgtcattctcccctcctgtcatccactcttgacttctttgctatttcttgaacatcccaaatttgttcttgtctcagtgcctttacctttacttttctctctgcctctcagctctacttttgtctgagtccttcatatcattcagctctctcatcagacttcacttccctagttagcactcccacaccagtctcttatttcctttctccttttctccctctccctccctccctctctctctctctccctctatccccctctccccctctccctctctctccctctttctgttctttcttcctcttccttttcccacagcactgttcactccagttatgaggatagagactgttcttttgttccctactgcttccctcctaagacactgcctagtgtgtagtaggtgttcaataaatatttggatgaatataaatggcaaacttccctaatgccttcaaaagatagactgactttcaaataaattgatatagacttttcagtaatagatgttgcatgaaatggcttttcatcaccatctggttttctccaaccagaagaaaaagcttcagacattaacatgtagtggaaagcccgtttatagaagaaacccagggctgttctgacatttattctgaaatgagaatattacttaattcacggactaaacgttctaaaaataataatttcatagattaatagttttggggggttcttagagaatatgagaatattttgacttgtgctttttattttgtaaatcaatttgcagtggtcattcttcattagatactgtttaaaacatggtttttgcccgtagggagctccttgtgtt

SEQ ID NO: 722 - DNA, 1050 bp, Homo sapiens
cctgagagtctggtgattctgaaactgaactttgtccttgggagaaggatctcaccttctttggctcagattctcttagcctagaagccagccttttagtgtgatgatggcccctttccaagaatcagtaaatctctcaatcacaagctgtcactttagaagataccaccaagagaacagggatcccagggaactggagacatacttgacctttaaagcaaagctctcattgtgcttaggtgctttcctctaaaaaaattgactgaaattagctggattagctcaaacagcacatcctagatttttagagaaactcagcatacatctatctgacctgacctttttatcatataggaataaatttaacatgtctagaccttgtatatagttgcacaactaatgtgagtactgagcagtagttactactggctgctcttctctagatgattatctctctatttagattctccacagttagcatttagaactaaatcttcctactcaagtggatttgattgagaacaccacctggccttttcagcctgcctggatctgtagactccagctttgagttaatgtgtgtaacatgcttagtactttacaaatgttagcatctgtattatctcttagcaaatcactgcagaaaatctagggggcaagaatggacataaaagcccagtttgtgactgtagactatacttatccagctgttgagacaggcagcactgattgttccacgcagatcccacatggcattagattatatcctcaaatctttttttttatagataattttattatactttaagttctagggtacatgtgcacaacttacaggtttgttacatatgtatagatgtgccatgttggtgtgctgcacccattaactcgtcatttacattaggtatatctcctaatgctatccctcccccatccccccaccccacaacaggccccggtgtgtgatgttccccttcctgtgtccagtgttctcattgttcagttcccacctatgagtgagaacattcggtgtttggttttttgtccttg

SEQ ID NO: 723 - DNA, 1026 bp, Homo sapiens
tgccctcacctatatataggctccccattatcagctccctaccagagtgctacatttgttacagttgatgagcctacactgacacatcacccaggcactagtttacattaagattcactgttagtggtatacattttgtgtgtctgggcaacattatcatttaccattatagtatcatacagtcttttcactgtcctaaaaattatctgtgctctgcctatttatttctttctccccttaactcctggcatccagtaatcttttgactgtctccacagttttgccttttccagaatgtcatatagttggaatcatacaatagccttttcagactggcttctttcacttagtaatacgtactgaagtttcctccatgtctttccatggcttgatagctcatttctttctgaataatatcctgttgtctggttataccacggtttatttttatccactcacctactgaagggcatcttggttgcttctaagttttggcaattgtgaaaaagccgctataaacatctgtgtataggtttttgggtagacgttaatttttaacttatttgggtaaataaggagcacaattgctatattgaatggtaagagtgtatttgattttgtaaaaaaaaaaaaaaaaaaaactcttcaagctgggcgtggtggctcacgcctgtaatcccacactttgggaggccaaggtgggcagatcacttaaagtcaggagttcaagacaagccgggccaacatggtgaaatgtcgtctctactaaaaatagccagacatggtggtgtgcacctgtaatcccaggtacttgggaggctgacgcaggagaatcgcttgaaccagggaggtggaggttgcagtgagccaagattgtgccactgcactccagcctgggcaaaagagtgagactctgtctcagaaaaagaaaaagaaaaactcccaggccgccttccaaaggggtggtaccattttacattcccaccagcagtaaatgaatagctcctgttgcatcatatccttgcc

SEQ ID NO: 724 - DNA, 1121 bp, Homo sapiens
tgaaaatgcaaaagaagctgggtgcggtggctcacgcctgtaatgccaaccttttgggagaccgaggtgggcagatcacttgaggccagaagttcaagaccagcctggccaacagggcaaaaccttgtccgtactaaaaatacaaaaaaattagctgggcatggtggcgcacacctgtaatcccagctactcaggaggccgaggcaaaagaattacttcaacctgggaggcagaggttgcagtgagcaaagatcacggcactgcactccagcctgggcaacagagcgagactctgtctcaaaaaagaaagaaagaaaatgcaaaataaaatcacaaaaagatattatatgaccaataatggcttaaagagtgacaaaaccaagtatagatgagtatgtgaaacagtaggaatccataagtgctgctggtgagtgtataaattaatacaactattttgcaaaacagcttggtgttttcttacgtaaagtacagaaacaagcaaactagaacacaaacggacacatattatataatctcatttctatgaaatgtccaggatacacaatttcatagaggcagaaagtagattagtagtagccaggggctcgtgtagatggaaatgaagagtgactgctaacactcgagtagagggaaatgaagagtgactgctaacaggtatagattcatttttgggcgataaaaatgttctggaattatataatggttatgattgcatagctttgtgaatatactaaaaacctctaaactgcacacttaagggtaaatgttacatgaaagttatatctcacttttaaaattgtatgagagaaaaactagagtgtttagagttgcatatttagttggtaaagctataaggaaatgattatcataatattgactttagatggggtaaagggaggggttttgatcaggagggattatgtggagggattttggaagatggcattgttaaacctagatggtgtttacacaggtgcttgctatataattatattcctttataactagttaaactgtataaatgaagcagctgattcaaggtcaactgactgctcccagttttgtttataacttgtttctctgggatgaatcatcactta

SEQ ID NO: 725 - DNA, 1054 bp, Homo sapiens
gtatagtgcttctctgaattctattagttgttctagtaaattattgaatgtgggagggctgtgagtactccctgaacttgcagctagtcagccagatatgctggtggtcttggcccctccccctgccatccccacaaagacttatgactggtgttggaagtgcggcagtcttgttgaggactttgctcttaaactgtggggtctatgctaactctatatggatggcatcagagtttaattgcagtatacccaacttgaggtagtgtcagaatagcatcttctgaaaagtctgcagagcctggccagttggaaagaatgcttgtttattatattgttgcttgcagttggtgggaattcatcattacttccccttgcattacagatgccttttgccaaagatttccatcacatatatagtggtctgttttttgctattaccctggcaacaactccataacttggaaaccatttcttttctccaacgttggccatatttggtaatgtagaatgttgaattgtgaatcagctctaaaaatcctaataaataaatgaaccttaaaaattgattacttaataagtacagtatttaccttatttatataagagcaaagacttatcatatgatgcctttcattctggtaggtgtcaccaagaattcaatataagactcagaaaaagtctttgacttagaaggtgttgtaaactaagcacattctgatttcattatcatggccttatggaagccctcatcacttttcatttggcttatcgaagataccccctaactccttttccctctctattctgtccattctaaattttagagtaagacacttttttttttttttttgtctgagacaagatcttactctgttacccaggctggagtgcagtgacatgatcgcagctcactgcagcctctaccttccagggctcaagcagtcctcccacctcagcctcccaaatagctgggactacaggtgtgcaccaccaccctcagctaattttttttagtttttgtagagatggagtctcactattttgcttaggctgg

SEQ ID NO: 726 - DNA, 1033 bp, Homo sapiens
cgacagagcaagactccatctgaaacaaaacaaaacaaaaaaagaacaggaagagactaaagccagagaacctccactgggtggctatgtaaagcctctctgaaggatgagaagcagctgccatgttaggtgcgaggacccaggtgtgtgtagaccattccaggcagagggaacagcctgttccattgataccatgggtctgtttcattgcctgggtttaggagtaggaccaactaggaggcttcagggcctggttttttaccactgagacccaaacaggtctatgctaagtggcatgacatttgagtcatgtgcatggaacatggatctctgggctgtcctcttatacaacatagtaagaaaagctgctggttattggtgggatggggagaagtgtttcaaccctgccaaacagagtatcaggaatcgtttgtttctgtgttactggctggcgctttggaggatcacattggtttgcaatgtcaaacaaaagacagattgaattgaacactaaggatagacccattggtcctacaatttcacttcaaactatcacacattcctaaacagaaggaatgtgccaagctagaccaaataccaagattcaaaaagatcactctctctggttcctttggttctcactataatgtgtatttttttactacagccatagccacagagctgacaggtaatagcgggtataatggggagaggggctgggaaactgctatgcatggccagacaatatggtttgtgatgttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcct

SEQ ID NO: 727 - DNA, 1047 bp, Homo sapiens
tacatttgcctaaacacacactggaaatcagaaatcaccacctggtagcaaaagaaataaggcagagtcttagatagacagcttagataggcagctaagaactcgttcacagatgtgtatctgtcattttgacatgactgtgtagttaggtccctaagaggtttggagccagacctccattctcctctgctggggatccaggccaggctcatgttcctatccacagtccccccattccaactcaccatctgtgaccagacaggttcactaagcagctctccaagcacctgcctaactcccttgggtcctaaggttaagtaagaggatcctgagttaaatgaaactctctctcacttaacaaacttcccggtttagaaaccagcagtgcccatacactaagtttacacagttgggaggtccagtggaagaacagaggaatggaaacccatttgcctggggaaatgaaagacttcccagaggagacacaatatttgaactgagattagaaggagaattaggagtttgtcaggcaggcttggcagggtgaaaaagccacacactgggaagagcataaacagacaggcatgaaacagcatagtaaaggaggaagatagcaaacacctgtgtgtccgtacagcaaaagagcttgccctggagggagttgggggagatgggcaagaccaggtgaaagagggccttgaatataaagctaaggcatcttgagttgactttacttgaaggtgatctattaatgtcttcagttatcaggtttcccaaatggcagtttaaggaaaccaggatcagagggagcccattattttgctatttccaggtccttcaggcttagctccaactgagctggaactagaagggaagtgtttctttcttgcttttcttcccaggccaccgcacaaatggaagagcgactagcagagtttatttcctccaacactccagacagcgtgctgcccttggcagatggagccctgagctttattcatcatcaggtgattgagatggcccgagactgcctggataaatctcgga

SEQ ID NO: 728 - DNA, 1052 bp, Homo sapiens
ggtaaaggcaggggtcagggtgtggccaggactgaagccgggtcagcctttgatctcttccatgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgagctctggggaagcattgagccgtgtcatcaggacatggtctatcaagaagtttaagagttctatggaccagggggtcccagacccttctcactgatatgcatgcccttgcccccttgttctgtgcattaattaaggtgtgagagaaggcagtttgggtggcagagagcacagctcaggtgctgagggtccatgggggatgggccggactttgtttcccagggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaaggtactgaggcaaaggtggcctggcatggaggccaaggcacagtctgagacttagccttaaacagggaccagcagctttgtacagaggtgaagtttcagggcccagctttccagtccacctttggcattggtttctgcctcaggatcacagagaccatttggccacagtgggcacaaagctccctgcctctaccatgagaggcattctgggataggatgtagcaggccagcagctatagaatcttgcaccccaaagcctgcacgctctctactgctggtatcagacagcaacagaggaggcagcagagctacaaaagcccaggattaggtgctaggaggtttgcatctggaccctcagaagaaaggaaagccattaattaccctgactgg

SEQ ID NO: 729 - DNA, 1086 bp, Homo sapiens
agcgatcctcccacctcagtcccctagagtgttgggattacaggcttaagccactgtgcctggtcctttgggccttttaaagagactttattggttgtccacgattgaaacatggacaaccatatcaaaatgttattggacaaaaagggtctgatcaaaacccagcaaagcctgtctgtttagattcttattggcctctctctgcggcattccttcctccagggtatgagtcaggaccttctctggaatgagggtcttatgacccacaatcagattagagttctactctgggaaggtgagaggagagcaggagaaggtcagaaagagactgtttcctgaagcctatttctgagtgccccagcattataacaaacactgtaacaatggctatggggcttatgagccaaaaactggatgaaaacctgcacacacacacacacacacacacacacacacacacacacacagtaatatcacaactagtaaataagtcgaccatagtaatatgtagagccaaatagcctaccatttattgatttacagtattatacttgtcagatggtatgctatgcatgttaatatgttccttcgatgtctcatgacaaacctttagatagtacctcatattataataaagaaatgaaggtttaaagaaatcaattttaatttcatatggctcattaatggcaaaactggaactcaaatctaggtccatttaattccagtgtctaattttctcaatgtacaaatatatatatatatttttttgagacggagtcttgctctgttgcccaagctggagtgcagtggtgtgatctcggctcactacaacctctgcctcggttcaagtgattctcctgcctcagcctcctgagtagctgggcttacaggcgtgcgccacaacgcctggccaatttttgtatttttattagagacggggtttcaccatgttggccaggctggtctcaaattcctgatctcaggtgatcttcccacctcgacctcccaaagtgccgggattacaggagtgagctaccacacctggcctcaatgtacaaatattaatgcatggtcttactctggttt

SEQ ID NO: 730 - DNA, 1044 bp, Homo sapiens
cagtcattgcagcagcctcaccagcagtcaatatagcctgacaggcgggagcccaggccgctcaaggcgaggcagctgggacagcctgccagacaccagcaccaccgaccggctggacagtgtctctattggcagcttcctggacacagtggcccccagcgagctggatgaacagggcccacctggggctccacgttccgagatggactgggcaaaagttatagctggtggagagagggccaggactgaggtggatgtggcagccaccaggctagggagcttgagagctgtgtggaagcccccaggggagaggcttcaaggtggaccacctgagtcaccagaggatgagagtgccaagctgggcttcgaggcccactggttctgggagcagtgccaggatgatgtgaccttcttgtaacaactattccacccttttgtaatcctgtggctcttttatccattagatgtggtctcccccaaaattgattctccctcagtctgagactaggaagaggctgcactgaaatcagttaccatggaaacctggctcatcatttctctagtccctagggagtctctgcctttatccctcaattattgggtccctagagctagcttgctctttctttctttctttctttttttgagacagggtcttatgctgttacccaagatagagagcagtggcatgatcacagctcactgcagccttgacctcctgggctcaagcgatcctcctatttcagcctcccccatagttaggaccacaggcatgcaccaccatgcccagctaattgtttatttatttattttttttttgtagagatagggtttccctgtgttgcccaggctggtctcaaactcctgggctcaagggatcctcccgcctcagcctcccaaagtgctgggattatgcccagcccctagagatacttctatagagatattgactctaaaggattgacctatggcttttggtatttagtatctctcactactccccccagctaagtaaggatttaaggaatttaggactccctggag

SEQ ID NO: 731 - DNA, 1028 bp, Homo sapiens
atcctcctgtcttggcctcccagagtgctgggattacagacgtgagtcactgcagccggttgggagcattgagctctgggggtgggttgagggttaaaaggcagagggaaaagagctcattaggggactgaagatgagatcccagaaaggtggagagtagtgtcatggaaatcaaaggcagaaaatatttgaggagtggtcagcttcgtcaagtaagatacatgtccattggaattagggtcatgtaggccattcgtgatcttggccagagtggaaggggcagaagacaggaagagtgggaggaaagaaggggagctatataacttactagaagtttgcctgtggagaggagagataagcaatcaaatgaatatttgtttttaagataggagataattaagtccattttaaatgctggtaagagctagtagagagggagaggttgagatacaagagtgatcagtcataacagagtgattctctgcagaaatgggaagctttagccttggtggggaggagggatgctgtctctcatctatcagaaggaaagattggtatgaattatcagtaactaaatgaacagagaataagagcatgctccctcccctgccccctgctatagagactggtgagtcaccaaaccagatccctgaaggttggccattccttttttttttttttttttttttttgagacatagtcttgctctgtgacccaggctggagtgcagtggcgcgatctcggctcactgcagcctctgcctcccaggttcaagtgattcttgtgcctcagcctcccaagtagctggaattataggtgcccgcccccacacccagctcagttttttgtacttttagcagagacggggtttcaccatgttggcaaggcagatctcgaacacctgacctcaggtgacctgcccgccttggcctcccaaagtgctgggattacaggcgtgcactgtgcccagcaggccattccattttgcaggctgagccctcagacatttttggccaggggtctccaca

SEQ ID NO: 732 - DNA, 1034 bp, Homo sapiens
ttgcttgaacctgggaggcagaggttgcagtgagccgagattgtgccactgcactccagcctgggcaacaaagtgagactccatctcaaaaaaaaaaaaaagctgaatgggataatggtcatatagagatgcccaaactgagtttggaggcattctcagagagagagggtcatatgggagctcgggaaaggttatgtgaaggacaagtatttgagctgggcttgctggagctcctaaacatagattcaggtgacggaatgattattggtttgtaggtcctctgggctctcgagcattgggcctgaaaagggctggggtccgccgggccctccatgaccccctggaaaaagatgccttggttctgtatgagcctcccccgctgagcgctcatgaccagctgaagcttgacaagtatgtgcactggtatttcataagcagttttggttctctgtatatgcacgcatacttgggagggcagagggtattttggtgtgatttctttttaggattgacatatgttttcagagagtagatgattggggaaggagactgcctggggaagagcctgtggtcatgtccagtgagtgggcattcctcatcccctcctgccttcccaggatgctcactcaggaggaggagtgattgaggtgatgacacagggaacccatccctctctgagctaactttctaactcctaaagtaggaacttgctatggttttacgatttatcagccaagaaggtcttcttttaggcagctgcctctgttgcctccggatcagcaggacacagcttcctgagggtgctcccttgcccatgtctgagcacgctgttttctttgctgtgttttctcagggagaaactccctgtccatgtggttgttgaccctattctcagtaaggttttgcggcctcatcagagagaggtaaatgagggtgaggggaacgaggtatgggctatgggctgagcctgggagactaccatccctgggacagcagcagcgtaggtgccaaagtggactgaaggctgttattct

SEQ ID NO: 733 - DNA, 1193 bp, Homo sapiens
tcattcaactaatattcactgagctttgtcctatacactgaaattatacaggcgaatctgacatagtctctgccttaagaaatcctagtctctgcctagttgagaagataaagtacagtagagtgtgattagtactctagtatatatattatggatgagggcagagtggtacagtgtccagactcagagtcatacagacctgagttcaaatcccagctctgctactttctaccggcatgattttggataactgtttacctctctgaatcttagtttcttcatctctaaaatggataatacaatttccattcgtgtggattacagaacagaatacaggtaaagtgtttagttagtaccatgcctaccacattaaacgggttcactaaatagtagcagccattacgtatatagtgccacaggagcacagagttgagagagacaagcagcctggagtcactgaggaaggctttgcataggaggtgacatctgaggaacttgcctgtggaaaagagctctaggcagaggggtggcatgggcaaagagacataaggaaagccagcattaggagtgacaaggtcaggattcctggaccgtgacaagcttggagagtgtcagagaagttcactggggcctcattgagaagggctttgaatgctaagctagtgagcttaaagagcttggacttgatgctatagatggaagagtcagtgaagggtctgcatttaattgcgttgtcaaagcctgacccaagggagcaagactgattgctgattcttggttgagtggttgagttttgtgtgccttccccagtatggggctggatgtagaaaaggtatgggcctaatcttgcccatgtagttcttggagaaagagggaaggttgtcctttatgattttcttgaaaaaggcttaaaagaagtagtagaggtgtggagagaatgggaggacaggacagggagaatagagattggggaagagatgtgaagggaagcagagggaagctctttagctctactagctgtgaggattctggtgggacatggagcctggtccaagtccctttaacactgatggcccagacaaggcctggagtctaatacagaaggcgtctggctcagaaggttctgagttgggtaggctgatgtggaggggaggactccctgaaagcatgggtttgtcatatgtccacatgat

SEQ ID NO: 734 - DNA, 1027 bp, Homo sapiens
gcatgttatgagtacactacaatttattctactggtttggttttgtttgttgagacagagtctctgttgcccaggctggagtacagcgttgcagtcatagctcactgtaccctcaacttcctgggctcaagcaatcctcccactttggcctcctgagtagctgggactacaggcatatgccaccactattggctaacttttaaattttttatagagatggggtctcatatgttgctcaggctggtcttgaattcctgggttcaaatgattctcttgtatcagcctcccaaactgctggaattatgggcatgagcccctatgcctggcttccatctttttctgtttggatatctggttcaccctacatcatatattgaaaaaaccgttctttcccccattgctttgcagtgctaccttcttcataaatcaaatgttcatatatgtgttgctctatttatggactctattctgttcctctggtccgtttgtctccttgtgtcagtacttctctgctttatttactgtggcctaataagtcttgatatccattagtgtgaatattccaactatagtcttttttttttttttttgacacagggtctcgctttgtcacccaggctggaatgcagtggtgagatcatggctcactgcagccttaacttccgggctctagtgatcctcctgcctcagcctcctgagtagctgggacaacaggcacacaccatcatgcctggctaatttttgtattttgggtagaggtggggttttgccatgttgcccaggctggtcttgaactcttgagctcaagcaatctgctcagcctccaactatattcttactccttaacattgtcctagatattcttggccctttgcattcccatgtaaattttagaatcaacttgtcaatttatacacctactgcctgccatacccaccaaaaaactctaactggattttaattgggctgtattgaaacagataaattctgaaagatctttcatttttataatacggaaccttccaat

SEQ ID NO: 735 - DNA, 1045 bp, Homo sapiens
ctgaacctaaatgttccctataagaaggttctctgcatggacaattctccattcacttccttctttccctaacactggccaccctctatgcgggggtggggatcagagaaaagtctatgaggggagcctggcacagtacatttattttgccccaccaccaccattttgtccacctctgaaaggtaagagcaacttttgggtgaagcactctaaaagagcgatttctcatgtttagtagaggaggaattgaggttggggcttttagaaggaaaatcatgcaggttctatatccattttatagctgaggacacaaggccaagaaaggaacagtggtttgctcactcagattatggcagaaccatagtgaagacccaggaaatgtccaggttctgaataaggaacttaccttgcagagtcagattctgtagcaaaaagagcacctcgctctgacagtcagcgagattcatgtcatggaagctcagtcttttcagggctaggttgtactctggataggaggcagagaccatggaccatggaccttagctttcctagagaacagtgctaggtccccacctactcctctcccttcaccattctggctgggtcctacctttgagtgtttgcaaaacaagcccaaaatcctggggagaggcaaaggtggcactatccagggacagctgctgcagagaacccgaggccttcagaacggagcacagcagtggggctggctgggctccccgtggaaatcccatctccaactgctccaggcagttttctggatatggtggggaaagaagattccagctggccatctctacctcactcccatagcaggtcccatcctgttcttaagggattcatctaaaaaattatttattcattcacttgtcgttgagtgcctaccatatgtcagcactgtgctagattctaggaattgagcactaaatatgagatttagtccttgcccttgtagaaattttagaccaggaagacaggctacccagacacaagcaaataaagtatgcagagtggtgggataggagac

SEQ ID NO: 736 - DNA, 1473 bp, Homo sapiens
ggtgctcattcagactaaagccaaggctgtgggggcctgaggttccccaagactaaaacatttctttgatccttaccctgcctccatgcattcctccatactggagtgactctcagttcctatttgaggttcttagaaggaactaggcctctgctgtcctcaagcaaaagtgtcattcctgttgccttagctatttccccagactccacttactgtggtaatagttaggaatgacttcctgcttgaaataactgcatagcagcaacacagaaaggccttgctcatcagcagcaggacattaagagcaggaaaaacaatacctggcaaccaaatctctgctcaactttgagtgaaggcaaagaaggtatccttcggtcctacctcacactagcacttttcctacagatttgctggcccacacccagtcttgaaaaacacttgcaggtaaccttagcaaggcttcagctttataagtgagtgagtcagatggttattacaatatctgtgcctaaaatatggacaaagatggtgagtcaagatattgtggctgtttctggctataagaggcacaggggaaatataggttagataggtaaatactggactttttcagacatgttaatggttgatgaagacaatgggagacagaatatttggaacaccccagacacaactgcagtgagcagcatgacacagtgatcaggaacatgcactccagaagcagactgcttcaacctgaatctgggtctgccattcactaactgtaatttaggcaagtcatttcacctctttctgccttagtttcatcatctataaagtggaagatcactatactgacatcacagcatttttgtgacagttaaatgagtaaagttatgacagctctcagtggcttctttctcacaaattaacgtacgagcagacaagagatcatgaagttttattccatcaccactcttaagaatctatgggccgggcgcggtggctcacacctgtaatcccagcactttgggaggccgaggcgggggggatcacaaggtcaggagatcgaggccatcctggctaacacggtgaaaccctgtctctactaaaatacaaaaaattcgccgggcgaggtggcgggtgcctgtagtcctggctactcaggaggctgaggcaggagaatggcgtgaacccgggaggcggagcttgcagtgagctgagatcgcgccactgcactccagcctgggcgatagagcaagactccgtctccaaaaaaaaaaggagtctatgctaaaattcgaagctgagagatgcttgagatctagtccagaccactcattttatggactcgtatgctatcacgatgcaaagtgatttagtactttgttttctgtgagggtaagggaaatgaggcatgatcaatgaggtgaagtgatgtttgcccaacaacacaatccttggcccatcctcagtgggctggtaggggaagag

SEQ ID NO: 737 - DNA, 1024 bp, Homo sapiens
ttacctgttaacagatgtgtctaatgaggggaggaagcttggtaaaatagagaaactaagattcacaagatatgggttgttgttctggctttgctattaattgtggtgtgcctgtgtctcacttttatcagtataataaagatcatatacttggctttgtgtttcataggacactgaggaatgaggaagaaaaataggtgtgaaggtactttttgaaaagcacgaagttctagcaggtatcaggggtaatatttaccggaagaacattatggtgccttgctcataatcattgactgagaaagagacagaaagatactcacctttcttgagggcagtttcctcaatcctctccaagtaatatatattgagcagaggtaggatgctttgaagtattgggcctgggagggctacaaaaatcaaaacaaaagtttacttttcctcccctccccctcccacccaagaggtttccaagcattatttattctactggaaaggaaaatggaagggtagacttctcatttgacaaatggaacctctagaagctaatctagatctgttccaaactctagtccacttatcttcagccactcagttggaagctggaatttcaggggcaagggtgagatcatcccacaaaacaagctgacatgctaaatgagcttgacatgcttatttaggagctggtcagttcacttctgcccaagcaaaatgaaccatttggcattgaaaaggacctactgaatatgtgtgataaaaggtctttcataatctgccctgctagtatcagctccctgctttgcctcctacatttcagccacacttaactactttttcatttacctaacatattatgccgctttctgcccctgtacctttgtcatgctgttctttccaataggaatgtcctttgtcatgctgttctaataggaatgtcgttgccactttcagtatatcaactactcatctttcaagtatcacatgccctttattaagtctttcctgaattccttttccatttttccag

SEQ ID NO: 738 - DNA, 1032 bp, Homo sapiens
cctcccactgtgtggtcattctaaaaatatttacatatatttgtcagccaagcactggtttaggatctgggagtaagatagacatggttcattccttcactgagtttatgagccagcataggaaacagaagtagaacaagtgctaaactttggtaagtctctcaggtatacctttctcagggtaatattaactgaaccccccgccccgcctcccatttattttcctcctagcatttcccattatcacaggttaccttatttatgtgttcattttaactcattaccctgtaagtttcttaagtggcaggcatgttttgttacagttataactcactcagcacttagaacactacctggcatataggagatgtcctgttgaattaatatgtaatgttaatgtcactgatggggaggtacaagtttttgtggaaagataggagggacagatttgtgtgtggataggggcttgtttagagaaggcttgcaggaaatgacagttatcagatctaaattctaaaggaagaataaaagatgaaaaaagtggggagttcactaggactcaagtgctgcttgcctatgtgagaaggggagtggtgagaagaggggcagtactgtttcaggtcttgaaggaccttgtaagccatgacattaaagctgccaattgattacctccttttctttcccccatctaggtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctgcaaacctgcccgtcttttttttttaattgagaatttttttttttaatttgatattttcttttagttttgagggggtggggagcggcaaggaggacagggtcttactttgttggctaggc

SEQ ID NO: 739 - DNA, 1066 bp, Homo sapiens
cacctaacctggagctcagccaggcttctcttgccgtgtgcccaagcccttctgttggacctagacccttcttttccaggtcttgtcagccagcttgcacagtttgagtcagcatccagccttatgataggcattggttgattcagagagatatcacattcggtcatagccttctggaagtccagagggagagaagaaaaggtggggtcatgggcttaatgaatccaatgcaagagagcccagcctgtgtgctggacaattcttatctgactgaatgctgtgggaatccattagaagggagatgagtaagggtagggttacttggaggaggaggaacttgaactaggaggaggaagaagggcaaagaagaagtaattgagagttgttcttctaaggcatgcttaactatcagcacctcaccttcatcccagctcctcatcaagcgacaactcttgatccgaggaaaacgggatcacagaatttgtataagaagggaaattagtgtttacttagtctagccctcatattttatggagggagaaattgagttctgtggagattaaataaataatacaagaattggaggtagagccagaactggaacccatctttctttttctcagttcatatccttctgcaaattcctctagagcagagaatacaatttttacttctttgagtgccctcaaaaatggagacattggccggggggcggtgactcacgcctgtaatcccagcacaagctaggaggctgaggcaggtggaatacttgagtccaggagttcgagactagcctgggcaacatagacctcatcttcattaaaataaaaaaaaaggagacatttatttatgggattactaagctggttcatagtagtgaccactattagataaggtggacacttgcatctcgcattctttaccattcccaccctaccttgttgttctttgactcagaggccaggtatcaagtgtcatttatcatcaagcttgcaatatttttctcatagtagcactaagagcaaagtgagatatttcttgaactcatgtctaccaataaagagaa

SEQ ID NO: 740 - DNA, 1051 bp, Homo sapiens
agttgagactacaggcatgtgcaccatgcctggctaattttttaactttttgtagagatgaggtctcactatgttgtccaagctggtctcgaattcctgagctcaagtgatcctcctgcctcagccccccaaagcattaggattacaggtgtgagccaccgtgcccagccgtgttaagcactttagatgcaaagaagaatgctacttcaaggctgggcgcggtggctcacgcctgtattcccagcactttgggaggccaaggcgggcggatcacgaggtcaggagatggagaccatcctggctaacacggtgaaaccccgtctctactaaaaatacaaaaaattagccgggtgagatggcgggcgcctggaatcccagctactcgggaggctgaggcaggagaatggcgtaaaccctgtggggcagagcctgcagtgagccgagatcgcgccactgcactccagcctgggagacagcgagattccgtctcaaaaaaaaaaaagaagaagaagaagaagaatactacttcagggctctacatactcttggtaactccatccttctcccgctccacttgtccatcagctggagaagggacaggacctcagagctctgcatgttcatggaagacactaacccccccatgtcacaactttcttttttatgtgagctcaagtttatttcaaataatacaatgtttatttgaacatgtttctatcttcccttataatacaatattatacaaattgatattaatacaaataatatttgttagacacttgcccagggctgagattcagtgggagcactatcctggcacgactggttatttatgactgacatccatgccagtgcctgatgtgaagatgcatgtgccatatctgatgttgagtggtttgactaccctccctaaatgtttcctaagtgtagtgcaacagtacaacttccttttctttcttctgtgactgagtgagatcaacatatttttttatttttgagacagggtttcactcccatcgcccaggctggagtgcaatggcacaatctcggc

SEQ ID NO: 741 - DNA, 1050 bp, Homo sapiens
caagcaagttaataaattagatggccacctttaaatgaaaggatagaatagaaaacacgtgcatcacacatagtaaaggtaagtattatattatgaagcatttgctttagagagcatgtgtgtgtgtgtgtgtgtgtgtgtgtgtgtgtatagaaacacacttactaggttttttttttgagatggagtcttactctgtcacccaggctggagtgcagtggcacgatcttggcttgctgcaacctccacctcacagattccagcaattcttctgcctcagcctcccgagtagctgggattacaggtgcacaccaccatgcctggctaatttttgtatttttagtagagaaggggtttcaccatgttggctatactgatctcaaactcctgatctcaggtgatccacccacctcagcctcccaaagtgttcgggttacaggtgcgagccactgcaccggccttttttttttcaagacaaagttttgctctgttgcccaggctggagtgtagtggcgtgatctcagctcactgcaacttctgcctcccaggttcaagcaattctcatgcctcagcctccagagtagctgggattacaggtgtgtgccaccacacccgagtaatttttgtatttttagtagagacggggtttcaccatgttggccaggctggtctcaaactcctgactttaagtgatccacccgccttggcctcctgaagtgttgagattacaggcgtgagccaccatgcccaaccagagttctttaaataataatagacttaccttaggatttgatttgcctacaacctaccaagaatatattctctgtgaaatatgacataaatgtgggataatgacccaagagtgcttctcaagacgagagacgtgcttttctgcatgtctgattttcaaaaactggtttgccacccaggagatgttttctcccacatcaacttggatagaagagcttatggcagacaagctgactcaacactcagactgatgtcaccagatcaaagtgaaaaatatgtagctctcatgatccaaataaa

SEQ ID NO: 742 - DNA, 1044 bp, Homo sapiens
gtcaggggcatcctgggggatgggtcttctatcacttggtaagatctgcacccctaaattttcctgctagttttccccctgagattttgctttattttttgcgctggtaccttagtgaccctagtgcctcaggatatgtgtaggtgaaacagaagaagtaggctacttttctgttctttctaaagagagctccaaattattctcttgtctttcaggaaaaaaaaaaaaagtttatttatccataaattgtctgtcattggttttctaatcaatggtgtgtgaaatgtcttatttctttatttcaccttggctctgatgcattggaaatgaggacttgatccctgggctggcacttagaacttaaacaatagggtccaagtggagctcctcttctgagagagctgaatgattagctgcattatttaaggctcattttagacatctcccagccgcttgtcaccaattttattcctcaggattgattttagacttcagacataatattcgatgatatatactatagttaagtttagcaaatatggactgaggacattttaaatactgagactttttttatgactacaatttattgtgggccctgtcttcggtgagctaatggtctaatacaggagacaggagacagacctccaaattgcagtgtagcataatgagggcaatgatagagatatgtgctggctaacacaaagacatagaagacaggtacctaccctggcatgggagctcaaggagacttccttgacatttacgctgactgcaggataagtaggagttagccaggtggaaactgtcatctctatcttgctagactttaagcatatactgctgttaataaagcccaggttatgctgtttgcaaagataaaatgtgttcctgacataatctggtcaaagggacagaaagacagaaatgctaaggacaattcagcagcatgaccagataaaaaacaccatatttcatatgcaaaagtcaactcaattgaaacatttgtaaaaccaaatttgacattataaaagtatatcagag

SEQ ID NO: 743 - DNA, 1050 bp, Homo sapiens
cattacctaatggccaaagcctgcattcaaaataagtaatcagaaaaacatataaaaacacaataagataaacagactaaatatatgcagtcattttatggaaccaatctgactagattggatgcagactaggtaggatgcaaatttaaaaaaaactttattcttcttccacttataaactttaaacctgctttgtggagcaagttctttttatctctggggaaagatcctgagtaagtctcatagagttctcattcatttaaatcacaagaacaatcttaggtcagtaattaaactatctggcccagtgtaatactgaaactttcaaatacttatccacttgagctcttctttccatcccagcttggtacttctttggtcctagaagccagcagtggtttatcatcgacttattcttactgactagctccccaatacccagtagctgctgtttctgggccctccaggaatggttttaggaggaaaggggataaggagtaaagggctggtactattgtgatcatgccaaagggcttggtggatattccatgcttccctttctctcaagaggaaactccctttcttggagactctctcactagaactttccagaggtgattcaggggacaagagaataattgtccttaggcagactctttttcaagctggtcccagagctttccctcttgccagttaattggtttaaggacacagttgcacatccttgccttgcctctgctgctgtcctctgcctttctgtctgttctgagttatagcctttcacatcagtcctgtactccccaaactccaaggagcacaagtcagatcatctaagtgatcctcttgaagcctcttgtttaagatgggggaagcacccttccttttccatggcactctggcattccaacaacactttaaataattttttctctcaaaattcttaagcctctcctctttaatccttcgccatttttatgtattattactttatatgatgagctaagagttacaaaactggtttttagaaatctccttagcaaatgttttact

SEQ ID NO: 744 - DNA, 1029 bp, Homo sapiens
atgctgtttctgaatcataatatgcctttaaaatatctgtacctaaattaataatacccatactactacactggttaaaaaataatctacacattcagggctgggcgcagtagctcacgcctgtaatcccagcagtttgggaggcccaggcgggtggatcacgaggtcaggagattgagaccatcctggctaacaaggtgaaaccccatctctactaaaaatacaaaaattagccgggcgtggtggcaggcgcctgtagtcccagctacttgggaggctgaggcaggagaatggcatgaaccggggaggcggagcttgcagtgagccaagatcacgccactgcagtgcagcctgggtgacatagcgagattccatctcaaaaaaataaaataaataaataaataaatacataaatgaaataatctacacattctgcaattattctttattctgttcagtaatggcaaataatattttaaacttgttaattatcagttacaagattccatgatgagatatgttctgtaatgtattatattattaagatttcaacaattatttgaccttaaactgttatcttctttaatgaaaagtattctcttgagtctagttgccataaactttattaagctgtcaatcaactaattccaaatagtttataatttagcaattgctattccctagctggctagacagacactggaatatctattttttttttttttttgagacgaagtgtcacgctgtcggccaggctggtgtgcagtggggcaatcttggctcgctgcagcctccatcttctggattcaagcgattctctgcctcagcctcccgagtagcttggactacaggtgcgcgccaccatgcccggctaatttttgtatttttagtagagacggggtttcactatgttggccaggctggtctcgaactcctgacctcgtgatccacccaccttggcctcccaaagtgctgggattacaggtgtgagccactgtgcccggcctggaatatctattgttagtgaag

SEQ ID NO: 745 - DNA, 1122 bp, Homo sapiens
tgggaaggaaagattggagggaggttttgggattgattttgcacatttatttgtactgatgtttttcagttttgtttgcttttctccttccttccttccttccctccctccctccctctctccttccctccctccctctctccttccctccctccctctctccttccctccctccctccttcctgttctttctttttcttcttttcttttttttttaccaaatacccagacttggagaatttgttttattttctaattgtttgtaaatctgtatcctctaatactgaatttgtttttgaaaatgagctattttctaaatcagtgtgatacttagagttaagtttccagaatggaattattgtgcaataatttagttataaaatcatgatgggaatactgtgtcattcttgaatttttaaaattaagctttatttatatttgttgttttggcccaaatgaaattatgtcaatgtaacctaaatttatatttgaaaataaccaccattttacatgcattagttggaagaaatatttaaacctctcttttaaagattgtgaacattttgcttacataaacaaattatgactaaagcttataaccatgccaaattgctttctgtagcacccagaaaacttttttttttttttttgagagagggtctcactctgttgcccaggctgaagtacagtggtgtgacctcagctcactgcaacctccgcctcctgggttcaagagattctcctgcctcagcctcccaagtagctgggactacagacacatgccaccatgaatgccatgttggccaggctggtctcgaacttctgacctcaggtgatccacctgcctcagcttcctaaagtactgagattacaggcatgagcctttgcgcctggcctcacccaagaagcattttatcatctgtgtcaacttcctccagggcctgtgtgggtaactcttactttgcctggccatcctacttactgcacttagaaaaagttttggatgataattgactttaagcatatataaatcagaaacttgatttcatttatctttgtgtccccagtgttgaacattgtgcctgacacatagtaactgcttattaagcacttattgaatta

SEQ ID NO: 746 - DNA, 1080 bp, Homo sapiens
cagcctgggcaacagagtgagatttcatctcaaaaaagtaaataaataaaaataaaaagatgtcttttaattgggttatatatcttcttatcgagctgtaagagtttatatatttcaaagataagcccctaatccagatgtatgatttataaacattttctcccatcctgtgggctgtcttttattttcttggtagtggtatttctttaaagtaaaatgttttaaattttgaggagatcttacatcttgtacaatagaacatccagtatgctttctattgcctatggtgcagagattaaaaaggctgataagctagtccaaaactacaaaaataaagatgtaactggtatctatatagtgccacgagttgggagtgggaaagagacggggtagtggtaaatggaaaggaaggtggggagggatagggggtcacagattctcattacttctttgaccagttcaagggcataattgagttcaagttaattaaatcagattagtgggatgcccattaagcaaaaagtcacctattttgtaaatggttttcagtgctttttctattgtgtagtcatgacaggaaaaaaatatggaaaaattttccataagattaccacttcttaggtcattttccttgatgaagttaggctctaatcaagaaccaagaggcccatgtagtctgctgtacattatagaaatgggtacagttatttatggtcatcattaaatcccatgctgggctgtggtttgattgcgatattgtttaaaaatgtattatcactaaactgactttaattttagattgagcaaaatatacttatgaaggtaaattttataccaaaatttaaaaaaaattactacttttcaagccaaatgatgatttctctcacacttctattagcacaggttattggagtaacaatgaaggtgattctttgttatctaagcagtgattgatgtttttctaaaaagtcaattaagagaggttacttggcacaataaagttatgaaagtgctccaatgggttattttggagactaagagtagtatgcttatattgtctatgccatagaagtggcattt

SEQ ID NO: 747 - DNA, 1045 bp, Homo sapiens
aaaatggaatcacattgtcttttttttttgagatggaatctttgtcgctcaggttggagtgcaatggcatgatctcagctcactgcaacctctgcctgctgggttcaagcaattctcccgcctcagcctcccaagtagctgggattacagacacacactgtcatgcccagctaatttttgtatttttgtggagacagggtttcgctatgttggccaggctggtcttgaactcctgacctcaggtgatccgcctgccttggcctcccaaagtgctgagattacaagcatgagccaccatgcccagtcttttttttttttttttttttgagacagagtctcactctgtcacccaggctggagtcagtgatgtgatctctgctcacttctgcctcagcctcccaagcagctgggactacaggcatgcaccactatgcccagctaatttttgtatttttagtagagacggggttttagcatatcggccaggctggtctgaaactcctgacctcgtaatccacccgcttcagcttcccaaagtgctgggattacaggtgtgagccatcatgcccggcctttttttctggggggacagagtctcgctctgttgcccaggctggagtgcagtggtgcaatcttggctcactgcaatctctgcttcccgagttcaaatgattctcatgcctcagccccgcaagtagctgggactacaggcatgtaccaccacacctggctaatttttgtatttttagtagagacagggtttcactatgttggccaggctggtcttgaatttgacctcgggtgattagcccacctcagcctcccaaagtgctgggattacaggtgtgagccaccgcgcccagccagaatctctttatatgcaatatatagtatcccatcacctttgtatagtgaaaatattttcctccaggctgttacttattatctgattatacttatgatgcctttctttgttcaaaagtttttattattaatgtggtcaaacataaatcctagctgttttggttcttgtttagtgccaagc

SEQ ID NO: 748 - DNA, 1055 bp, Homo sapiens
gagacggatggaaaccgagccccctggaggacctgcccctgcagttctgcctcacacggctcaagtcaccaccgtgaacaagggtgggtgaatgccttttcttccccctgaatgtctttccttccgcggtattttctgccccgatctatagtcccttgagtctccacacacactcctcacagagatctgtagcgtaggtacgtgacagctctgcctacatctgacgtccggagtcattaaccaggaatgtatgtgtgtctgtgtgtctctctgtggagtcgtcagaattcttcataggggttaagctaaaaaagcgaggcgaggagcccctctccaatggctcagttttgctgaataatcacgtgtgaatcgaggggcgggcttttggcaggcagatcttactagtatttactaccaagctctactccagattaaccatcccagtccttctgtcagtctccgatgccatcatgcagcctggttaggagcaaaggaaaggggaaaaagaaaaacgactaattcatcttttcctgatcgtcaggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttggtattaagagaggtggggaaaacaagtcaataatgttgcctacgtgacccgggtttctagatttacagcttttaagctttcagggacataaaatttcactgtttttaaacctagttggttgccatattttatatctttaagtggatgcaacttctcaaaatgacgtactttgaacaaactcctcaaatccaataacatccttgatatcaagtggggtccagatttggtcttagtttttggaatgtttttgtgacggtggggattttaaagtagtcagtgtagggccgaggtttgtttgttttgttttgtttttaaagacagctctgtaaacacattattatgattattatttgaagtaaatacactgcta

SEQ ID NO: 749 - DNA, 1031 bp, Homo sapiens
ggcatgttaatgaaagtaatattttttcacaactaaattatatgtattttatatttgcatgctgttctacaagatactttataagagaccactgttagagtgaaatatattcaaacaatagtagataatctttgttatgtgaattatttgtatgttgatagcaagtgttaataccacattctgacttttaaaatgttggcagtttacaaatagctgttccttaaatgcttgataataactgaaaaaggaactaacacaggatcaccagttgattattaaatgagctcaaaccacaagacaaggctgtccgtgtcccaaaacacccattaaatatcttattttttcttcttttgctcatttgaaaatcaggaggcttgtcagaactttgagaaacagtatataatgtaatagggtgactatttcattattttcaagaacagttgtcctacaataatttcctactgtgatacaaggcatatcaggaacttagttttatataaattgatatcataagcaatttagaacactgtggcttatttaacaccttaataatcagtactgttttgtaacttaaaatgaaggattctaaacattgaatacacctagtagccaatattaaataacttgcaaataaaaaatatttttaagaaatgcttggaaatttggagctatatctatttggagggaacttgtaaaaattgatcatttaagaaaatatcaggcctggatttttaaaacatcatttttacactcactcatggagttggtttagagaaactcaacatccttatttgtttgcagtagctatttagaaaataaagtttaaccacatatgattttctagaattaataccacaggcacattttatgagcatgaacaatcaaacagaaggagactcttatttaaatcccaaattccatttctgttattttaataaattcgtgaaattacacaactcttcatggaacatagagaacagaattgttagcaaatgctatacatgttgcacaaattctatcttattgatcaa

SEQ ID NO: 750 - DNA, 1084 bp, Homo sapiens
accagctagcatcataatgacaggatcagattcacacataacaatattaaccttaaatgtaaacaggctaaatgccccaattaaaagatacagactggcaagttggataaagagtcaagacctatcagtgtgctgtattcaggagacccatctcacgtgcaaagacacacataggctcaaaataaagggatggaggaatatttacaaagcaaatggaaagcaaaaaaaaaaaaaaaaacgggttgcaatcctagtctctgataaaacagactttaaaccaacaaaaatcaaaaaagacaaagaagggcattacataatggtgaagggatcaatgcaataagaagagctaactatcctaaatatatatgcacccaatacaggagcacccagattcataaagcaagttcttagagacctacaaagagacttagactcccacacaataacagtgggagactttaacaccccactgtcaatattagacagatcaacaagagagaaaattaacaaggatattcaggacttcaactcagctctggaccaggtggacctaatagacatctacagatctctccaccccaaatcaacagaatatacattcttctcagcaccacatggcacttattctaaaattgaccacataattgtaagtaaaaaactcctcagcaaatgcaaaagaacagaaatcataacaaacagtctctcagaccaagtgcaatcaaattagaactcagaattaagaaactcactgaaaactacacaactacatggaaactgaataaacctgctcctgagtttattcaagactactgggtaaataatgaaattaaggcagaaataaataagttctttgaaacaaatgagaacaaagacacaacgtaccagaatctctgggacacagctaaagcagtgtctagagggaaatgtatagcactaaatgcccacaggaggaagcgggaaagatctaaaatcgagaccctaatatcataattaaaagaactagagaagcaagaacaaacaaattcaaaagctagcagaagacaagaaataactaagatcagagcagaactgaaggagatagaga

SEQ ID NO: 751 - DNA, 1022 bp, Homo sapiens
aactctatctctactaaaaatacaaaaattagccaggcatagtggcatgcccctgtaatcccagctacttgggaggctgaggcaggagaatcgcttgaacccaggaggtggaggttgcagtgagctgagattgtgccactgcacttcagcctgagagatagagtgagactctgtctcaaaggaaaaaaaaagaaaagaaaaagaaagaaagatcacaaaaatcatttttcaatacatcagtgttcatttagatgaattaaaatttcagcaggaagagtttttttgctagataagctggcaatgacttttcctttctcatactgtcttattctaggcacagactgaggaattgcgcttggcctaataagaatgattcccctgggggaaagaaacagaagagcatttgacaactacatgggctggcataatggattggaatttaaaggtgctacaaatgtgccaccagtttatcacatgggacattttctcaccgagtgaagcaggaagctggtgggcctaggccaggaaggcagagtgaaatttcatgacgcttagaagacaaagagccttgctaaaattaagtgaatggtcctgcaacaaatacacaacaggtctcccttcttaagaaatccaccagattgtgaaactgcatggggagagaagcacgaaaggattaagtttaaaactccaaagcacagaaaaatgctgaggagacagggactcacgaggctttcaatcagaagcctgaaatggtcacacttgagcatgttgctggctggaaaggcagagtaaaatgtcttgtgatttcatggtgttcaaatctctgaaggacagatgactctccattggtatttcaggctttccctacagtaggcaagtactttggacctaccagtctttcaacaaaaagctcagaagggtcacctctaaggaacaggtataaatcagaggtgaactaagtttcattaaaactatacctcagctccaacctagctcaattccagattggatgtggtgatttt

SEQ ID NO: 752 - DNA, 1065 bp, Homo sapiens
aacaaacaaaaaaccagcagtaagagagtgaaaaggaaggcaacaacgcagagaagagattcaaaatacatacatataacctttgtttgtatcctgagtttatacagaattcctacaaataagataaaagaaaacattttttaaacattaaaatggacaaaagaattgaacaggtcctcctaacagaagatattcaagtgaccaataagtagccacatcattatcatcggggaaatgcaatttacaactacaatgagatatcacaccccaccagaataactagtaatgaaaaaattaagaatcgaagaaaatgtagatcaattagaactcatacattgatggtgaaagtataaattggtacaaccattttagaaaactttttggcagtatctactaagcccagaaatccaattcactgcaaaagaacccactcaaaagaactgaatgcatatatgaattcaaacaacatatcaacatatgcaaagaacatttatagtacttttattgtagcaaacaaatgaaaacaatgcaaatgttagtgaatagtagaatgtacaaactgacaaaatcatacaactagagactacccagcagtaagaaaaaaacacctagtactgcgatgtattaacatggatgaatctcacaaatattatgatgagtgaaagaataatttttttaaatttagaaagagtatgagagaaggcaaaattaatccatggtaatataagttagaataattgttgtctggatgaaggatagttatagataagaaagaggcatgagagaatctggagtgctagaagtgttcaatattttaatctgagtggtagttacagaggtgtttacatatttccattcatagagttttagacttaatgcactttgctgtatgtatatctcatacaacctcagaaaatggtagtatggctactacaaaaccgtctaacaatgtgtcatattcagaataaaattttaaatcataggattttcttgaaaacacttcttgacctggactttgcctttccagaaatatttctgcactctaacaataagctcctgtttact

SEQ ID NO: 753 - DNA, 1051 bp, Homo sapiens
tcgcctgccctcgggcaccgtgtggggatgataccctctgcccttgagttctgggatcagagtatgtgatcacatccccttggccagtgtctggtggttcgcttgtggagtttgggagtgacattttcctgtctttatgtctgaatcgtatgatttcctcatcgcaccgccaactggattatgggttctggataggtggttgccaagcaccacccccccgccccatttatgttttcatgtgtggtcgtcctcttacccacctccctcgtctttttgttaattggatctggcaggttttccctctgcttgggagacggatctccaagtggtgattttaaccctagcgacatcgagttacttgtgtgtgtgtgtatatatatatatatgtgtatatatatatatatatatatgtatataaattttaatccctcctctttttgctccacccatatgacacaccttttaaacgtgctgacttaagaaaacttgattagcttgaactttggaaacctttaaacctggcttgggaaattccttcggttactcgtgttctccctttgtatcaaagactctcctaaatacgttgtactgctttttgtacaataatcagtagtcccagatgtgttgcagaattcgagtgaagacctcttaaactcaaaataggtatgtggatgttataatccacaatagatgtgtgaaaacctttcctgtactttttccattttagatgatattgaatacacccttttccagagggcttcaatagtagtagtgcttaatttcttcctgaagagtttagttttctgactgggtaggctcctttgttgtttcatgtgatgacatcattatctagtgttttcttttctcattcctgtgtaaaccaatgtctcatcacaccagaaaaacctgatcatatatatgctcgttttctgaataaaattcttctgggggcatttcatatataccagtaaggtccagtcttgattgtggtattacagaagcctccatgacttctccctcttacgttctatattccaggcctaccaaatac

SEQ ID NO: 754 - DNA, 1031 bp, Homo sapiens
tttaaaaataatacagaggaaatctgcccagcgaaggcaatcttggaaggacagtgagtgggaggataagccaggaaaggctgaagaagggaggtccatgagagggggaggccaggtaggcagcccagccctgaaaggcatatgtaaaacagcttgaggtacccctgtgtcactgtcaagagctttgttatgtgctaaattgagggaggcactttgttaaaagagtgtaatattcattgaacaacaaaccatgttacattttctaatctgaatatataaaaataaggataggtgtctctcaattttgcagtagttatatagtttgagattcgccagtcttcttccccgacctatactttttgattgatacatttgaaattttaaaatcctgagaaaataagtttgtatagcattgaatgcaagtatagctctgcttttagagtcagattgtcctgtgttcaaattctggctctgccgcttacatgtaaaatatgaaaaaggaaagaatttatcagattgttttggggagcttttttgacaaataagaaaatgtaacattttggatatttcaaattgtgtctgcataaagctttcttcaagatacctttttttttttttttttttggctgggcacagtggctcacacctgtcatcccagcacttaggtggcagaggcaggaggatcacttgaccccaggaattcgagaccagcctgggcaacaaagtgagacccccatctctattaaaataccaaacaaaaacaaaaaacaaacaaaaccaaaaaccctcttttgttgttaaaaggattggtttatcctgtagaatgcactaaaaataacccccttccttataaaaaatctagaatgtactgcttatttttaagcatgcaatgctataatgttttgtgggggatgggcttgttttttttagagatggagtctcactttgcccaggctagtttcgaactcctgggctcaagtgatcctcccaccatgtctcccagtgttgggattacggatgtgagtcactgt

SEQ ID NO: 755 - DNA, 1076 bp, Homo sapiens
aggtttgaccatgttggccaggctggtcttgaactcctgacctcaggtgatctgcctgcctcagcctctcgaagaaaatacttgtaaatcattggtctgctaagggacttgtgtccaggagataacaaaaagataatttgctatcagagagggcaaatcaaaatcacaatgagatatcacatcttatccacttgaatggttataataaaaagattaagtttaagcaatgctgtagagaaactggaacattctatttccctttttaaaatgcacacttcattgatttccagtgtgttcagagttacacaaccatcacttaccaatacagctctcgatgggattgtaagatggtgcaggtgctttggaaaagtttggcagttctacaaaaggttttgcagagttccattcattggtttatatacccaataaaatgaaaacatgtacaaaaacttatacatgtattttcataacactgttattcacagtagctaacaagtagaaacaacccatgtccatcagtgactaaacaaaatggtggtggactattcagtgataaaaaggaatgcaattctgataaatgctgcatcatgggtgaactttgaaaacatgctaagtgaaagtcgagccacaaaagaccacatattagtatgattccatacacaggcataccttgttttattgcacttcacagggttgtgtgtgtgtgtgtgtttacacaacttgaaggtttgtggcagctctgcatgaaacaattcttttggcaccattttcccagcagctcatttcatttctctgctacatttggtaattctcgtgctttcagactctttcattatatcttttacagtgatctgtgatcagttttattagggtggtctggaacgaaacccacacatctgaataatgcttatctatgaaatgcccagaataggcaaatctatagagacaaaaagcaaattagttagtagtagcctagggccggggagtttgggggagtgactgttaatgagtacactttcttttgggggtaatgaaaatgttctaaaattgataagtgatggttgcatagctctgaa

SEQ ID NO: 756 - DNA, 1104 bp, Homo sapiens
ttaggctttatcttttgaaaagaatttgtggacaaattttaaaccaccacaatcacaatttaagggattggcagaggaaaaaagcttgcacaggagagtgaaaagggatgccagagatgtaagagaaaaactagaagaatgtggcagtcatggatggcaaggtggaagtagtaaattggcttgaatactgctgaaaggattaaatagatgagatctaaagcatatccattggattgatgaacatcattgatgttcttaggcagagcagtttccatggagtggtaggtatggaatgcaggttggagtggcttgaagagtaaagaggaggcaggaaatatatgaagcgaatggaggttattcaagatgtttcattgtagaaagggcaaagaggacatggaatgtggaatggaggggaacagtttctaaaataggaatatgcttaaatggtgtagggatgggaagcaaggtcaatgttaaaaatgaggatacagtcaggacgcaaggagtatagtaaagatttaggacaatgacagtgggaactggaaaaaggaatagctaaggaatagctaaatatgatttgtttagtcattacccacaaatgtttaaccctctttcttgatttgtattgcttttggagagagggttagaaactgaattagtaagttacctgggctactcaagatattccttgtaaaaggagtcgttagagaaatcatatgttctttgctgttacacactgtctggaagagacttgtaatgactttgcattttaaaaccactgctagtcaaaacacatttaagtgttatttggcagtctttagcaatgtttagtagatgataaaaaaatctaccatctaattattagattttagatttttgaatagcttaaatgtatatatttctcttgcaaacatgtaaaagtagtctcagattctcctggaaaggtatcagcaccactcccatcaaacatttaaaagcaaatttattcttttctaagtaaaccattcttgaatatatcaaatatgatttttattgagcttatatatggtacttttttttttttgtcggagtctcgctctgtcacccaggttggagtgcagtggc

SEQ ID NO: 757 - DNA, 1032 bp, Homo sapiens
gaggccgaggtgggtggatcacctgaggtcaggagttcgagaccagcctggccaacatggtgaaaccccgtctctatcaaaaacacaaaaattagccgagcatggtggcgggtgcctgtaatcccagctactctggaggctgaggcaggagaatcgcttgaacccaggaggcggaggttgcagtgagccaagattgagacattgcactccagcctgggcgacaaagcgggactccatctcaaaacaaaacaaaaaaaaataattatctgggagtgattcttaaacctccaggtgattcttagccttctaggtggttctctgactctctaaagtatgagaaacattcgtacttaagggaatgaagaaggaatgaaaataatgatgtaatatatgttacattaaaggtatgtgtaaagttctatgattaggttaatttatatagactgtatgacattttcatttaaaatctgtttattttcctatccataagtaatttctttttggaagagaaattggcagaagggatgggtattactgtaaatcttgtccttttatccccagatgattctaaaaacaatttaccagtctgttaatgttttattcattgaatgctttgtttttcttttagtccaaggacaaaatgatgagaggctctcgcagaggatgtgttagactcagagtgagtatttattcatttttatgaaaatcaattttgacagaagaaaattgtattctgatagaattatggaagtctaaatttagtttagcttccttacataattgttggggcaggtatctaagtctcagagagaaaatgtgatttctccaagtaactgttagtcagtatcagaaccaggactagaactcagttattttggcccatgattcaatgttgtatttatgacttaatgcatgttctgattttcttaaacctctactttacagacaagagacaagggctggaaattaagtgagttatggtgttggtggtatatcaacagtagaaaaaatggaaaaatcccaactgttagc

SEQ ID NO: 758 - DNA, 1050 bp, Homo sapiens
aatggaagagaaagctgaaaaacagaaccatttggatttgggtcttggagaaagctggaaatttggtatatgatagagcgttacaaatcagacattatcacttagtaaatgaaactggatcaattgggtgtccatatgaaaaaaagaagattactctttaccccatgtgatacacaaaaacaaatttcagatgtataagaggtataaaatgaaattttaaacttagaaaaaaagcataggtgatatctttatgatgtcaagatagagcagaaagcataaaccacaatggcaaatatttgtggatttgacaacattcaaaatttaaaacctttgaacaaaaaaagataccacagtcaaagggaaaagacaactcatggatagaagagaaaatacttaaaatacatcagttggcaaaggattaatattctgtgtatatataaataactcctgcatattaataaagaagacaaaaagaaaatccccccaaatgcatacaaatctgtaaaaaagacaaaagaattctcaaaatgtagaaaagttacatactttcaattcatgtaagggggaataagaaggtaaaatattgaatgcaaaagcaaagcaaattgtttaccactctcttactggcatctaggccagtgcctagaaattcaataaatacttgttgaatcaatgaatgaatgatgctaaagtaggtcctccatgcagcgtcttctttagtgagcaggttgaactgcaagccattctgctcccttctatattattgattctgtcactcctctctagactgtatgttcctccagggcatagacatgttttgtatcccttggctgttactgttcttggcccagaataggtatttaataagtttgttgaagtaattagtgaatattgtttactgtcaccatgtcctgttaagaacaggctttggatcagggtttgcaagacctagtattcttctcccttttagttgttggacttttggcaaacttaaaaaaaattttttttaaacctgagtctcagtttcttaatctctaaagaagagtagtg

SEQ ID NO: 759 - DNA, 1444 bp, Homo sapiens
tttgcaccaagtcttcaaagtcatggatgttctttaagccacccagtctatggtattttgttatggcagcccaagcagattaatacaagtggtaagatgagcaaagtcctcaccaagattgtactctagggtagacggccaataaagagataaataaacaaatggtttatttcaatggtttttgttatatttacaaaattgtacagccatcaccataatctaattttagcatacttctatcaccgcaaaaagaaaccctatacctattaagcaaatattttctatatagattttctatatagatggtccctgacttaataatggttttacttaggattctttgacttcatgatggcagaaaagtaatatgcgttcaatagaaactgtactttgaattttgagttttggttttttcccaggctactggtaatgctatatgatcttctctcactatactgggcagtggcagcaagccacagctgccagttcgccacgcgatcacaagggtagccagctgaaactctgcactgtgtactgtgttgcgagatggtttttgcccaactgtaggctaatgtaagtgttctacaacacgtttaaggtaggttaggataagctatgctgtttggtaggttagatgaattaaatgcatctttgacttaacaatattttcaacttaagatgggtttattgggaggtaaactccattgtaagttgaggagcgtcagtgcctccctttctcttccaacagcctcctactcttcaccccatccagcccttggcaactattaatctactttctctctctagatttgtctattcttgactcttcatgtaagttgaatcttacaatatgtggtcttttgtgactagcttctttcacttaacatcatgttttcaaaggttcatccatgtagagatcacttttgcctggaattttgaatgtgactacagttctacaggatatttccacgatgaacttagttaaatccctatatagaaaaataattgccatgctgttggtgttgattgttgtgtagccagagttagaattgtgtttggctaagaatgtacacatggaattaaaatcttagtggaggcagataaatcatgttctaacattattacttacctagtaaataagctttcttgtaggagaaatacacaaggagttacttacatgtaagaatgaagttaatatttttaacatttttccttaaggaccagagtaatgcggagaagcacgcagatggaatgatagtaagtttaatgtaatctttttgtttccctttacttctgcagagcattataaccagtcatatcaggagaagcctgaattactactcatttttcaatgccaactactcactgctttttgttgttgactcttgcagtttcctttaagctcccttctttcagcaatcatttgcaggggaaatgacaatct

SEQ ID NO: 760 - DNA, 1583 bp, Homo sapiens
tatgtgcaatacattgtattacgtgggtttcattaatgtcaaaacagattagggctgagtagtattatttttgcttctcaagttctgcacatttatttttaaagcaagttgtagaatgtaatgtgacatatttgagcctgaagttggctgaccaaggactgtggataagtgtagcatagttattttttctatcaaaaacaataacaaaaagattgagtacttttaatatacatgttgtcaaaagacaaaattacaacaaatttaatcatagatctaattggcttttattcaagatgcatgaatcggatcagcctccattctacaaaatagaatgagaggtctcactgggcagtggcaaagcagtgggttttgtaaggtgagaactgtaacaggaaaaaatgctgattggttaacatcagattacttttcttttaagggttaaaacagtgagcatttccgtattacactgattcgggtagactggaatctcctattttcagaaaaaaaaaaaaaaacctggtctattttgggatccacttgcttccttagagtttaatgatacggcatttaacaagagtgactccattttggtttggtctaatctgttgggccctagtacaagagctcagtccaaaacagtggcctctcataatttttgtttaacagtgcacaaagtttttaagtgttttctttggttgaccagcctaattgtaagaacgtttcatctggaaaataaaagattacatccaaaagagaattctggtcccttgttccaaagttattttatttcttattcccttcagtgggaggggtaaggaggtgtgacatattctcactgctatatatcaaagcgttaatggtggaattttgtctttgtaaagcatttggagttattttcgagaaaagcgctgtgtaaacaaggaatttattttaagaacaactccatgtttgttgagatacttgtttagttattatggcttggtctagtatctgaaaatagaatcaaagtaataaccagaaaacccttagcacccatgtaaatacagactttttattttgcagaccgggaaactgaggcccatagaggataagagacttaaagattctaagctattaaaaactccaagtctctgtttctttgcttttctcagtgcttcaaaacattccccacttcagtttcttagttgtttttttttttaattattactgattgttttgggggtgttttctctaagtgtccttcatttttcagttaaagtatttgtggcagataaactattttagtgacaagaatcagaattcctgtgttcaagtcacttgatcgaaaagaccttatttaatgagttttagatattcatgcagaaagagggctgggtttttttggttttaaattttctttaacagtcctgaacacagtgtatgtttgtttttcacatggcctggaaaaaaatttttaacttagatattacgtgagaatgctacaaaaactttaccattacctcagtttctattattaggtgattttaagtttttacaactgcttttttgggcttatttattggcaaagtatttcccttatattt

SEQ ID NO: 761 - DNA, 1032 bp, Homo sapiens
gttaatccaagtggaataaatagcatcacctatagtaatgtgccagcgttattagttgaaccctggccgtttctacagtaccaacattaggagagggtccaatgagagtgaataagctatgaagcattatacaaataagaggtttctattacttttttctttttttaattagagtggaaatattcaacacctatcagccaggcactgtgctaggttgatatcaaggttacaaagatccaggccctgcccacagggaacttttgggggaataggcagacatttataatctaatgaaatacgtggtatggtatcttagtccctttaagctgccataacaaaatacagtaatctaggtagcttataaacaacagaaatttatttcctacagtgttatggagcaaaaggggcttgctgcccaatgtgctagaagccattactaagtcccaggtttttgaggaaagaaaagctttttattgcaagtctacttacagggaaatggaagtccacctcaaatctgtctctctgcactggctttaaggcactaattttatttaaaaacgtttagggaggccaagtgtggtggctcacgcctgtaatcccagcactttgggaggctgaggctggcagatcatgaggtcaggagttcgagaccagcctgaccaacatggtgaaaccatctctactaaaaataccaaaaaaaaaaaaaaattagccaggcatggtggtacatgcctataaattccagctactcaggaggctgaggcaggagaatcacttgaacctgggaggcggaggttgcagtgagctgagatcacaccactgcactctagcctgggcaacagagcaagactctgtttccaaacaaacaacaacaacaaaaacagtttagggagccaggtgtggtggcttatgcccctaatctcagcaatctgggaggctgaggtgggaggatcagttgagcccaggagtttgagaccagcttgggcaacatggtaaaaccctgtctctaaaaaaatacaaaaattagctgag

SEQ ID NO: 762 - DNA, 1049 bp, Homo sapiens
atatagtatccaaattatagatgatttataaattttaaatataaagcttgcaatattatatatgtgtatatgtatgagatagaagtaatgtaaaggtgaaattgatttacaaggaggtgagttcacattgcctttcgctggtagcaggaaatttttttgtaatggggaatgttgttagttcgtcttctctgcattccttagtctcagactgtggtttactgaagctagatacatatcactgaagtttcttgctgggtggatacattggctgacattgataaatatatattttttttttcttgatgaagatttaaaagaataaccaattccccaaaggcagaaatttaaataaatatggcagtgtttaaattaacagataatttaagaagtaaaatttaagcatttattagtaacgtgtaagcaaaaatggaacgtaccagttgttcattgggtatagatttgagatttaagggtagtttttatgtgtgagaatttaaactttgaggcccccagaactatttacaggccagttgcagtggctcatgcctgtaatcccagcactttgggaggccaaagtagaaggattgcttgaagccaggagtttgagaccagccagggcaacacagcacaaccctgtccctacaaaaaaaaatttttaataataagccaggcttggtggtgtgcacctgtagttccagctacttgggaggctaaggcaggagggtcatgcagtcccagcaatttgaggctgggactgtgagctataatcacaccactgcagcttgggtgacagagcaagaccctgtcttaaaaaaaataaaagtacagttcaaaagccagtagataagattaaacggaatcatacaaatactccattaattctaagaaaggagaaaaggagaaataatggcatgaacaaggaacaaagggggcatgtagaaaacctattaaaatggtagagttaatcccaactatatcaacagttaccactccatttaatgtcagactggattaaaaaagcaggatttatctatatgatattttcaaga

SEQ ID NO: 763 - DNA, 1118 bp, Homo sapiens
agtcaaattaaaaagtttctgcacagcaaaagaaataacagagtaaacagacaacccagagagtaggagaaaatattcgcaaactatgcatctggcaaaggactaatatccagaatctacaaggaactcaaacagatcaggaagaaaaaaaaacaaaaacaaaaacaaataatcccatcaaaaagtgggctaaggacatgaatagacaattatcaaaagaagataatgataataaaataaatggttggccgggcgcggtggctcacacctgtaatcccagcattttgggaggccaaggcaggtggatcacgaggtcaggagagtgagaccatcctggctaacacagtgaaaccccgtctctactaaaaatacaaaaaaattagctgggcgtggtggcaggtgcctgtagtcccagctactggggaggctgaggcaggagaatggcgtgaacccggcaggtggagcttgcagtgagccaagatcgcgccactgcactccagcctggacaacagagcgagactccatctcaaaaagaaaaaaaaaaaaaaggccaacaaacatgaaaaaatgctcaacatcactaattatcagggaaatgcaaatcaaaaccacaatgcaataataccaccttactcctgcaagaatggccatattaaaaaaaaaaaaaatagatgttgatgtggatatggtggaaagggaacacttttacactgctggtgggaatgtaaactagtacaaccactatggaaaacagaatagagatgccgtaaagaactgaaagtagatccaccatttgattcagcagtcccactcctgggtatttactcagaggaaaagaagtcattatatgaaaaagacacatgcacacacatgtttatagcagcacaatttgcaattgcaaaaatggaactagcccaaatgcccatcaatcaacaagcaaataaagaaaacgtggcatatatatactgtggaatgctactcagccataaaaaggaacgaaataatggcattcacagcaatctagatggagttggaaaccattatgctaaatgaagagactcaggaatgaaaaaccaagctggtggcaagcacctgtaatcccagctactcgggaggct

SEQ ID NO: 764 - DNA, 1046 bp, Homo sapiens
atcaggaaccttgaccagtttgagctgtcttactctgaaaaccatgttacctcgtgggcaaggcggtcaaagaggtactgctgtgtaaccacttcattccagttcctatccacctcctccccaaggtgggtatcctcacactccttcagcttgatgagagctgtgacctgttcccaccaaaaagaaagatgctcaggtgaggcaacataccacttcccacagaacacactgggccctgtccagcccggcttgtgatggacatgccagtataagaggcacggatgaagctagggagacactattgtaagaggaaggtggggctgcaaagctcaaaaactggccggcgaagccctgttaagatttgtatctgggggcttgtgtgggccaaaggccaaaagaccaggctggcacagtcacctgggtgttgaatgcctcttcagtgaggttctcaatcttctcctcaaagctagaaagaaactcttctatcttcttatcaacaacttcagaactgaaacaaaacatcttcaatcagaactaaaacaaaacatcttcaattaagtcatcagaaacccgatctcaggcagaaggcaaaagaaggaattaagactaagacatatatccaggaaaaaaagctaaagtgttttcccaggcctcagtattccacctgactttgaggacagaaagagaaagaaccctccccctcaccccacctccagcccagtttcctggtatcctcataatgaagcagtcacaaccatgtatgaccattccaaagctgaaaactaacaggtttcagcaatgcctgtcagatcaggcatcctttcccttcttgtcctcaggtctgcctgaagagaagaaacactggcaagccccacacaatgaccacaggacttgaatcaagtctgaaagggccactggaactattgatcagtcctggaacagaccatctataacaacccccatcttcccagcttccactgactaaatagagcaaacctgcttggtcagggttgcccaaggtttaaggaaacacatgtagcccctac

SEQ ID NO: 765 - DNA, 1401 bp, Homo sapiens
aagactccatctcaaaaaaaaaaaaaacaaaactaagggatgaggggtttcagagacagtttcatacaaaggtcaaataaataaccagctttttttttttttttttggtggggggatggtctcactgtgttactcaggctggagtgcagtggcacagtcttggctcactgcaacctactgcctcctgggttcaagcaattctcatgcctcagcctcctgagtggctgggattataggcgcaccaccacatctggctaatttttatatttttagtagagacggggtttcaccacattggccaggctcgtctcaaactcctgacctcagaagttccacctgccttggcctcccaaagtcctgggaggattacaggtgtgagccactgcgcctggccaataaccagctttttgaaaggaattcttaggcagacttacagagtatcatccagaaccaaatttctgaaaatgttttatgttctgtaacatttgaaaatatttgaatgtgcttgttatttggtaatctagttgaatgtagtgactgtgctgtcaccttttcttccccaattgcatgaatccattgacaaaaggatctgttttatttctcagaaacaacagattttttccagtttatttggtaagaagtgtaaccaaaaagcactttccgattcagatgccctaattgttccaagttgcttcatagagttttataataatattcagaggacagcttctgtcttaatcagggtataattcagcctccatgaaacccttcctgtctttccaggtatagtcaaccctttctctgtacttttactgctgttagcctaagttgctcttctataatatgtttttcgctatctcatatcgtggtgtataatggtaacttattaatccagtagtctgttttcagtagcttataaagagtcttgacggctgggaacatgtttattcgttgtttctagtttatagcatgctgattctctgtgatgagtttgcttagaacctattaaatttaagaggtactgattattccaggtgggattgttctgcagtaagttagctatagggagctagggcttagagaaagcttaaggctgggaatataaattttgtaattggacacataagttttactttttacattttcctcttcctggttcttgttttttctgaaccagttgtacagaaagaggacctaaagttaatggcgggctcttcctgcagttccttcttcctccagctagagcctcaggtgcccatagatagacagctctgagtacacgagagtaaaagggaagcaccatgtcctattcactttaccattccatagcatccttctttctctcttagggtcctgttcttttggctttttgttttgttttttactctgtgtgtgtgtgtg

SEQ ID NO: 766 - DNA, 1034 bp, Homo sapiens
tactgcaacctccgactcctgggttcaagccacttctgcctcagcctccgagtagctgggattacaggcacccaccaccatgcctggctatttttgtatttttagtagagatggggtttcaccatgttggccaagctgattctgaactcttgatctgcccaccttggcctcccaaagtgctaggattacaagtgtgagccaccgcacctggcctgaaatcctcttttaaaccacgtgatttggtcttgatttgaaaaatatagtcctaccatatcttttgttcttttcccattctaaaattatgtgattctaggctaaatgcagagcaacatcccatttcacatccactgtcatccttctcgagcccagatttcacccactttaacatttaactttttaacaaaactgtaattatcttcaaaactatataatttatcttttctgaagttaacataactcacagtgctgtgtttttagaacagctgggttgaatgcttgtgtgtgatataattaatagaaccctaagtgtaatagtgagagagggaagggtatagaatttaaatagtgatttttgtcagaaaaacctggggaaattatttgtgggtttagttacaattttccagggatttgcctttattttctctgtgttccaggtcttgcctgaaatttagaagcccctttcttgcccttcctttctggtgctatcaatggtggtaatcacctctgaggaagaaaagccctcttcccactgtccatggagaacactcagcatctatgcttgattttgacagggcagattttggatgaatcatgaaatgcttctaaagtagccaagagttaactcttcctaacctttttatatagtaagcatgttaccccacaaggtaacttacccaggggaatcaactacatagtggaatcacgttattcacacatttaacttacacaaattcaactctactgaaaaaaacatgaagtacatgagtgagagagaaaaataacaatcttaagtagcacatgttaaaccttccatt

SEQ ID NO: 767 - DNA, 1034 bp, Homo sapiens
tgggaggcagggagaattgcttgaacttgggaggtggagactgtagtgagccaagatcgcatcactacactccagcctggtcaacagagtgagaccctgtctcaaaaaatgaataaataaaaataaataaaataaatttcatctttgtcacacatggaaattgccagctgtgttatcagtgtattaactgattaaagttttatttttaatgttactcaagcaaaaaatatgaatggcattttagattgacaatatttagctatttctgagcaactctgtgtgatttatacaggaaaaaagggataaacattataagttttctttaaggtctttgttctcaatgactaatattaaaataaactttttgtagtcttggacagtaaagcaccaaaaccagaagacattgatgaggaagatgatgatgttccaggtaagtgacatttccttagacttaagattttaagcatcctgtttatctcctttcagtcattgcatagataacttttaggtttgtgttgattgtaagctcatgaatttaaattgattcacaataatgtggataggatctaatgaaaaacaacgtaagcacccaccttagaacctagaatcagaaattgtcacacaaagctctgctgcctggatttattaaattgaaatcactgtgattataaatttgcatagctattgttataacatttctgtatgaattataattgacatatgaaaatgctattcacctcagtaatttgcatagacaaaagatgaacatttccttaggattactgtcctaagcaaataattaaatcattgttagtaaaatgccaccagttcatttctgcctccttatgttttcaggctaattctggttgtactaattttattttttcgggggttagaagttaggagttccatttacctctttttccttttttgtattctttgattcatatactttgtttttctttttcagatcttgtagaaaattttgatgaggcatcaaagaatgaagctaactaaaagtttggtttttggaa

SEQ ID NO: 768 - DNA, 1046 bp, Homo sapiens
tcccaaagtgctggaattacaagtctaagccactgtgcctggtccactccgaacatcttattctttgtactttcaatatatattttgaaaaacctgtttaaatcaaaaattttttggtactctcaatgtcttgaagtatctctaagagttctcttacttatttacttagttattattattattattattttgagatggagtctcgctctgttgcccaggctggagtgcagtggtgcaatcttggctcacttcaacctctgcctccccgattcaagtgattctcctgcctcagcctcccaagtagctgggattacaggtgtctgccaccatgcccagctaatttttgtattttttgtagagatggggtttcgccatgttggccgggctggtcttgaactcctgacctcaaatgatccacccgcctcagcctcccaaagtgttgggattacaggtgtgagccactgcacctggccaaagagttcctttaatgtgaagttttttgctggtcttactgtctctaagacatcttcatccttttggttataaccattttcttcatttttttcaaaagtttgccttcactaagttcctctggttacatatctaaagtctttcaaatgggaacagtgtcaaaatttccatgctcaactacttcaagtttcacttccagccttatcacttttcatttctttacttcacttgatcttttttttctaattcccctttttgattattcatttttctaaaatgtcatgtgagttttattactggtagaaaaggaggcaacacaatatatcctttgctgtttgttaaagaactgaataacaaatatgcagtgatagaccaaagtctatcactgattgactttgaaagaagtggtgtgattgatgactgatcataatgtgcatctgttatttacatagtgatgcatggactgaagagccagcagcaaagtttgtaatgtgtgcaattacttatagttactatattgtgataaatgaaatttgaattgtgttgttaactatggtaactaaaattcatgcatt

SEQ ID NO: 769 - DNA, 1029 bp, Homo sapiens
gtcactactgggcagggagtattaagtggtatcctagggaatcatctgagtcccacacatattctttcttgttccctttgtgtaacggcagccctacttcctcctgaggatgagggttaattaatcttgccaagatgggcattcctcttactgctttctagtccttggacacaaggaatactcagtattcaggctgcagctgtaaattgtagttcactgtgacctttcatgtgtctcttggcaaaagtgtgcccgctttgggtgccaggacttctaactccgtagagccccacattgcagagatgggaagcacaaagtagatcattgggaatgatggcgagtaggggctatttccctttccacttcttggttctcagacccatgtattcttcttactgggaacctagctctaaatcagtgcatgtactgcatacaagaggatagcacaccatttttgtctctgagctagtacattagctgtgcctgcagcaggccattccaatactctctaagactggtccttttgtatggagctgttatggatataactactggagcttatggttatgggcctactgccacaaatctttcactgtgaagtgattcccttggctggattccatgtctgttgattaagtgctgtataagtctatatttagtggtactggctaggtctctatggacaggaaaggcaaacccatacctggaataaatgtctaatcctgtgaagatcaatcactggcccatccaagatggaagaggcccagtgtagtcagcttaccacttaatagtctgttggtctgcctgaggcataatgctatatgggggcttggtgttggtctttgttgctcataggttggatgttcagagttggccttggtaaatgggagtccatgtctccttctctgcttccatctctatttctgccacagtgacctctccatttatgtccccatcttgccacttctgggtgaccgatgtcagctagttgagtcattttgtctccttggctgttcattggctcttctg

SEQ ID NO: 770 - DNA, 1053 bp, Homo sapiens
gcctgcctcagcctcccaaagtgctaggattaccggtgtgagccactgtgcctagccaaagttttaagagatgtattttaaatacatctttcataggagtctgcaagctttttatctctaaaaaatgacttaatttttagggctcaaaaattccattcttcaaaagaaatgtccaagtattttcttttatagcttcaaactttctgcacctaactacttgactgttccatgccaccccaaacatgacatgactgaactaatttatgtgttactgtcttcctcaaaagaaagtttaaaaaggagttcttcataaatgcagatctctaatacaatatctaacacaaaagaagctttaaaaaggtaatttcttatttgattagctaggagtttatgttagtaaaagcaaaaaaaaaaaaagtttacggagtataacactagggttgcttttatactcaagatgtttactcaaaatgacaacaattacatctttaggagtataatgtagatactaaataaaccaaaaatttttttttcttaaagactaggaagaatcagaagcttagggacatccagaattaaaaaaaaaaaaggagaggaaaaagaaaataaagaggaaaaaaatgtccttcattgcaaccatttcattatcaatagtgtcttgggctgcaggaatgagatcttgattgtgatctgtatcgactataataaggagaaggtgatcatcttctgtaccggtaatcatagtcttcatatctgtcatatccacgatgatatcctctatcatagtaagaatctcgacgtctgtgaccacctccactgccgcctttgccaccacctccgccaccaccactatgagttctgcccatatagatgcctggtataggtgtgcgcattgtcttggtaatagaataatccacccgaatttcttctatcatccagctcctttctgtttgcccttaccatagcctcctttgagtcatctattccctaaaaatgcacaaaagcaaatccttgagatcgcccagtttgctggttgtaaaccacattggcacc

SEQ ID NO: 771 - DNA, 1016 bp, Homo sapiens
aattctaccctgatgattaaaaaaaaaagttttaggctgggtgcggtagcttatgcctgtaatcccagcgtgaggaggccaaggtaggagcattgcttgagcccaggagttcgagaccagcctagacaacatcttgtcccatctctacaaaaaacaaaaaagtcaggcatggtgacacgcacctgtagtcccagctggaggctgaggtgggaggatcacccgagcctggggaggtcaaggctgcagtagctgtgataatgccactgcactccagcctgggtgacaccagatcttaagaagaaaaaaaagttttaaggcttacatttcatgcttatttactctgaacaaatctttttaaaaaatgtatcaattgatctttataaaaaataattcccattagcagaataaagattatgtattgaatatgattccaatataatttaaaaagttttgcaaaaggagtcataaaaagaaatgtctgcttcattaaagttgcatattaatacaaacacatggtatcagtaagaactctgccattgtcaggattgctatagtttaggcctcttgtttctaagtcctcaggcagctgcagttgctctgtatatcacattacatagctcaccttctgtttctcattgaagaaaaatgaggcataggatgtgcagtgatccaatgttaggtacttccttgaccccatcaatcttggtggataaataagaaaaatacattttaagctttgaaacatgatttcaagcacttgatagtgtttcagcagtagtcttggtaagtggacgaagccagtgatttggcctgccttggatggataaatgaaattgcacgttgccatgaagacccatctcactcaacagcgcatgagatacatatgaatcctcgccttggtaatgttctagaggtgaatattagcatagatctaaaaataacctacccttttaccctgatatatgatgccaccgtcacttgtagagtacaaaaacgtatacaaatcttgccacact

SEQ ID NO: 772 - DNA, 1079 bp, Homo sapiens
gtgctcaagtattggttgagtgaatatttatataaatgtgaattatgtggagatttttattgtaattatgttgtaatgagatttgaccccaaaacttgctattatgaagtatttgtaccctaactccttgctatcctcttattttcaacttggtctaggactttagtaagctaatacatttgttgaatggatttgtcaatcagtaagcctcaattttttcctgcagaaatacattttcgttatgtgatgtaacagttacatacgttggaacagccaagaattcgttttgaccttttgcagattttacttaagaagattttgaaaaattttattgctcttttttaaaaattcttcctatcttcatttaatattcagttcaaagcttttcatgaagtcttgttagataattctaagctgtaataattgtttcctcttagtttctataacattaatttatgaacatactaatatttgtaaatccattgcatcatttattcatttgacgatacttattgacccatttactcttaatttgctggcatatagtttttcatagtagccactcatgatcctttgaatttcttggtatcagtaataatgtctcctttttcatctctgatttcgtttgagtcttctttttttcttagtctggctaaaggtttgtcaattttatttatcttttcaaagaaactgacatttgtttcattgatcttttgtattgttttcatttcaaattcatttcttttttccttttaattttcaaattcatttattctctgatctttattacttcttttcttctaattttgggtttggtttgctcttgcttttctagttctttaagatgcatcattaggttatttatttgaaggtttttcttttttgatgtaggcacttagagctataaattgtcctcttagtactgcttttgctgtatcccataggtttcggcatgttgtgtttccattattatttgtttcaataaaatgttcaatttccttactggccattcaggagtatattgtttaatttccatgtgtttgtatagtttccaaaattcctcattattgatttgtaat

SEQ ID NO: 773 - DNA, 1073 bp, Homo sapiens
actcttcagttcctgctttccttctaggtttatggcatctgtgtatttccctttcttgcttttgaatttgactgtttaaactcttttaaaatattttatttagaatttttttatttatttatttttgagacagggtctcactctgttgctgaggctagagtgcagtgccaccatcatggcccactgcaacctccgtctcctgagctgaagcaatcttcctgcctcagcctcatgagtagctgggattacaggcatgtgtcaccacacccagcgaatttttaaaattttctgtagatacggagtctcactatgttgtccaggctgatctcaaactcttggcctcaagcgatctcacaccttggcctcccaaagtgctaaactctttaaaataattagttttgtctagaatttttttatttagagtaggaaggaatgtttaccacccatcagctcagtgtgcccttttttcttttaagaaatcttaagcctgcagaaaaatggaaagactagaacaattaagacccatatatccttcagctagagttatcagtttttaccattttgtcccttttgcacacctttcttcccttcccacacatatactctcacatcatttaaaagttagttgcagacaacacaacacttcttccctaaacacttcagcaggcatctcctaagagaacaagtaagggcattcccctacaaaatcagaatgccattatcacatctaagaaaatgataattaattcaatgtgtcacccaatgtatcgtccatatccaaatttcttctgagattgttctcaaaatgttaatttatgctgtgtgtgtgtatatgtgtgttttcttgatccagaatcaagtcagtgcctgacacttggttatttaatattttgtctgttctagttgagaataatcttttttcctttttttttttttaaagacgaggtcttgctctgtcacctaggctagaatgcagtggtgcagtcatagctcactgtaacctcgaactcctgggcttaagcgattctcctacctcaacctcttgagtagctgcaccaccacacctggctaat

SEQ ID NO: 774 - DNA, 1027 bp, Homo sapiens
atcacataaatgatttgcagatattttctcttattcttgggtttttcattctgttgtcctttgatgcaccaaagtttttaattttgatgaactccaacttacattttcttttgttgcctgtgcttttggtgtcatatcaaagaaatcatctccaaatttgatgtcatgaagtctttcccttatgttgtcttctaagtgttttgcagttttagtgcttgcgtttaggtcttttatccattttgagttaattttttgtgtatagtattagcttagttttattcttttgaatgtggatatctggttttctcagtatcatttgttggaaagactgttctgttcctatggaatggttttggcactcttgtcaaaactaactggaccatataagtgagagtttatttctgggcttttttctattccattggtctttatgtctgtctttaatgtcagtaccacatggttttgattaccatagcttcatagtaagttttgaaaacatggaatgtgagtcctctggggttgtagtttgtcaggattattttggctattctggatcccttgagattcaatttgaatttgagaatggatttttctgtttctgcagaaaacatggttagggttttgatagagattgcgttgaatctgtagatcactatgggcattgttgacatcttaataataagccttctagtccatgaacatggaatgtttttccatttatttgtatgttctttaatttcttttagcaatcttttgtcttttgtagttttcactgtacagtattttacctccttggttaagttaatttctaggtattttattctttttgatgctattgtaaatggaattgtttccttgatttcatttttggataattcattattagtatgtagaaatgcaatggacttttttgttgatttttgtatcctgaaactttgccgcatttattagctctaacagtttttgtgtgtttgcggggaatctttaaggttttctaaatgtagcatatgttgtcagtatacagaga

SEQ ID NO: 775 - DNA, 1087 bp, Homo sapiens
acagggttttgctgtgttacccagacaggagtgcagtggccattcacaggtgcagtcatagtgtagtgtgtcttcaaactcctggcttcaagccatcttcctgcctcagcctcccatgtagctgggacaataggtgtactcctctatgcccagccttgtgttattatttgattttaggttataacctgaaacccttgcactaaattgcattgcatgaaggcaaggaccatgtccgttttgttttctgccacatccccattgggtagcttggtgcccagtacatagtaagagttcatatatttgtggaataaatgagtgaatgatggattcttggttttgtctctttattagaaaggttattgaaggattttaagaaatttaacattattagatttattttttagaaagttcagtctttgtttggaagattaattggaaaggcagatgtgaagattaggagaacagttaggttatcatcatgatcgtttagtcctcagataataacagcctgaacagaggcagcaatgttagagataggagaagatgtgattttggaagaacaatttcagaggaaaactaacaggacttaatgactgactggatgtggtcatggcgagggagaaggaaaagtcaagactcaaaatttaaatgaaatatgtaatttagtatgaagtagtattacagagtagttaactatagagccattgcagtcatacagattaatcatgtaatttactagctgtatgaccctggtaattttacttaatgtcttagtccattcgggctgctataacaaaataccatagactagatggcttataaataacagagatttgttacagtctggagcctggtaagtccaagatcaaggcaacggtagatttggtatctggcgagggcctgcttacttatagacagctgtgttctcactctaacttcacagggcagaagggtgaggagtctccctcaggcttcttttatagggcactaatcccatatgccccactacctaataccatctcttttggggttaagatttcaacataggagttttggaacattcatctgtttacctaactgctaattg

SEQ ID NO: 776 - DNA, 1109 bp, Homo sapiens
cttctgtactttttcttgtgctgtggaataatgggaaagaatggacttcagaattgaacaaacctgacttttaatgccagtaccgttccattctagctgtgtgatccagttggcaagtcattcatcctctctgaatttgtttcctagtctgttttatttaaaacaattatataactacacctacttaaaagtcattgtggttattaagttagatatcatacctgtaagtacataccaagaaagtatctggcataaagtaggcatgtaattaatattttccatttcttcctttcttctgcctagaatacccctctctactgtagacttcctgaagaactcctcaaccttttaaaatccagcttaatggttaattcttctctgaatccttacctgggctgcttagaaaatagtgatttgcttcattatctctgttctaatagtggttcctatagactgttggctacattaacactttttctcattgcaatttagatattatattttcagatcgtattctttcacttagactatgaaattcttcatcttattttatacttgcatttactgctccttgcatggtgctaggcctgtagtaggctctcagcaaatgctgtctatattgtactctcaaatgcagctatgtcccagatagttcagcagtgaactttcacatacagttaagcattcttttgactgcataatgcttttgcttctttaccaggaccctgtaaaaatatctactgttagtaaaattgctgcttagggttcagatttttattttaataaatcttagattaataaggaactaaattggcctactctgttgttaaaaagagtcagattgttggattctattgttagtaaaatacctattgttagtaaaattatctattgtaaaaatatctattgttagtaaaattgctgcttagggttcagatttttattttaataaatcttagattaacagggaactaaattggcctactctgttgttaaaaagagtcagattgttggattccattttcataaaaagttatgtccgttaaatctaattgtcaaaacttctcctaccaagaaagaacagtgaattatctatattacttaaacta

SEQ ID NO: 777 - DNA, 1072 bp, Homo sapiens
tttacttaaaaaattttaaactcaggatttctctttccaataaatatttttaataatggagtagatatttcccattgtatccaaaaaatccattttaaaatttccattagaaaatgggaaatgatgttactttgttctacctgactgtccctcaaatatgcattttatataagaccaaccaagcaacattcaacttttaggttttcagttcctttcccatatctctaggttctacagtgattattacgcatgatttgacttcaagctgaaaggaccactgtcattcaaaatgagatgctgaagcacatactgtgcttccagagattaaatgagaagagttacattcagtattaacttgttcatgttcagaatcttatgtgtgatttactgatgattttagtgacatatgtactaaactcttaaattatacttaaaggaattgttttatgaagccagtcacacacaatacttttattttctgggttcattttttaaagtttaagtttttaattgtcaaaaatgtcaaacagtacaaaaggtcatagagtaaaaggtagggctctcttctaccccaactatttgatatcctttccagaggtaactagtatattatcactttcttgtatatcatgagttattttaaatgctggtcttgaacatttattatgtgaaattcttgttataatagttggaaaatttttattaaatagaaaggtagtctttagattgtggcacaaaccactgtggggagaggtctatacacaggataaccacattatcatctaaggtggactgggtcacttttgagagtaaaagagggcactattaatttgatactgagccagcagatacaaaccatgctctgtatgcacctattgataaatcaaatgcatgtctcttttctgtgaataattagctcatttctccatctgatctctttcttgatttgttcctttaaccaatctattacattgttttctcccctttcagactatgctgtggaagagaaaccatcacagatttcagtaatgcagcagttggaggatggtggccctgacccacttgtatttgt

SEQ ID NO: 778 - DNA, 1064 bp, Homo sapiens
gggggatcacttgaggtcaggagtttgagaccaacctggccaacatggtgaaaccccacctctactaaaaatacaaaaaaattatccgggcatgatggtgcgtgtctgtaatcccaggaggtggaggttgcggtaactcgagatcacgccattgcactccagcctgggtgacagagcaagactctgtctcagaaaaaaaaaaaaaagaaagaaaaaaagacatctcaaatcaatgacctactcgtctaccttaagtaattagacaacaaagagtaaatgaaatacaaaatagaagaaataataaagataagcaatccataaaatagaagacaaaaacaataaagaaaattaatgaaaccaaaagccagttctttgagaagagcaataaaattgataaacctctagttagactgattagatagggaaagcacaaattacctttttaggatgtaaaagagggaaactatcattacaggtccgatagacagtatgaacatgttttggtcagtgtgcgttcaacttagataaaataggcaaattatttgaacagtaagttttcacagctctcaagattaaatagataacctaaatagccctgtatttattaaaagaattgactttattgtttaaaaccttctcacaaagaaaagtcctagttcagatggtttcactggtaacttaacaatgaaggaagaaataacaccatttctgtgcaaacacaccaagaaaatagaagagaaggaatcttactctatgaggtcagccttatactaataacaaaaccaaaaaaagacattacaaaaaatgaaaactatacatcatacctctcatgaagttatttgcataaatagttaacaaatttttagtaaatccactctaacaatacataaaataataatgtatattatgactaaacatggtttatttcaggaatgctaagttggtttaacattcaaaactcattccatagtttaggatacaggatcctttaacaggatgaaaaaggaaaaccatatgatacagcaaaagcagttgacgaaatcctacttccattcaagattaga

SEQ ID NO: 779 - DNA, 1026 bp, Homo sapiens
ttttggtttattttaatttgaaactacacatattcttcagagaagtgtgaaattacaaaagcataatttcataggttctttgtagcactggcgagaacagatggcgctaaaatctgtttgaggaatgtttgattctctggccttcaaggaatacatttcttttagggaattaggagctgatagtcctcttcttaaaggaatgaaaggagttggtcaaaggtcctctggagaatagtgcagaggagagagatgatgttccattgattattggtatagcttttcctagtttatacataaaagacagtatttaacaatagatatgttcaaataaaagaatcctcaagaagaagcccatgatactgtacctccactgactgcaagaggaggccactgctgaaccccacatgcccaggatagtactgtcttctctcttgtgtacatgcccattgacaggagtggttctactacactggacttctagtcaaactcctggctttccctgtctcccagaactcacaacctcgctgccatatttgtccttgagaccatcagctctaatctcattgtgtttatgtcaagcaccacaagaagttctggactcctagggcatccctcatttatcgtaatttaatttctatctctgtacaccctcctttctgaccccatttcgtattcattttggaaaacccaagatattagttcttgtaagtcttatttgcctctatacatttccttggtaatcttatccagttctatgggcttaaatactatttctaagctgacatcttccaaatgtttgttttagcctaaatctctctgctgttttgtagacttgactgtcttattgcccacttgacatctccacttgcatacacatttcaagcttagcaagttcacctttgacatggtcatcttacaggcttctccatctaaattaatgacagtgctgtcatctttccagttacccaagcccaaaactttagagtcatctttgaatcttcttttcctcattccttgatagacaaa

SEQ ID NO: 780 - DNA, 1093 bp, Homo sapiens
atttgtttgcttgtctactactgaataaagcaagcactaaaacagtgtctggcacgtattagatactcaatgcccattggctaaatgaataagtattttctaaatgaatgagtgaaggcagcctgggcacatagcgtgagacctcagctctacaaaataaaagtaggccagagggccaggcactttgcctcatgcctgtaatcccagcacattgggaggccaaggagggagggtcacttcaggtcaggtgtttgagagcagcctggctatcatggtgaaacccatctctaccaaaaaataacaaaaattaggcgggcatggcagcacatgcctataatcccagctattcgggaggctgaggcaggagaatcactcctgaggtccggagttcacaaccaccctgactaacgtggtgaaaccccgtctctactaaatacaaaaaaaaaaaaaaaaagccaggcgtgatggcgcatgcctgtaatttgagctacttgagaggctgagacaggagaattgcttgtacctggttggcggagattgcagtgaactgagattgtgccattgcactccagcctgggcaacaagagcaagactcagtctcaaaaaaaaaaaataaccacaaaaaaacaaatgaaaataaagatagctgggcatagtggtacatagctatagtctgtgtacctgggaggctgaggtgggaggctcacttgagcccaagagttggagactgcagtaagctatgattatgccactgcactccagccggggcaacagaacaagaccctgtctcaaaaacacacacacacacacacacaaaaacaaaaacaaaaacaaaacaaaacagattgaatgaagactcatagttgtcaatatgtagattcataggacttgaagatggggtctagcctctggacactagtgaatttcagctaactggaagggtacgtatttacatttttcttaaaattactccaagaaagtatattcttccaccttttccatcgttcttcagctcagtgtttctttctcacttctagttctgttcctcacttatgctgtttcctctgtccaaaatattctttttatatacctg

SEQ ID NO: 781 - DNA, 1049 bp, Homo sapiens
atagctggacatggtggcacatgcctgtgcctgtaatcccagctacttgagaggctgaggcaggagaatcacttgaacccaggacgtggaggctgcaatgagccaagactgcaccattgcactccagcctgggcaacaagagtgaaactccatctcaaaaacaaacaaggccgggcacagtggctcatgcctgtaacccagcactttgggaggctgaggtgggtggatcaccaggtcaggagatagagaccatcctggctaacatggtgaaaccccatctctactaaaaatacaaaaattagctgggcatggtggcatgcacctgtagtcccagctactcgggaggctgaggtaggagaatcgcttgaacccaggaggcgaagtttgcagtgagccgagattgcaccactacactccagcctggtgacagagtgagactctgtctcaaaaataaacaaacaaaaatactgttggtcttgcaattaagcattattcaaggttgaatgtgaatgatggcatataaaaagtacagagaatgtgctatggcatttcaaagaaggtaatggtcacattaatgtctcactgggggttaaagaagtcttcatgctggccaggcgcggtggctcacacctgtaatcctagcactttgggaggctgagtcgggcagatcacaaggtcaggagttcgaaaccagcttggccaatatggtgaaaccccatctgtattaaaaatacaaaaattagtggggcgtggtggcgtgtgcctgaagtcccagctactcgggaggctgaggcagaagaattgcttgaatccgggaggcaagaggttgcagtgagccgagatggtgccactgcactccagcctgagcgacagagggagacttgtctcagaaaaaaaaaaagtcttcatgctgaaattggcattttcaggggactactttttcaggtgcttggccatgggagaagaaaagggaaggtaggccgggcgcgatggctcacgcatgtgatcccatcactttgggaggccgaggtgggtgggtcacttaagct

SEQ ID NO: 782 - DNA, 1030 bp, Homo sapiens
gggcgcggtggcacatgcctataatcccagcactttgggaggccaaggctggcggatcatgaggtcaggagatcgagaccatcatggttaatacggtgaaatcccgtctctactaaaaatacaaaaaattagccgggcatggtggccagcacctgtaatcccagctactcgggaggctgaggcaggagaatggcgtgaacctgggaggtggagcttgcagtgagcctagatcgcgccactgcactccagcctgggtgacagagcgagactgtctcaaaaacaaaacaaaaaaaaattcttccgtgtcaacagcaaagacagcaaggcaaagtgggtatgtgcctgtagttccagctacttggaaggataaggtgggaggatcagtgtcaacctggataacataacataacataacataacatagcaccatagtctctaaaaaaaagacaacccagttaaaaaatgggcaggccaggtgcgatggctcacgcctataatcccagcactttggaagccaaggtgggcggaccacttgaggtcgggagttcgagaccagcctgacgaacatggagaaaccccatttctactaaaaatacaaaattagtgggtgtgctggcacatgccagtaatctcagctactcgggaggctgaggcaggagaatcacttgaacctgggagctggaggttgcggtgagctgagatagtgtcactgcactccagcctgggcaacaagagcgaaactccatctcaaaaaaagaatggctgctccataggcagagcagtgtcatgggctgcctgactgagtatagttacggtatttcctgattatatgctaaacaaagggttttctgggaaaggggtggggaattcctggaactgagggttccttcctttttagatcatatagggtaacttcctgacattgccatggcatttgtaaaactgtcatgcatgggtgggagcgtcatttagcatgctaatgcattataattagtgataatgagcagtgaggacctccagtggtcacttt

SEQ ID NO: 783 - DNA, 1514 bp, Homo sapiens
ccaggcagtcatagtaaggtgagagagatggagatgcaaacaaatgaatatgaccagaggatgataaatgcaggagtgaaaacaggaacaaaatattcagtgtgtccagaagaagaatgtgactgtgtttaagttttccccttaagtagtctcaggagaaattcttagttgtgtctgaagtgaaatcaacaagcatgtgttttaatcttggcattgcttctcacaacactttcagtaagaggttcagctcaaagagcaaaacctctgtatcagtcagctttggaaagcagagctaaggtttacatttaactcggaggaatttgctagatgccaggtgctgtgtttcatttgcctctcctttggctttgtactgattcttagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaaggggtaaatgcagcacatgtccccctttgtggcttttagttataggttaggctctgggttttgtctgctgtctacattggtgttttatagttttactgaaagccctgcctaagagaaagactgctttgtatgcttaacgtagaattttaaatttctggttttgtaagttagtttctgaaggagtttctgtatgtatttttgagggaagtataagtagagggattgatgaaacaaaaaagtccctctatagttattgagataacagtaatacctgagccttttaagatttacaacacatttttgccaacattgttttgtttgatacaataacaggtgttaacatttccattctataaatgagtaaacaagtaccaaaaggctaagtgacttttcaggtctacaaagctaggaagtgataagactagctctgaaaaccaccttcttgggcttcaaactctgtattctttctcagtgttcggcaactctattctaatggttcaagccaaaaccttggagacatctttgacacttttctttccccctcacccctttcttcctctcatacccagacattcagggacaagctggaaaacattgcatttatacattacaaactgaactttgtatcctttctcaaaggattctacacaacaaagggtgctctttttttgttttgtttttaacattgctatttgatgaattagaaattaaacttaaattcaagtaattttgactaaatgaagtgaatgcctgatatggaagtttaagttagattcgacttttaatacatagagatttggccgggtgtggtggctcacgcctgtaatcccagcactttgggaggctgaggcaggtggatcgcctgaggttgggagttcaagaccagcctgaccaacatggaaaaaccccgtctctactaaaaatacaaaatcagctgggcgtggtggtacatgcctgtaatcccagctactca

SEQ ID NO: 784 - DNA, 1049 bp, Homo sapiens
tctcactctgtcacccatgctggagtgcagtggcacaatcttagctcactgcagcctcaaacttctgggctcaagcaaaccccccaccttggcctcccaaagtgctgggattacaggcatgagccaccaagcctggcctttttcagtggttccaattcattattttggtgcacaaatggtctcagctttagctagacaagagacccttcaagctggctcctacatcctggtgatatgctattttttttttttttttttttgagtacttcttttttatttctatcctaacaagatgcttcaggcttatcttgtgcttatcctgccctagccctggaatcagctatttctgcaaggagccctggcttcttttaatgggagtggtattagaaaccaaaatctggtttatccatgatatgtgtgatgcactctgacctttttctgtttcattaaaaatttattttgatcttagaccaaatggattccacaatgcacattttgaaaatactgctttagggcaatgtactccattgtcactggcatcttctgaaagccaaggctaaactagtttttctgcagtattagtacagctccaagaattccctggaagctagcgcaggcctgtgggacagcgacaggctgctccccagtggctagtgctgggtttagcacgaggcaacagcaggctgtggagctgtgtttgcggcagcagctgttttccagaggcctaaaggcctggcctgggaaacatctgggtaggttcatcctgctctctgaggtgggagcttatagtcgacatctgcctctccaaaggttttaccgacggtggttgcacagaactcttactgtgacctttcccacaggctcagaggtactcagagcttctaaggggaagcttggcccacagagcagcagcttgtcaggaccgagccctggtaaccactacctccaaacctgacaagaacaggaagcacttgttaacaggggcagcttatttttggtctaatagccagctttgtctgaacatacctcaaaagtctggaacttctaca

SEQ ID NO: 785 - DNA, 1046 bp, Homo sapiens
tctgcctgccttggcctcccaaagtgctgggattacaggcgtgagccaccactcctagccagttctcaaaagctatcactccatgtgccatataagatacatgttctaaattcagaaacattgaaggttcagatgagaaattatatttaagttatatgatctcttcaagatcatccctacataattcaggactgtttgtgcttgtttttgtgtttgtctcctgctaattgggacatcttcattcatcccttaatctcttctaaagaggcctagcacatagatgtcctgatatgaagtcttaacacttcttttactttttggcatctaaatcttttatttccaggttgtttgctctaatgactttttcttgcagagtttgaattgatgcatgttgatgagtttattgatgaactattgcacagtgagagagtctgtgatatcattctgccccgactacaggtaagaaataaaagtctgttaccagagtcacccttctcttcctagacgggcagacagacaaacacatacacacagcttaaacactgaagcctgtggatcttatgggtcctcttaatgaatagtcttcctgtctgggagtcccaagatagtggattgggagtgagaggaaaatagataaaatatttgaagggtagggctttaaaagtgaatggtttaaaacaaggaaactttgtttttctccatccttttgtagttcaggtgcatgtgtgagttgtgcctccctcaaaccttgttacaaagtcagcacattacctgtctatcatgaaaaaagaaatttattcaggatgttacatcaagggtattgtagctagagtaggtagggagtttttaacttcatgaacgttttttttaaactaatcttcatgtaaaaagccaggacataaaacagataaaaatagggccaggagtgggagactgagccattaattccttaaacttgccttcaccatcctgcttccctttcctagtgataaacgattatccatgaggcatcttttcaggaaatgagtgtgatacagctctcctgt

SEQ ID NO: 786 - DNA, 1087 bp, Homo sapiens
actgtaaggcattgctaccagcataattcacaaaggatattttttcttataattaaccaaaacataaacctcattgctcagagattctgaagtccacaagtgctcagaaggttgaaatgcttctttgccatggctctggcaatacagtaacagaatgaagcttttaatacacaaaacaaactaaccaacaaaacagataactgactgagtcttggggaaattactgagaatacctctagttgagtgttgtgtaaatgactaaatacttcaaggcaggagcatttaggaagaccaataaaaaccggagtgggggttgtgggaaggaagggtagagattaaaagaaagctatgagaaggtttaggaagagctaatggattgagattccttttttgccttgtcttcattgccccatgctctctggtatgccttgcttttataagaagctgtggttcaagagcagaggatctgcttataggtagttcatttattcatacttacttcttactcagtagacactgaaacatttactctgtaagcataggggatatggagatgtataaggcatggctctaacctggtggttttctttgtttttgtttgttatggagtctcactctgttgcccaggctggagtgcagtggcgcgatcttggctcactgcaacctctgcctcccggttcaagcaattctcctgcctcagcctcccgagcagctgagattacaggcatccaccaccatgcccagctaatttttgtatttttagtagagatggggtttcaccatgttggccaggctggtcttgaactcccgacctcaagcaatccacccatctcagcctcccaaagtgatgggattacaggtgtgagccactgcatccagctgttttttttgttttgttttgttttgacggaattttactcttgttgcccaggctggagtgcaatggtgcaaacaaggggagaatcgcttgaatatttaacttttttttttttttgagacggagtctcactctgtcgcctaggctggagtgcagtggcactcgatctcggctcactgcaacctccacctcctgggttcaagcaattct

SEQ ID NO: 787 - DNA, 1051 bp, Homo sapiens
aagatctctgctgttgctttccggaaagctttctgccaccacaagttagtggaacttgatgccacaggtgtgaatgctgatatcacgattacagacattatcagtgggcttggcagtaacaaatggatccagcagaatctccagtgcctggtgctgaattcattaactctctccctcgaggatccttacgagcgctgcttcagccggctttctggccttcgagctttaagcatcacgaatgttctcttttacaatgaagacctggctgaagttgcctcattgccaagattagagagcttggatatttctaacacctcaatcacagacatcactgctctactggcctgcaaagaccgactcaagtctctaaccatgcaccacttgaaatgtttaaaaatgacaactacccagatactggatgtagttcgggaactcaaacatctgaatcatcttgatatctcagatgataaacagtttacatcagacatagctcttcgcttactagaacaaaaagacatcctacctaaccttgtttctctggatgtttctgggagaaagcacgtgacagataaagccgttgaagcctttatacaacaacgtccaagcatgcaatttgtaggtttgctggctactgatgctggttactctgaattcctcacaggcgaaggacatttgaaggttagactttaaaaatgtattattttgtcaggctgaccaatatcttagttgcataagactctattaaagatgaatgtctgtaatatatggaacatgttcatgaaacagggctgcatatagttgaaaggcttagagtcctaattaaaatctcagcttcatgacccagaacaagctatgatgtcacttcgagtttttatttatttgtagaatagatattattcttaccttgcagaattctgaagattaataataatctatgtaaagggcaagtcacgtagtaggtcctggctaaacaataggttgtcttatgatgataatgtttagctattttgaaccatttacatatatggtttttttgtttttgtttttgttt

SEQ ID NO: 788 - DNA, 1034 bp, Homo sapiens
agatatttattctaatttaattatttatggtcagagaatatgctttgtttggtttgagtccttctgaatttattgagacttgtgaatggccaaggatatggtctattttggtaaatattccatgtacacttgagaggaatgtgtattgtcttattattgggtatagtgttctataaatgacaatcaggtcactgattgttaattagcttgattaattaacactaattaataattagattgtacagtgtcacagttgatactgtacaattctaccacatcctttctaattttctgcctacctgttctatcaattattgacaaaggagttttgaaatctctgactgtaattgtagatgtatgtttctccttacagttctatcagctttttcttcatgtattttgaaactgtattattagatgtataaacatttagaattatgtcctcctgtttaatggactcttttaccgttaccaaatgactttctttacccctgctaatatcctctactttgaagtctgctttgatactgatatagccatttgtactttcttttgactagtgttagcatagcatttcttgttttatccttttacttttaacctatatttgtctttatatttaaaatgtatttcttgtagatagcatataccttgcatcctgctttttcatctagtttgaaaatatctgttttttatttggggtatttggatcatttacatttcctgtgatttttaaatttttttaaataataaaaataataattgtgtatgtggagtacaatgtaattttttttttttgagacggagtcttgctctgttgcccaggctagagtgcagtggtgtgatctcagctcgctgcaacctccacctcccgggttcaagtgattctcctgcctcagcctccccagtagctgggattacaggcgcctgcctctgtgtccggcaaatttttgtatttttagtagagatggggttttgccatgttggccagggtggtctcaaactcctgacctcatgatctgcccgcctcagcc

SEQ ID NO: 789 - DNA, 1031 bp, Homo sapiens
cgcgcgtccgcccccgtccccgtcccgtccccagcctttgccgaatgcctgttactcttagctctggacaaaatgcaaacccaaagaatgtgtgtttagcgcctgctgtgtgttaagtgtcgcctttcttttctttctttctttttttttttttttttgagacggagtctcgctctgtcaccaggctggagtgcagtggcgcgatctgggcccactgcaacctccgcctccggggttcaagcgattcttctgcctcagcctcccgagtaggtgggactacaggcgcgtgccaccatgcccgactcattttttgtatttttagtagagacggggtttcaccatgttggccaggatggtttcgaactccagacctcgtgatctacccgcctcggcctcccagagtgctgggattacaggcgtcagccaccgtgcccggccaagtgtcgcctttctaaagcagtctggtaacccctagtcttttgtaggctttgctaggctccattttaccgatgtagggaagttgggagctctgaaatttagttgacttgctcgtgaacttgaatttcacctcaggtgttcagacctctggccccactttggaaaaaacccgccaagggccacccttggggaactcgagggattgagtggtgaaggctcgacccaaaatttatggagagaaggaaatgttctgattaaggttgtgctttacatattaacgccttgttggaagactttgtgccctgcagtgatctagcctgtaatcttttgaactcatttagaaaagttatataatttgtggatttgtaattaatggaaaacttggattttttacgtgtgtgctagcatcgtctcaagcacattttttcctgcttggaatcgaaacaagatttctttacaaaagtactcacacccattttctctgtctagttctgggtatatctcattttctttgttaaggattttatttatttttaattaattattttaattacacaaatattgcatgaatacttttttccctatgaaacata

SEQ ID NO: 790 - DNA, 1025 bp, Homo sapiens
gacctcccagttccagacatcataagtggactctgcagcaataggtggatccagcaaaacctccagtgtctcctgttagactcgacaagcatccctcaaaattcaagattactgttctttagtcagctcactggtcttcgcattttaagtgtttttaatgtttgttttcatactgaagacctggctaatgtttctcagttaccaagactggaaagcttagatatctctaatactctagtcactgatatttctgcactgcttacctgtaaggatcgattgaagtctctcacaatgcactatctgaaatgcctggccatgaccaaatcacaaattcttgcagtcattagagaacttaaatgtctgcttcaccttgatatttctgatcacaggcaactcaaatcagacctagcttttcatttgctacagcagaaggatatcctgcccaatgttgtgtcattggatatttctgggggcaattgcatcactgatgaagctgtagaactgtttatacgactgcggcctgccatgcaatttgtgggactattggccacggatgctggctcttctgacttctttactacaaagcaaggcttgagggtttgttcttatctgaataagttttgtttcatttgtttagaacattattaaactcgtgctatagaccagactttttactaggtattagggttacagagacagataaaaaaatccttaaagagcttttttaataattaatgattattatgtacctactatgtggaaggttgtgagaatattattattattttttgagatggagtagttttgtatttttaatagagattgggtttcttcatgttggtcaggctggtctcgaacgcctgacctcaggtgatctgcttgcctcggcttcccaaagtgctgggatcataggcatgagccactgtgcctggccacacgtgagaatataatattaagatacaggctgggcatggtggctcacacctgtaatcccagcactttgggaggccaaggcgggcagatca

SEQ ID NO: 791 - DNA, 1054 bp, Homo sapiens
tcaggctccagagtagctgggactataggcacccaccaccacgcctggctaattttttgtatttttagtagagatggtgtttcaccgtgttagccaggatagtctcgatctcctgacctcgtgatctgcctgcctcatccttccaaagtgctaggattacaggtgtgagccaccacgcccagctgggctctttatttttatctgtttgtgtattgccttttttttttttttttttttttttttttgagacagagtctcggtctgtcacccaggctggagtgcagtggtgtgatctcggctcactgcaacctctgcctcccgggttcaagtgattctcctggctcagcctccctagtagctgggactataggcgtgcaccaccacgcccatctaatttttgtacttttagtagagatgaggatttaccatgttggccaggctggtcttgaactcctgacctcaggtgatctgcccactttggcctcccaaagtattgggattacaggcctgagccattgtgccccggcctactgtcttgattactataactttatatgaagtcttgaaattgggtaatgtgacttcttcaactgttattctgtttcataattgttttggttattctaggttctttgtatttccatataaatcataaaagcaacttgtcaatatctacaaaaaggactactggtattttagttgggattgcattaaatctgtaggtcagtttgaggaaaattgccgtttaataacgttgagtctcatgttgttttaaaaaatagaggcgaggtctcactatgttgtccaggctggtctcgtagtcctgggctcaagcaacccttgagcctcagactcccaaagtgttgggattacaggcattagccaccacgcctggcgctagtctcctgattcttgaatcctgtatatctctgcatttatttagatctttactttctctcagcatattttgtcatgtagctgggactacaggcgcctgccaccacgcctggctaatttttgtaattttagtagagatggggtttcaccatattgt

SEQ ID NO: 792 - DNA, 1068 bp, Homo sapiens
tccccaacaaatttatatcatgattttaaataaatcattaatcagtatttatgttatgattgtgttaacatcgttcactaaaaaatttatatcactgggccgggtgctgtggctcacgcctgtaatcccagtactttgggaggctgaggcgggtggatcacgaggtcaggagattgagaccatcttggacaacgtggtgaaaccccgtctctactaaaaatacaaaaatatgaaaattagctgggtgtggtggtgcgtcctgtaatcccagctacttgggaggctgaggcacgaggattgtttgagcccaggaggtggaggttgcagtgagctaagatcgcacaggtgcactccagcctggtgacagagtaaaattgtgtctcaaaaaacaacaaaacaaaaaacaacattgttttattctgtacttatttttttattttcattttattatatgaattttttttttctcgttgctcatgctagcgtgcaatggtgcaatctcggctcactgtaatctctgcttcctgggttcaagcggttatcctgcctcagcctcacaaaaagctgggattacaggcatgtgccaccacgcctggctagttttgtatttttagtagagacagagtttcactatgttggtcaggctggtctcctgaccttgtgatccacctgccttggcctcccaaagtgctgggattacaggagtgagccaccacacccagctgagtcatttatattttttgtaaactgtctattcatagcctttataagttttcttttgggttactgacttttttctactttataggattttttttttttttttttttagctttagtgatgttctttttttttttctttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcctgctgccttcaagc

SEQ ID NO: 793 - DNA, 1050 bp, Homo sapiens
tagacaggatggtggccgggcagagacgctcctcactttccagactgggcagccaggcagaggggctcctcacatcccagacgatgggcggccaggcagagacgcccctcacttcccagacagggcggcggccgggcagaggctgcaatctcggcactttgggaggccaaggcacgcggctgggaggtggaggttgtagtgagccgagatcacgccactgcaccccagcctgggcaccattgagcgctgagtgaacgagactccatctgccatcccggcaccttgggaggccgaggctggcggatcactcgcggttaggagctggagaccagcccggccaacacagtgaaaccccgtctccaccaaaaaaatacgaaaaacagtcaggcgtgacggcgcgcgcctgcagtcgcaggcactcggcaggctgaggcaggagagtcaggcagggaggctgcagtgagctgagatggcagcagtacagtccagctttggctcggcatcagagggagacagtagaaagagagggagagggagaccgtggggagggggagggggagagggagagggagaggggatttttttatacattaaggaaacaagcctttgactatgatattgggtgcatgtattttctcccattttactgtttatctatttttaattcatttatggcatggtttatgatgcaataattttttattttcacgtagttgaattcattctgttttactatgcatctgggatcgatggcacacctgcaaagtatttccctccatcatgaagtatttttaaaaaattctttgttttgttttgtttaagagacttgatctcatcctgtgctgaagctggtgtgtagtggcaagtggcatgatcatggttcattgcagcttcatcttcctgggctcaagcgaccctcttgagtagctatgtttgtagccaccacattcagcctcctcacgtttttaatcctgtgatttctgttcttttttttctttggaatttttttgagatgttgggtcgttcaagttttcttctctgtgtgtttct

SEQ ID NO: 794 - DNA, 1071 bp, Homo sapiens
attggatttgacaagaggaagtcattagtcaccttgattatgttatttcagtggggtggcaggccaaaacctgattggaataggatggaatagcaaatgggaggtgagaaatggatgtaactttttgatataatttaatgagaaggaaagcagaggtggggtcagtctttaaaaagatcgactacattaagacatattttgtgcccacgagaagagttctaaagagggagaagttgacaccacaagcaaaataaaaggaaataattttggtgctgaatctcagtatgtgcagaaattgagtttagagtagaataaagatgtttgctttagattggagcagaagggaaggcagagtatgttgatgcaaatgcaagtaggttggtagcttttgttaggaagagtgggtgtatttctcaatgaaaaagaagatgaaatcaaatgaggggagtgagaagatggtgattcaagtttgaagattcaagtttgaggtgattcaattttggtgctgaatctctgtatgtgcagaaattgagtttagagtagaataaagatgtttgctttagtttggagcagaagggaaggcagagtatgttgatgcaaatgcaagtaggttggtagcttttgttaggaagagtgggtgtatttctcaatgaaaaagatgaaatcaaatgaggggagtgacaagatggtgattcaagtttgaagattcaagtttgaggtgattcagttttggtgctgaatctctgtatgtgcagaaattgagtttagagtagaataaagttgtttgctttagattggagcagaagggaaggcagagtatgttgatgcaaatgcaagtagattggtagcttttgttaggaagagtgggtgtatttctcaatgaaaaagatgaaatcaaatgaggggagtgagaagatggtgattcaagtttgaggagagagaattaggaaatagtagtctttggagcaaattctttgggaaataaagtagtattgacaaatacggttaagtgtccttttgaaatttatgagcaggtattgaaattgagaccaggtgagctcagtcttcttc

SEQ ID NO: 795 - DNA, 1036 bp, Homo sapiens
tatatcctgtacaattctacatatcctaccagctgacctaaaagatcttccacttttcttatttatttatttatttatttatttatttatttatttttgtctcgctcttgtcacccaggctggagtgcaatggtgtgatctcggctcactgcaacctctgcctcccgggttcaagtgattctcccacttcagtctcccgagtagctgggattgcaagcatgcgccaccacgcccagctaatttttgtattttttttagtagagacagggtttcaccatgttagccaggatggtctcaatctcttgaccttgtgatccacctgcctcagcctcccaaagtgctgggattataggcatgagctaccgcacccagcccactttttttttttttttttttttgagagatccagaatgtgaggatttacaagaaaaatcttgggactcacctgtggtgcccctctcagttgtgctaagaatgtcttgttagggggtaacatatgatagacttaacactgaaatcatgcgtagatgagagatatagctggtcttgggaaaaacaggcgtgggggggacatctcaatttctgcttcaatctttagtgtcctatgtgcctcaatatactagtgtctagagtgtgctttcctgaatggttcatcagaagcagcagttaatgctaacacaaactgctgtgtttactttgactgtttcacctcattaaacctttggtttttcatttttgtagacagactctcccagtgattccagcctcctggcactgacatcccctacccttgagtgtggacaggacctgtttcttgattctagccaagggaatatggcaaagatgataaaatatcactcccatgattatgttactatatacttatatatatgtatctgtcttgctagcaggcccactgtagggactctttctctctggccctgaaggagcaaacagtcatgaagtaagtggttggaggagggagaagcccaccttttaaggaacttggggcagcttctaggagccgaacgtggcc

SEQ ID NO: 796 - DNA, 1420 bp, Homo sapiens
gcatatgacttacttcggtcctctttctcatcagctttttttttttaaaactatttactttattgatgtttctttttttttttttgagacagggtctgtctcccagggtggagcacagtggcacaattcacagcacactgcagcctcaacctcggaggcttaggtggtcctcccacctcaacctcccaagtagctgagactataggtgtgtgccaccacacccagctaatttttgtattttttgtagatggggttttgccatgttggccaggctgttctcaaactcctgagcttaagcgatctgcctaccttggcctcccaaagtgctgggaatacaggcatgagccatcgcgcctagccaacttccttatttctaaataacatattatgctgctgttcttgactttatcgctttaggaatctatcaattcattttcccactttgggaaactaagattctttttctcactgtttctatgcacagcctttctaagtgtatactcaaggtataaatcttcatacatattctgtacacttcaccttctcaggactttcttacctttgcattccttccatgtggtctgcttgttttgtacaccgtatatggtggactgctgtcatcctcggactccctttgcctctcttgtgttggattccgtgtttcctggcttatgtgcctccctgtatcttggtttactcccaccttttgttggaccatattctccagtagcttcctaagaaaagagtcttgaaatgagaccatacctgtttaaaaaggcctttattttaccctcacatttaattgatcaaatggctgggtatagaattctagctttgaaatatttttccttcataatttaaaaatgtttgcttcattgtcttttacttgtcaggatcactgttgagaactcccatgcaattttcttttaagctttaaggtttttgtcctttgtcctcagtgttcagaaatcacaatggcttaccctgtgggtttattttcatttttttgtttattttttgttaatttttttcttctttgtgggtttattttcatatattttgttgagtacttatcagtcaggaagctcatttcctccctgggacatttctttaatcatttttttctgggatgttggccttcccagactcatcttttcatatctagctcatttatcttttttgttctgaatcctcttctaaaaatataatatcctgtttttgtttcatagttctatatctatttttctctttgaacgtaataatgataattttaaattttattttattttattttatctttttgagataggctctcactctgttgtccaggctggagtgcagtggcaccatctcagctcactgcaacctccgcctcctgggttcaagtgatactcctgcctcagcttcccaagtagctggg

SEQ ID NO: 797 - DNA, 1035 bp, Homo sapiens
tggtgacctataggtaatttcatggtgttgtgcttttcttcttttttttttcttcttttttttatttttgagacagagtcttgctcagtcgcccaggctggagtgcagtggcacaatcttggctcactgcaagctccacctcccgggttcacgccattctcctgcctcagcctcccgagtagctgggactacaggcacccgccaccatgcccggctaattttttgtatttttagtggagacggggtttcaccatgttagccaggatggtctcgatctcctgacctcgtgatctgcccgcctcggcctcctaaagtgctgggattacaggcgtgagccaccgtgcctggcccagtgttgagcttttcttaaaggctgtactcagtgatacagtgataacgtgttagagtcagttagccttatgttcaaatcctatttctctgatattgggaaagtcatttctagaaggtcagctttccttgtctgtaaaatgaggctgacagtgtgcaagattgaggatgcaatgagatactgatcataataaagggtttaatacagaatgcaatttcttaaataatagcttcattgtatgctcggtcacagggagaagttgaccctgtggggaaaatgtttaaaatttgaaaattctttttttttcaaccttttgagtcagggtctctctctgttgcccaggctggagctggaatgcagtggcgggatcacatctcaatgcagccttgacttcccaggctcaagtgatcctcccacttgaggatcctcccacttggccctacaggcgtgtgccaccaggcccagctaattttttttttttttttttttttttttttgtagagacgggggctcaccttgttgcctaggctggtcccgaattcctaagctcaagcaatccacctaccttggcctcccaaagtgctgggattacaggcatgagccaccatgcccggctgtgaaaattatatacattattatattaattatatagtacaaattattatatccctgagcactggcctaac

SEQ ID NO: 798 - DNA, 1049 bp, Homo sapiens
gtatcccttaagctcaggatttcgagtctgcagtgatctatgttagtgccactgcactctgtcttaaaaaaataaaatcccctttgagaattttccgttgatatcctttgttgagacttgttatacaatttttcattgtattataggagatataagctattattttacaacaggaaacccaagagacaacttttagaattaaaagtttagcttgttgactagctgtaaagcaagtgtataaaaaccaatagttttataatgccagcaaaaatcagaaaatgtaattaagggaaaatataccaccactcactttattaacaaaaacataaagtattttaaaatgcctttaacaggtaatgagacatgcagtaaactatgagataatttaaaagcctgaaataattatgagaccattccattttctaagatggaatgacctattagatatatagatgtcatttcttttcagtttattaatgtaatataattcaactgaataggtaagagatggaggatctgaaaattattctaaagtttatctgacagaatcaacaggaaagaactaacaaaaatgtttgtttgtttttttctgagacggagtttcactcttgttgcccaggcgggagtgcaatggtgctatcttggctcactgcaacctctgcctcctgggttcaagcaattctcctgcctcagcctcccgagtagctgggattacaggtgcccaccaccacacctggctaatttttgtatttttgttagagacagagtttcaccatgttggccaggctggtctcgaacttgtgacctcaggtgatctgcccgcctcagcctcccaaagtgttggaattacaagcatgagacactgcatctggccagaaaaatgttttttatgggctcagcctggtggctcagacttgtattcccagcactttgggaggccaagataggaggatcacttgtgcaggaattcaaggccacagtgagccatgatcaggcaactgcctacttccagcctggggaacagagcaagactcctgtctctaagataa

SEQ ID NO: 799 - DNA, 1030 bp, Homo sapiens
agaccttgggcaaatcatttaccctttcttaacctcaatctcatcctctctccaagggagaaagatgaggatagaatgtaaacaataatactgtctggccaatttgcagatgtgtaaactgacgtagagcacgaggtcagagttcaagtctgttagaagagtccacttcctgagtttttcccagctgtgctgtctgagctctgaaagcactgtgtcccagccgcgaccaactttagtggacccaagtcccaacccaaaaccctctcacctccgttcctcggtcaatggctactttgcccagccgcacggcaatgggggcctagggaaaagcaaaaagtcttggttgaggagggcatcaaggctgatagttgcaggtctgaggtgcacagctttgttttaaaggagggaggcagatgtctgggtctggttccagccattctgctgacagtttctttagcgttagtcctataacctgttagctgaggttctttttctatcatgaaagaagccagactctgatccctgaacacctgggtttcttgttattcagcccatccttccaacatgcacaacataactagtttacaaagtgctttcctcccccacagactcatctaatggtgctacccacacttctaggctggtgtcatcactgatgacccagctgtgattttacagctgtgagattgcagtgcagggaggtgaagcacttggctgtgtttatccaatcattggtgagacttggattggactcccaaccacctttcccacttcctcgacctcatttcagcaaatgccagcctctgcggtaaggttttaccccagcagagtgaaacaaagtcagggttaggaacttgggctttcaagtcgacagggctgtgttgaaatcctggtctgtggggcagtgcagaggggcgggtgcattttaatacagccacatagaagcaacagtgtctgctttgtcactggccttggttccacaccagccctagcactccagtctcagccccacttccaggcaaggaggaat

SEQ ID NO: 800 - DNA, 1065 bp, Homo sapiens
cttttaatttacatcaccgttagggcttagaaaacaatacaccaaaataaaagcctcagaagcaaaaatttttctctggccttctcctggcctcctgtctctcagtcccattctccccaccaaggccagccgtagaaactagaatccctcttcctcaaggcagatcatgaaagccataaccccttttccccaaagccagtcataaaacctagaatactactataacttcccttcacctttctgtgtaaaaactagccataaagaaattatctgacctatcttgtttgactgggggtcataagacccccattccagaaagggacctgccccacgcccagaaggaaggaatgcgtgctcagagaggccaagaagaacctagatggacaggcctggctgggtttccccactcagtctattagcattagatcatatgctttttgtccaatcatatttctatagggctgttccatactttgttgaacttaagcataaaatggacaacttcccctgtatctttgggtctttattctgaatgctcctatgtatacatgttaaataaatttgtataccctttctctaattaatctgacttttacaagttgatttttcaggaaaccttcagagggccaaggagcatttgctccctttgcccctctctacgtaaccattccccagttacttcacttctagattatctagtttttcactgttataacagtatgatgaacagatagctttgtgtgtaaaactttccctacatttgattatttccatggaatggttttgaaggcattttaaagactcttcataactttgtacattgctttccaaaaaggttgtcctggtttaaactttgaccagttctgtatagaggtggctatcttgccatagtttcccctgcattgattattcccatttttacatattcttaccaatttgattggtgtaaaatggtatctatttgatttttatcaatggtgagattgagtattttctcaaatagttgtaaattgcatctgttcttttgtgaagacaactagcagcgtatctaagaccagtttgaat

SEQ ID NO: 801 - DNA, 1030 bp, Homo sapiens
ctcccaaagtgcagggactataggcattgagccatcgcgcccggccaagcttaattattttatatgcttactaaagatttcctttggataagatttgcaacatctctgttcttagggtttttgaaaattttgaaaattactattttataaatgttgaaaaacctagtacctatgtgactccatgaattgaaacagtttcttttccccagttcttttagaactcatcaaattgaagctgttccaaccagctctgcaagtgatggatttaaggcaaatcttgtttttaaggagattgagaagaaacttgaagaggtaagatttatgtaaaatattgccaggaaggaccttgaggctagaggaagcagacacaggtttcaggtgttgccacgaggtggtacaattgaaaatttatatcatgttgtcaagtattgagtgtagttagatttctgagtgtctattaaggcttccttgtaattctaaaaggaatgcatttcagaaatgtatgaatctccagatttgagctaaagaactataataaatactgttaaaattgtcactcttttctaggtcctctttgtcagagggtcattcagtcatgggcaaagttcaaatataaagggattctaatttattttgctgtaatttcctttgaattaaaacggtcttacttaaaatcatttcaaagaataatatttaaaatgagccttttttgtatatatatcaaaattctttgtaaaaagaaattgtgttttgatttcttaaagtagttaaaaaatttttttgttttaaaaatgatgttaatttaaaaaatactatacagaaatatatgtttatgaatagtataaattttatactatacttttgttttaaccttttaaacaaaagtttaaaatctccccaaattctgccactcagagtttactgaaatgttaacagtggttaacattctttcagacatctttctctgtgtatattaacttacagttttaacctagggtcaaaaaaacctattgttttttgttttgttttg

SEQ ID NO: 802 - DNA, 1132 bp, Homo sapiens
agaaagtcatgtgacctggataaataaatgatctcagggctagatagtgtagaaacatcagcaatcttaaaacaaaaaaacaccaagtaatgaattttctttcttcttcacaggccttctttcaaggcaaattgaaaatcactggcaacatgggtctcgctatgaagttacaaaatcttcagcttcagccaggcaacgctaagctctgaagaactccctttggctacttttgaaaatcaagatgagatatatagatatatatccatacattttattgtcagaatttagactgaaactacacattggcaaatagcgtgggatagatttgtttcttaatgggtgtgaccaatcctgtttttcctatgctctgggtgaatagagcctgatggtatactactgctttgcggaattgcatacaactgtgcattacaaagttaatatggtaattatggtctggggtaaaattgagtttcagaataaaattaggaacagtaaaatccaaagaactatgtaaacaaaaaagcttttgttttgcttacaaagtatatttaaggattattctgctgaagattcagtttaagagttttccttgggagaactaagtaagaaacacaatgccaacagctggccagtaattagtgttgtgcacttcatgtcattaatcaatttctcaatagttcttaaaattagtgagattaaaaatctaaaaattttgcatttcatgctatcagaaacagtattttcttcccaaatcaaaataaaagaaatatgatcagagcttgaacacaggcttatttttaaaataaaaatatttttaacatgggtttccttattgaaaaatcagtgtattagtcataaaacaccatcattaagaataattgaacaataaagtttgctttcagatgcagttttcaaattataatctcatttcaatttataacgttctcagtcctttgttataattttcctttttcatgtaagtttaattatctgcatttatcttttttcctagtttttctaatactaatgttatttcttaaaattcagtgagatataggataaaataatgctttgagaagaatgtttaatagaaaattaaaataactttttctggcctctcttgtttttactg

SEQ ID NO: 803 - DNA, 1051 bp, Homo sapiens
atgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttgaagatggttcttaatttcttttaacctaattcctaatcctcacaaagatctttccaacagcaagttcagtaagttcaggtaacagtacgtcaccattggcttctggctcattgagtgatggtgggatcgcggtttcatctctgtaaacttgcccttgactggggagataccatctccttaaaaatactcttcattttcctaaggagtgaactgctgctgcacgaattcttatttgtggagggagtagctgcctccttacttcaccttcatgcaccagtgcagcgtgaacaggggctttattgatggggcttgggaagctgtaataaagtccagcatgcagattgtgaaggtttcgtatagccaccaggagacaagggtcaaaggaacgagcctctgtgggctctgctgctta

SEQ ID NO: 804 - DNA, 1131 bp, Homo sapiens
agaatagaaagagcagtggtttgaggtctgaggacccttcttggtctaccacttttactaccagttatataccttcagaccagttatttaaccactttgagcattggttttggcctttgtaaaatgaggataataatgaatgtcctggctgggcgcggtggctcacgcctgtaatcccagcactttgggaggccgaggcgggcagatcacgaggtcaggagatcaagaccatcctggctaacacagtgaaaccccgtctctactaaaaagatacaaaaaatcagctgggcgtggtggccggcacctgtagtcccagctactcgggaggctgaggcaggagaatggcgtgaatccgggaggcggagcttgcaagtgagccaagattgcgtcactcactccagcctgggtgacagagcaagactctgtctcaaaaaaaaaaaagaaataatgaatgtcctccctacctcccagggaagtgtattcattcaacaaatattttttgagcatctacaatgtgccaggcactacgcttatggccttgaggactcaatgctaagtgtagtactctctgacgtgagaaagtaatatataagaaaggattctgaaaataatgcaagttggtaagagtggtgatagtatctgtgtctaagttcccttgaatatctttttaaaataaataaatgcttttactttggaggtgaaatggccatgaataaagtatgataaaccattgtaatacatgtttatgtatgttttcatatggttccaaattaaaccctttgggataactacctggttcatttatttttctgctcacccccaactcctagaaagtaagagctgtaaaggatctttagggatcattgagtgtggctcttttatattacaaatagtaaagatcagacctctgtatttaatttactttgaaaagtttgccaactcaaatgttttatagtttatcattgcccggacgtttttctgagcttatttttggttgtcattttaacagcatttatattgtgacagaatgctacgttgtttttgacatctaggtaaccctgagatcacagatgcaggcattggatacctcttttcttttaggaaactaaactgcttagatatctctgggac

SEQ ID NO: 805 - DNA, 1032 bp, Homo sapiens
ttccactcacctgtcctcattctcatctcacaagggtccacttacttccctatttctgtctcagaatttctccatttcttcaaccgtattacacttcccttctatccgagagaacaagtatgctcctttattccagtcacaagccctttttttcttttttaaaaaattctgttccctaagatctccaacttcccttgtgctatttactaataattattttcccctcctgcccaccccccccccatcttcattgtccccctttgttggctatctgctttctgtggataaacacaaggtgtccttattctagcttggtcctcattccccagtgcagctgtgcattgtttcctgtccagtctgtcccaccccctccttgcctactcagttcttactcccttgcgatttagttctggcctcccctgctctcctgacagtgtcctcttgaaggagatattcttcaccttccttggctttcctgcagcattcgatagaaacatgcatgacttatgtatttttctctgggcctctctcctggctctcccccaactttctcactcctctggctatgactgattcctctttcttcctctcctcttctcccacatctccacactccccaggtgctctttcactgttctcagagctccagctgtccttgcgaggatgactctgcattcctctctcagacactagactcattcccaagtatcctctgtaaatctccacctgccacctcaaattcagcttgtcccgaaccaaactcattttcttcttccccatccccgaccagctcttattgacattcttatttctgtttagcggaaggaagcaccattttccctattgcccactgagtcaacatgttctattaatccatcctggtgttccctgaaatctgttcccatttttataaccagaaaattatagaaaagatggcaactaatatttattaagtgccttttgtgtgccagacactgtgctaaactctttatgtgtattatctcatttaatccttaaaacagccctatggaa

SEQ ID NO: 806 - DNA, 1049 bp, Homo sapiens
ttttttgtagagatagggtctcactatgttgcccaggctgatctcaaactcctgcactcaagcgatcctcctgccttggcccccacaaagtgctgggattacaggcatgccaccatgcgcagcctgtcattattaatgttatcatgaaattccctttgtgatctgaaatttatgactctgctctgtttttgtctagtagagggtttcccagactccttctctttcttgccccagactgaattgcctttttgctgttagtcctctttggaaattcttccctcttgctgacaagtcgcatcccccactgggctcctttacagccctacctacgcttcctgggctggtttggctggtgttgacagaacactcctgaccagtctgggcatggctcttgtgggagtatctgagggatgtactgccccctgcaggccaaaagcagtgactccactgtccggacctgagagttgaagctttctgtccttcggccacctctcagggcctgtgctcttctgattttggaataccaagaatgtgaataacagtatctcaatagagccttattgaagacttcctgtgtgccagtccctaataacagagaagtataatgtattaggggttaagtgtgcaggttctggaggtggagtcaggctgcttgtgttctaatcctagcttccacacttattagctgtgagaccttgggcaaggtgccttactgagtttaggtttctcatttgtaaaaagagatataataatggtatttaagtcattgttataaaaattaaatgagataattcatacaaagcctggagtgataagcaggaaaaattctcagcagtggataagaattagaaacttttcattttctcagcacctttggattcatttctttacagtatagtttcattattttgtttgcagttgtgtgattttcctaatcacctctatccatattcaaatgtcagtacaaaaccaatttgaaagtcaaatgtaaatgttttttatttaactgattcaattcagcaaacatttatggattgtctcttctgtgc

SEQ ID NO: 807 - DNA, 1032 bp, Homo sapiens
aaaagatttaaaaaacaaaaacaaaaacagatattttaagaaaattttaaacattcaaaagaaacccaacaatttaaggcaaaggaaagaaacacttgagattcagtcaattagaggttttttttttttgacaaatgaagtttaaagttgcccaaacagatatcattagagaatcccaggtttgaaaaatggcaggagacccagataatgcatttactgtgttctgtggtgaaggaacaggtagctggcctttttcatttatagaatatcaggttcttaaacttgtgcctgtcaaccttggttttcttttgctgtagcctcaggcctcagaaccttactctgagattggtaatgtgttttgaatgtgtttatcacagccagatggggcaaaggctcagtttgttactgcccattattgcaagggaagggagtccatccagaaaacaaagctttgggagtttcagttagttgggtgacactaccctggtatcaaaggaaagatggtttgattggatgacattgtattttctttaaatcaatcaaaatgatacaattactgtcagggatggacttactcataacctggggaggttggtttcaagatccaagaagatcaagacatccaatcaaatgctggtttttaatgttgataaaatcattctttcaatacatatttgttgagttcttacgtgtcaggtattagggtcacagggatagagaagacataatctttggcctcaagaagcttacagtctagtgaagactgtaaacagacaataaacagacaatttttactatttatttttattttgggagggggtcagggtctcactctgtcgcccagggtgcagtacagtggtgcaattacagctcactgcagctttgacctcccaggttcaagcaagcctcctacctcaagcctcccaagtgtctgggaccataggtatgtgccatcatacctggctgattttttattagccagattgtcaccatgttgatcaggcttgtcttggactcctggcctcaagtgag

SEQ ID NO: 808 - DNA, 1027 bp, Homo sapiens
gccagccaccatgcccggctaattttttgtgtttttagtagagactgggtttcaccgcgttagccaggatggtcttgatatcctgacctcgtgatccacccgcctcagcctcccaaagtgctgggattacaggcgtgagcctaccatgcctggccaattttttgtattttttagtagagatggggctttgtcatgttgcccaggctgacctagaactcctggcttccaatgatccacctgccttggcctcccaaagtgctgggattataggcatgagctactgcgcctagctgcgaaagcctttagtaccaggttagagtaaccatttttctcccttttagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggtaaggatcaatgtcttggacttttaggcagtgtggaggagaaggacatgctttttctggagggaaaggatatactaagaacttgctaggtgctaggcacctcgtgtgtattacctatctcctaggatccatgtggcagccccatgagacaagtactattatctccatttcataggcaaagaaactgcagctcagggaagttaagtgatttgctcaaagactaactttactttttaccttggagaagtaactctattacatcagagtggcttgagggacttttttttttcttcagcaaactgtatcattgggcgtttgaggggcttttcaccaaggctttttctttattcataggtcccatgaaaggcacccattttctgtttaccttgtaaactctggccaaccccctttaggaactgaggaagccccatagacattgaatggggccattaatccaaactccatcaagcaagggaccaccatgtactccgtcaggcaag

SEQ ID NO: 809 - DNA, 1046 bp, Homo sapiens
atttgtcactaatattaaagtagtaaattttgcaaatgacttgctttcttttgaataattaccacagatttcaagttctccttctcctaacatcactgtcatctgtgtgccagaatgagagagaaaggtgtggagttagaactagcttgcaggcagcacctataacaggttggcaggcattttctgtgaagagtcaaaacagtaaatattttaggtgttacaggccacatatggtctctgtcacagctacccaatagtcatacgtaaatgagtgaatgtggttgtgctccagagaaaatgttatttacaaaaataggtagcaggccagatttggccagcaagctgaagtttgccagcccccgagctatagtgatagtatccacctttgttgagtctctctgtagcacctgtccctgggctaaggcgaggtgactttcctgaggctttgtggcaggctgatgaatcctttccacccctccacataattgtgtctcttgcaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatggggtatgtaggtggagaagaccactgagttgctttacgtggtgttggtctcctcccttaaggttactgctcagaggaagaaaagggatataggggaactgatttcttgactgaggagttttagggaggagtacttcagcccaccctgtggagatgagccaacatcactagggggtgactgcctgtgcttcacctaagtagctcacttgatcacagtagcccacatgtttttactgaagtccccactttctaagctatgccatagaattacagggaggccatgcagcttatcagcattacacagcactaagtggtggagataggactgcagctaggtctgccccactctgaagtcttcagttgtttgtgctgcagcatgctgcctctgttc

SEQ ID NO: 810 - DNA, 1027 bp, Homo sapiens
gaggccaaggtgggaggattacttgaggccaggagttcgagaccagcctggccaacatggcgaaaccccatctctactaaaaatacaaagattagctgggtgtggtggcatgcacgtgtaatcccagctactcgggaggctgaggcatgaatgttgctttaacccaggaggcggaggctgcagtgagctgaaagattgcaccactacactccagcctgggtgacagagtgagactgtgcctcaaaggaaaaaaaagaaaaaagaaaaggcaaccactgaactgaaatttcagaacatggcattatttaatccttgtagttttttaaccccatgtggcagatgctattagcttcattttatagatggtgaaactgaggctcagggaggctaaggaacttgcccaaggatacacagctaagaaattagtagctgtcagatctttatgtgaccttgtgtctttccaatcctaggacaattgtctttattcccattctctgactatatacttcctgaaggctccgaaagattaggtaacttgtccaagatcccacagctaatgagtggggaagcaaagcttggaacatgatctctccagttttgaaggatgtgctactcccaactcaggcaggagaaggaggcagagatagtcacaaccctggtcccaggcctgcagactcgctgtagcctctgtgccagctattgccatcagagtctgggtagcaacgatacaactaattaccacccagttgggtaggagtggaggcctccttcagcccctccaggcacaaattattcctggggatgtgaagttgagcaattatgggaagagcctccatgtaaaaggtaaaattgctgagaaatttatgtactacctgcagttttattgatctgtagagggagataagagtcaatacagaattctcggctaacacttacaggtacttttctttttatttatttttcatgcagctaagaacaggtatttctaaggccaacagccccagtgtggcccacactgaggtctgac

SEQ ID NO: 811 - DNA, 1127 bp, Homo sapiens
tctatcagcatttttggtgtctcccagtgatcaaaaagagagtggttgtggtaagttgagccatctcctgcctgacccaggagggccatgcctcctcctacctggtgtgagcctcaggtgggattgctggggtgctctgtgaggagagccctggccctggggacttcccacccgggatctctgcctggaggactccttcagtcccgcccctacctaaggccctgcccagtgctccactccagctcctgcttccctttgcaccctccagccaatccagctcctcgcagctcccagggtgctctgcggcttcattagctctggcctttgtaggtgctgctccttttgtctgggaggcttcttgccttctcccctccccattactgtttgtcaggctatcctccacttgtccttccaggtttagcataagtgtttcttattttgggaaacttctgaccaccaccgtccccatcccaaccctcacttaagtgcctcaggtgggctgccctggcctccgtattcccccatcagagcacgatcacattgctgtgcgtagaacctcttcacatgttttttttcctccaccaaacagaactccaagctcctagatccttgagggcagggtctggggatgcattcgtttcatcccacagatacggagttcctcctgcggcaccattgtgctgcaccccactgctcagctgacggggtccaggcctgctctctgtgtagtgggcagtagcagtatctaaataaattcctgatagagcatcaggcagtaatatgcaccctggagagacctacagcagggtcaggactgcgaaagcggagtaggggtactgcctgctctgggaccaaccaggccccacacaggcctgagtgtgggcttgctaaatggagtcgctgagcctttgaacattctcagcaggtccgttcttgaactggttctccagcagctctcagtgctgtttccacctgaaatgcctgctgggtctgtgccctttgctttggccccagacaccctcagttcacctgcatagtcacaccagccacctccgtgctctctgctcttagtcaggttttccctcctgactctgtgtcttcaggttctcttccctcagcctctccct

SEQ ID NO: 812 - DNA, 1135 bp, Homo sapiens
aacaacccctggcataaaaggggtgctcagcaaacacgagtggatggatggaaagaaggaagtctatggaggctcaaagtgagatggtctttgtggcactggagggctgacatgggaggcaggaaaccaagggcatggctgaattccagaaaccagatgccaggttctgcggctccgcaggcaccctgggaatagagagaacacaacctctgcctttcagcacccaccctcgttggtctgatcttttacatccaacccccagccccaactccaagcccccagtgcttgtacccagtgagcccagggctgggcagagcaacgctcatccgcctgtaaccccaccctgcccagccactctgctcaagtccaggggagccccatggcctgaaccccaagaggcccagctcccctcagttcagggtcagagccctctgagggaccccaggtatgttctgggctcaatctcctggagtctgtggaatctgggaacacagcccaccacttcatgggacagccgagactggggcgggggattcctcaggtcaccagggagccagactgagcagccttcttacccccgctagagccctgctctggcctagcgcgttagtggctatgctgctgctggtgtcagcgacttgccttaagtttctttcctggctctggggcagggggcagtggggatgcccagcagggaggcaggtgtggggtcctgtctcaggcctggtcctacctctggccccccaggccggccgacccctagaatcaagtgcctgtggacagcgatgactccagcaggaaagctgtggtctggcccccgactccggcacctctcagtgatgggccgaagccctattttgtggaaggactggcatgatgctcccttttctcctcctcatttcagtatctttccactggctcatgtagagctctggcctggccccaggcagtgatgaaaatgcttagtgaacaagaaccagttctttgctcagagatctgcccctgaggaaggccaaactaacctgcaccagggccatttgtgttgtgaaggcaactgccaggctgccgaggggccccaggctgaggggtagcacagcacacagcaggcgctcttcccaggctgggccccgtgacc

SEQ ID NO: 813 - DNA, 1008 bp, Homo sapiens
gttgacatgatgaaaagagaaacaggatggattgtgtaattcttactgtctcaacccaaaaagtgacttggtcactcaagtaaggtgtttgatgtatgaggcagtatgttctgagatttttgagcccaagggcttctactctctcaaaaaatgtgtttttctggccttttatcctcttttcaaggatgctagcaggagtaaggcagtagagatctttaggtgagataagctattttaatctaagggagaatatctcaaagcgttctgtgggacctttgagttaaaaatattttttggttgggtgcagtggctcatacctgtaatccaagcactttgggaggctgagacaggaggatcgcctgaggccaggagttcaagaccaacctgggcaatatagtgagaccctgtctctccaaaaatttagctgggcatggtggtgcctgcctgtagtcctagctacttgggaggctgaggcacgaggatcgctcaaggctacagggagccataatcacaccactgcactccagcctgggtgacaaagtgagaccctgtttctaaaaagttgcttggatgaggaattttaactcatttatttattcatattttttactttattacatttttttgtagagacagggttttgccatgttgcccgggctggtctcgaaattgggctcaagtgatccatccgcctcagcctcccaaagtattggaattacaggtgtgagccaccgcacccaggagattgaggaagtttggaaaatgctgcttcttagagatttacagtacatgttaacatgttaaagacactgagatagcctgcaagaaaataaatttaccctgggtttctcaaattttgtaagcctcctcttcaggtaacaccaacatcatgcaggttctgtagtcgtaaatttgggaaatgattatttaagtagtattgctggtgactagtcttggttatgttagacctgtgggttttttttaaaaataatttatttttttaattga

SEQ ID NO: 814 - DNA, 1008 bp, Homo sapiens; identical to SEQ ID NO: 813

SEQ ID NO: 815 - DNA, 1008 bp, Homo sapiens; identical to SEQ ID NO: 813

SEQ ID NO: 816 - DNA, 1008 bp, Homo sapiens; identical to SEQ ID NO: 813

SEQ ID NO: 817 - DNA, 1005 bp, Homo sapiens
cttgtgtgctagtgtggaagccctgaacaatttaactccctgggccttgttttcttcccctcctaaaggataacactggagtagcgaatctgtgaggtcctttacaatgctatcattaaaccgatttttaaaagatttaactccaaaaaaatgggtatatttaattattcatcctggttaatgaaaatttgagttcctgagtctgaaatgtagatgtaatgtagaacaggggaaaaggaaacatattttcaatacttcagtgataaaaggtacaatttgattaagttgttactatattctaatcactgtatgatatatgcacttgatttttttttattcccagagtaatcctctaagtttggtattatctccatttaacaaatgaagaaattgagaatcagatactttaagtaacttgtccaaagttccagtgctattaagtggtagagctagcaatcaaattcagggttctcagactgcaaagtctctgctctatggactgtaaagtcaaaatgcctagtatgttctgagtttcaaacctacaaggatataattttctatgtctgctcatatttatcagaattgagaaaataagatttaaatgtctttcagtccatatttagagataaataacgttttttgaaatgccatatatagatgattaaaatttatatttttacttttccaacatttacttggatgcctcaatctttcatttcttattataaaatgtgctgaattctaccagttttaacccatgtttattagaaatactagtgatttcagtgtgtttactgatatgaaagtaatcttttttttttttttgagactagtctggctctgtcgcccaggctggagtgcagtggtgctatctcagctcactgcaagctccgcctcctgggttcacgccattctcttgcctcagcctccccagtagctgagactacaggcgcctgccaccacgcctggctaattttttttttttttttttttttggagacagaa

SEQ ID NO: 818 - DNA, 1021 bp, Homo sapiens
agccaggatggtcttgctctcttgaccttgtgatccacctgcctcggcctcccaaagtgctgggattacaggctataaaggtaatcttgactagtgattgccagtaacctttagtaaccagactaaagagaacttgtacaaatgatttgatgttctagaagaaaacattggtataagaaggtattagctctggaattaattccatttctactaccagttgtctcacctttgggaaaaaccattagatgctgagcctttgtttcctccttcgtaatatggcaatgatcatacttgtcctgcctaccttctggaatagttatgaagatcaaatgagttgaggtatataaaatggctttggaaaagataaaatgctatacagatagatgacacttgtggagatggtgagatgcatggcaattgtaggtaaattctgcaccctgtgttagaaagtacttactttccattgaaatgccttcagttctcacaccaacattgagatagagctgtagtaatctgcccctattttgtggttgcctaggttgaagaaagctcttaatgactactttatctgtgctttatgatacttattaatgtttatattaaaaacaatatcctgtatgactaagtcatgtaatttgctttttcccaaatatggaagatgaatgaaacaagaatgaaatggaagtaatagttaaataaaagtgaatgtacacacattcacagtaaattgattttacttttgaaattatgcaaattctaaacaagtgttaaatattggttccaaataatgaaattatgtttcttctcaaatactagattagtgattgaattaaaatcagttgaattattctcacaattaggtaaatacgtgctatttaggtttctcttgctgatatatatagatatatataatatatatataatttatatgatttttgaattgtgtccttaatatctgaatggattttgttcatttggtgtagccagttgattgactttcaaagggtattttaaataggaa

SEQ ID NO: 819 - DNA, 1024 bp, Homo sapiens
agacatgagccaccatgcccagcttttttttttttttaatgtgtttgagtataagttggaactatatggtgttccataattgattccagtttttccagtcttaattaatggaataatacaatcaatataaagtatttgctgtgtttagtcatacgggattttaagcaaaatgttttttaccagtgttcatctgctcatgagggatcttctcctatgacccaaacacctcccattaggccccatctccaacattggagattaaatttcagtgtgagatttggataggacaaatatccagactatgtgaagtggctaaaaggcagaagaactaggaagagtttgagtcttgtgaggcaacagttggagttcgcagtttatcaaggagagtctgataaacagttgggtttttggctgcaaccctctgaagacggatatcctgcttagaataagcttaatctcagattgatctgcctcttacctttcttctctgggggaagataaaactgtcagagcctctacagattttcatacacaatgttcagcattctaagagacagggtgaagataatagaaacaggtttgtaggggatgcagatagtaaagatatcaaacacagaattttaaataactgatacttttgtttaaagtggagaatattagcagaggactggaatctataaaaataaaggaaattctaggactgaaaaaatacaataattgaattatcttttagatgattaatagcagattagattccattgaagagaggattagtgaattagatgatgggtcagaagaaaatacccagactgaaagatagacaaaaggatgaaaagaaagtataagacacatatgagaacacagtgaaaagtctaatacatgtattattggaagctatatagaaaaagttaattgcaaacctccatttttcttttctgtaaaatggtaaccccaggtttaccttcttttaatagagtttctctggacatagactaagataaatgtgatttatcagttctattgc

SEQ ID NO: 820 - DNA, 1011 bp, Homo sapiens
ttgtcccttcttaaaacaaattacctatttgtaaactgctgatttctttgagtcattgttcccataaacttttcataaggcctcaatgatttcaccatacttccattaatgcttcgatataaatttgatgtttgtttttgctttaacattagcagaattcatgttgctttaatagggactctttttaaactgttgcttatccttcttagtgcctcaaactagatcctgttcagacatgtaatagtttattttggtacaaaagttttttgatatccatgcatagttttttcataatatgcatttccatgaattttttgaattttttaaatatttttctttttagttcagatgttgtttctggtctaatatttacttgtttatatttaataagttatttttactttaaaaatattttgatctttttttacatgcatgtttgtgtgtgcagtttctggtgtatttttaacagtagcaataggactgttcaggactcttaggaaatgcaaagagagcaaatttttttccccttgagacttgctttggagatagcaaggtatagctttgaatcacagctccaaaattgattgcttatatgcaatttggttaagtgtcttaaactctgcgagcctgggttttctcttctacaggaactcttgtagaatttaaattaaaaaatatataaagtgcttaatgcatttatatacatagaaacacatgtatgcataagtatatgtgtacacacacacacacacacacacacacacacacacacatatatacatacatacaaacagcttgctaagtatgaggcacgcattaccattactattagctgcctttcagaattacctgttttctattgatatcataactacctttcctcaattgctttatcttttaggccccagaattgtctggtctttcctgccttggatatccgctctagctagttcctatcttttttttttttttttgagacagcgtccaaaaaaaatccaggccagagtacag

SEQ ID NO: 821 - DNA, 1080 bp, Homo sapiens
gttgttggaaaaataaaacgagaaattcaaaatctaaaactctttcgtcatcctcatattatcaaactgtaagtatttttgtatctaataataccaaagagacacctatcttaaaatgttttttaggaattttataataattgttaattgttaaccttttacaaagattttttttcatgttcatattcagcaagtgttaattcatttaacctttatcagtcctttttttgcatactcttggttagactgaacagacattgtttctaaattagtactcaatttatgtttctaaattagtactcaatttatgtttctaaattagtacatcaattctcaagtgatgaatgaagttgattcatcacatttagaagttgattcttatccaactttaaatgtcattcagggctttgacatttctagattcatttttataatttttatctagtcaattttcactaacattcagggtattttttcctttggaaagatagaaagtatatgtcaaagattatttcacatagtatattacttgtagaactgaaagtagtactataaccataaagcttttaggaaggcaaatgtgtttttttccccttggaataaattataaacttaaaagttaggtaaatattgagataaataagataagtaattgaaagataaatagattattttaaaattgactagaccctagaaaatttaaatattcattgtgcaataatgtgtttctttcagtcatttaaagttgcagtttaatatttgttgggaaaatgtaacgtgctagacactgaaaattgtcttatttatctttaagcttggatacagttttataaaataagtattgctcttacttattgagtacctgatagtggtcaggaactgtaccaagcattttttttttgtcaagtttctgctgaatgtgtggagcattttccttatttaatttaatattatcttcatgatcagtgtctaaagtaggcttactttatagacaaggaaactgcattatctaaaaagtaatagcagcttatccaaggccacacagctagtaagtcacagagctggtagttgaggtcaagc

SEQ ID NO: 822 - DNA, 1039 bp, Homo sapiens
tgatctcaccgagtacaatacaagtaggtactcaataaatgttgtgtcaccatttaatagcttagtgcctggcagacagtaagtgcttagtaacgttatgattttcattgctctagactggcctttagtgtaagacagtggctgctaaggatttagaggtttcatgaaataattaattccaagaatatctgttgaagacctgtgatatactcagaaatggcagctaaatttatttattagaatgtcatcacttcttttcttttgtgccccatctaggatgtacagagcacaaaagtgattgaaaattgttactaaatcagaccaacctacagtgaggtgctacagcagatgcacctgccctacagtattcagtttacgtgatcactttggtgcttgtaaagatagcttttataaaactatttcttctagagttctcagtataattacctttccaaagttcatttgaaatagtctcaattcttcttcagtcatattcgtttattttatataaattagaataccttgccatgtttcttcccaaagactaatgattgccattcaaaatatttcttctggccaggcttggtggctcatgcctgtaatcccagcattttgggaggccaaggcgggcagatcacttgaggtcaggagttcgagaccagcctggccaacatggtgaaacccccctctctactaaaaatacaaaaattagccgggcatggtggtgcatgcctgtagtcccagctactcgggaggttgaggcaggagaatttcttgaacccaggaggtggggtgcgcagtgagccgagagcatggccgctgcactccagcctgagtggcagagcaagactctgtctcaaacaaaagaaaaaaagtaactaattttaacgtctccaaaacttggtttggtaaaattgtgtataggggtgtaagttgtagtttttgggaaaaaaatttattttatcaaataaagctaattttttttcttagtttttaatgtgcccagctttggatgcctagaaacacagacacacagaca

SEQ ID NO: 823 - DNA, 1953 bp, Homo sapiens
tgctgggattacaggcgtgagccaccacgcccggcctatcacatcttaattaaaataattaacaacattatccaccactaatcagcatgtagactttcctgattgtttcataaatggtttttaaagttggtttatttgaatcagaatcaaaataagtctatacagcataattggtcaatatgtctcttaagttacttttaacgtatagtttatcctttccctttttttcttgcattttatttgttgaggaaatggtcatttttcacttcctggattttgctgaatgtatccctgtagtatcatgttacgtgtccaggaaaatatatgtatgttttacagaaatgaggtcttgctatgttgcccaggctggtaaaatactgactttagaagatatattccacttaattgccaacatgaagcctatgcttttcaaaatcggttccataaaatcatgttgaagatcagttattttcttttcttagcactttcatgtatgttctgttttagtttgttttgctgtcaattccccaaaacattgccctgagctcaagtgattctcccaccttggccttccaaagtgctgggattacaggcatgagccatagtgtctggcccaagtatattttctgtttatctttaaatatgtgatacctcatctccttttactgtaaacaaatttttgtttatatggaaaaattagttgttgaagagggaaagatttcaaaaattatgtaaacttgaaagggaggatctaaaggaacggccgtgagcctcaagaaatagaataattttgtaatggtccgtgtttattgctctgtgattattttgataacatgtaatttgttgccatcttaaagtattataaaacattgaaatataaaattgtagcaagagtagatataccagtttgattttggttaaagtaacatactttgttaactttttttaattaacaaaaaagataccaggtgatcagcactccaacagatttttttatggtaatggaatatgtgtctggaggtgaattatttgactacatctgtaagcatggacgggtgagtaacatactatctggtacactaaatctctaaactaataaaaaggaaagtattgggacatagaacaatgcaaagatatcttcaaggttgaagttgcttttatggtagtgctcaactaaacatgtagagtgttagataaattttctttcttaaaaagcattccttttgaaatactgattttagaaaatatgtttcacttaattgccaacatgatgcgtatgctttttaaaatctgttccataaaatcatgttgaagatcagttatttccttttcttagcactttcacatatgttctgttttagtttgttttactgtcaattccccaaaacattgtgcacatttaataatattaattgaaatttaaatatttctgcttagcgacaaagacaaacttgtcttttgacatgttgagctttgacaagcttttggttggtttattttgtctgatttgttgagaattccaacataattctagcttgcttaattatatttagcctaattatgaaattaaaactcttgtcaaatagatgtctcagattttttttttttttttttttttgagacagactcttgctctgttgcccaggctggagcgcagtggcatgatctcagctcactgcaacctctgcctcctggtacaagcaattctcgtgtcccactctcctgagtagctggaactacaggtgcatgtcaccatgcccggctaatttttgtatttttagtagagatggagtttcaccttattggtcaggctggtctcaaactcctgacctcaggtaatccacctgccttggctgggattacaggcatgagccactgtgcccagccccagatattcttaatgcagtttcttttgtgcttgataggttgaagagatggaagccaggcggctct

SEQ ID NO: 824 - DNA, 1060 bp, Homo sapiens
cataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaacttttgtcttttacataaacttacgtcatttaaaaaatgtcttcaaaatctacctttctcaaattctttttgcctctatttatttttgcatttcaccaacagtgataaaatagttaaatgaaacaaagcaaagtatcaacagtcccttaaatgagaatccttatctttgatctttattttctgtgttaggtgttagggtcctggtgcagctcataatgctaattcttcattggaagccactcccttcacctcacctcacctagtcactattgtctttgttcattgtttgatcctgagtggttgattgatatagctttgaatcttttctagtccaagtttgaaaacactgttctggccctaagggctggctatgacctttactgttgaacctgatagggcagggaagctttgaacatcaagaaaaaatttttatcttaaataaataaatatatatattcacacaccagtgcttttaagcaaaaaccagtttttttgtttgtttgttttgctttgtgcaggttttctttaagattaaaaaaacaca

SEQ ID NO: 825 - DNA, 1037 bp, Homo sapiens
ttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacgataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatgcctataatcccagcactttgggaggccaaagtgggtggatcacccgagttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaa

SEQ ID NO: 826 - DNA, 1021 bp, Homo sapiens
atttctagcctttgtttttctatcaaatgatatgagtgaaattttaagttgcaaatgttgggttatctttaagttctttttctgatgttctgctaaatatagacaaaacacaagactagagttatatacctggttttgtattattccaaattatgtattacttatgcatggcatcaatatgttctaatgtcctaggcatgattttgtgaaatgtttagtttatttttataaagttacacagccatagagacatattagcatagttccatttgtttgtctgggtctacatttaaacaaaacaggaccatgttttttttttttgttttttttagctgttttcaatttatgtttgcattttgtaatgctaccttgtaggtataaagaagcagtaagatcatttgatttatgtcattttagctgcagacattcaatactgcctcaccttgtcaagatgtcaaacagctgactagtggagttgccatggcacaagttcttcatcaaatgtgagtagtggtcagactctccctgaaaagcattgtaaacccaatacataccaaggaagaaaacttggacttgaattccaaaggttgttgcaactttatcttacccagtgacatattcaggaatatggcaccaaggcattcttgcaggtagggaacaaaaagtttaccacctcattattcctggcttgttcatagagatacatcttaactggatatgtgatcaggattcttatttattcaagttaacttattttaaacttgttatgagcatgttcacactattttaaaactataaaagaaacaagttaatgatacaattgcttatggtgttttctttggttgtactgttgtcattttaaggtatccgtgcatggagattattatcttaaaaattattgaagcataaaatattggattttgaaaaaatttttaaagaattaaattttaaaatgtatttctgaattaatagtagtttatgagttcaccaataatgaaatgaggaatgaatgaaatttgaa

SEQ ID NO: 827 - DNA, 1059 bp, Homo sapiens
gaattaaatgtcctagtgattataaagtaaaaccacagaccaatttgcaaatgatcttcaatgttaagcacttgctctaagattaaaattccttttctttttaaggttaagggtgtgtacgtatggcagtgatgtctatgttgagattaacttatgtattgaggaaaatttgaagtttattttttcgatgaataaggctgtcaaatgatttagtatagattaatgacatcttttttagaaatattaaagtgagtattcctcattatgtcatcatttctgataattagagtgctaatttgaatgttagataatgtttccacatctatacctatttctttctagggcacttctgaccctggggcttggggatggcctttaggccacagtagtgtctgtgttaagttcactaaatgtgtatttaatgagaaacattcctatgtaaaaatgtgtgtatgtgaacgtatgcatacatttttattgtgcacctgtacattgtgaagaagtagtttggaaatttgtaaagcacaaaccataaaagagtgtggagttattaaatgatgtagcacaaatgtaatgtttagcttataaaaggtcctttctattttctatggcaaagactttgacacttgaaaaataaaaccaatatttgatttatttttgtaagtatttaggatattattttaaataaatgattgtccattatcaatataatagttgtgaaatgatttaagtaaataaactttatgcttctgtgtctgttgattttgatgggtttttagtgggcataaatgcatgtttatttgctgcattaaatagaggagtgaaaatatgtaggtttgtaaagaaaaagtaattgcattcttctaattttgtttttccttttaattttttggggaatgaaaagatatattaaatgatttgggaatatgtctttttatgtctccattttcacctctggaacctagacatcttgcattaacacggaatcaaaacatttctggggccgggcgtggtggctatgcctgtaattccagcactttgggaggccgaggcaggcag

SEQ ID NO: 828 - DNA, 1556 bp, Homo sapiens
tatacttaattataagaattgccttttgctttagccaattctgggtagcaagaatgaaaagtcagcacctctcaagtgacctctaagcaggaataagtagcccttttttaacccactcttaaccctgttgttgttcatttgttttgtttactgaaaaagtaaagttaaaatttttaaaaaatgtgtctgcatatgttaagcacagcaaaacgcaaaaaaagtataggtgttacaggtgctttcaagaagcactctttaaaatcttgtttttaccttttagatatttagaaaaatataacctataaattatcccgaatagatgaccaacatcgaaacttgaaagtgccaacaggtgatgcagatcatgatgtgtgcttccatataagataacatcaaaatgaaatacctgtgaagtttttgtcggtgtaagcagtgtccattctaagttttcgtcttaaacatttctctgttatttaaagaaatgcaatcttttcgctgttctcattacgtgccttctttttcgtcgttggtttgttactgtgctattgctcccaatccttgaactaacacagttgttggttgttgcaatgcctgaaggggttatgttggtaaaatgacatttagaaggttacttaggagagttagcatccttattgcttatgaaagatttattgacagcagcatagatcagactactcttcggtttggttttcctgatgtatcccagaatcccttgttatgcctgaatgccagccaaatgtttggccattggttttcacgggaccgcagtaatggctgcttctctgtgcgcgcaacaggaagactgtaaaagaaaatattaagggtcttttgtctgaaaatatttcaaatttgatttaagagattcagagacctgttatttgtggaagggaagctgccaatacaaatatgaggtagatcggtcaacttacatacaactgatttgacaagcatctgttataatactgaagatttgtaaacactaaacaatgtttttacctccttaaaagttttgagaacttgccagtattggcaggaggcagagactctgaaacgtgcttcaagatacatgccaaaaccattgtggccttttcacctataatgcgttttttctcgctctttcttttaaattgttatatttttttcctttccagaatgcctttttttccccctagatggtcatagaaattagatcttcttttccttctgaaatttgtgtgtaataattcttgctttatgtgtccacctttctttggtaggaagttgaaatctcagaacatacgtgagaatactagaagcaaatgcagaatcaatctttttttttttaaagcggaggtgatttattctaagacttattgacatgctaaaatataatacataaactacattccagttttttccctctaaatccagtggcattagaactgtgaattttgtggctgataagcagtaacaagtgtaatgaaattggagtgatttcataagcctgagaatttcatcttgttaaaagaacaaaaccattttatgcccttaatttg

SEQ ID NO: 829 - DNA, 1464 bp, Homo sapiens
agctttaagctcaaggtggattttttggctgatcaagctattgtaaattattgatatatggcatatttttagaaattttaatttatcttttaattcttcaaaaaagatagcagtagcagtcaacaaatttgagataaatattgattttacatccttgagtgttttctgtgtaacttgaggatagtaacaatatcctttacctagaatgtagtaacaaaatcctttatctggaatgtagtgcaaaagatggtagttctaaggcagagagtgtacaggaatagggagaaatagttgttctggagtaaacctttgaatggaagtcagttcatttatggctaagaggttgagtgtgttggtaagaaaatttcccaatgcttctggcttggattttccttgtcttcttttccaccctgtgatgaatagcattaatttaaacctatttaaggctagtgtgggagaaaccacagcctttgttgtggtcactgctgtacacagtaggactgggtgtttcatttggttaaggcctcaagctgcttccagaggacacgggacagcctgtcggcattttaaatcttgcacagaagcagcaacaattctaattgctcacaaatgtcaatatagatttttgaaaccaattttgaggattagactagaagaaaaaacataaaatgcagattgagttcagtgaatgtgctaaacactgatttattaccattttagtaataattttcccatggttatttaagggttagagcttgcttttgaattattataaattgtaaacccatgggggttgagtaagggaaggaagaagtcaggtggaggaggaagagaatgaatgaactcgtatgctttgttaaagagaaacataaaaccctgaacttaatcacaaatggagataccgtaaaagtattttggtttcagtaatgactgtaaagcagtcttgggcagtgagctatcaagtggagaattttataatttgtcttcccacaattttttgcatagcttttttcagactaagacactatttagagctttgggagtttttattcaagtttttaggaaaaggttttgcaaaaattctttttagaatttaggagtccagttagagacatcattgcacacttaagctcagaaaaggggccatggagatgtttattctttttactattttgctttctaaggtggcagttcagagtattgtcaaatttttggctctttcccagtaggcaacggtaagatactcattattgatccaaacttttgggtccctgaacttaacagaattatttagttgctgcttagacagaaatgacttttttccttagattttccccaaaatattagaaaacaattcctcatgttttgttttaactccacagcgtaaagcatattttatctaatggaattagtcctcccgttagtgttctagctaaataaacatggcttatgaagtgaagaaat

SEQ ID NO: 830 - DNA, 1031 bp, Homo sapiens
tagccacctaaattccctattttgctccttcttggaaaaaagttagcagtctcgagacttttacgctgaagtggattttaagttgtcagaagtgtcaagctgatttgcctttttttctctcttttattaaaagaaaagagatacatactacattcagacagaaagcatgtaaggggtcttataagtgtgagcatgtgttagtggattaatgggacaatgtgtgtggatggtgatagaaaatatgagagaactattgcttggctgataaatgaaataacaacaagaaaaatctggtggcccaatatatattggatttgttgttattctctgttatatctgctggttgttcaatctgaaagtgaaatctgtttctccattcattaatacgtgtgcttttctttgtatagagcacagaacaaattatttgttccataattatttttaaaaagcagaaaatgtgtttgtaacatttaagaaatggcatgggattgtcatagaaactcattctgaacactgtaaataaaaatggttggggattagtcacagtaacatgtaggacatcatgaaattcaagacagatttctttgtctaacagtcagtaagagacatgaagcgaacttgatatagttcatgagatattagcagttcagttccttcagagaaagagaaaaccatgttgcttcatattaaataagccatctgtatacaaatctcacaatttacttgatgattttagcaatatttgatgtttcctttcagagtcttatttccaaataatgaaagcttaaaaaatttgaaaatctctctgtttttgctactaaatctttagaaccatatccctccttttcttctttccctatcttattttttggtaatcttgaatagcattttaaaagttttagctttattctgtttcctttagttttcccttacttcatataatatgaataaaactgaacacattaatgataaatagccttcaataatactatatatttttaaatatttcaggttagaattatgagtctgca

SEQ ID NO: 831 - DNA, 1889 bp, Homo sapiens
attggttatttttaacttaatcacgtagttgatgctacagaaatgaattcatggcctttcttgtggtgctcgtctttttcttgtttgatgttgctagttgaacacatctcaggttgtgagaagtgcatatttagatgggaacatcttggagagatcttgattggtagagagtaactttatatcagtgagtataatgcttatcagtgaaattctaactcatttaattattacttaattttctgattatgtttttgtatttgagagaagattatttccattatggcaaagtatggatggatggacattgctattgccatttcttgacttagcacacctaggaaggcattttgaaacatactttttaaaaaaagaattgcatatctgtgcacctacaacagtgggtgtgctgaaattctgacttgggttttgatgaaagaattccccaattcagttaaattcatccttgactgtcgtgtgccactcatgttcacttggttaaaaaaaaattgttttttggagattatttgtagaatctcggttctgtaaccagatattgaatattaccactggagggaagctttgaactcatttatcacccttctgccaaaccacaaaaatcctctctctctctctcatgcatctatctatctatctatctatctatctatctatatcttactgatttattcatatatatatttcttcatatatatgatatatgacactgtatatttacagcatatatattacagcacagctatttacagcaacctggatcattcattcttagccccttctcaagaatggaagtttattttaaaccagacataaacaggacataaaatgaaatattaaaagactggataatgcattttaagtcagacatacatttggatagctgttgtttgagtttgtccatgctggagttacctcctcctcactgcaccctccctgtttgcatggggagctgagattagattttaactacaaattattcacattagtcaaataaaaaagaatgacatttcccccaaatttgattattattgtattttcttggagaaaaagatcgtgttagtaaaataattcaaaatggaaatccaaatgtatttcttttaaaatttttcaaatctgttgctaaaaagctgtagaatatcgtggaaaattcttttattgtaacaaacattcctggtttaatttcttattttcactttatttttaatataaatatatatgtaacttataacacatagtatgaactgaaaatctgtgaaccaagaaagataacaaccaatacctttcatttacctgtgtgttcttttcctctcccattaccctgaaattcctcctattatcctgaattttgtgtttgtaattcccctcctataaaataaatggtttatcactcataggtactaaatatattgttcagttttgcttgtttttttaagttttataaaaaatcatatatacacacatacatatacatacatatatatatataaatacatatacacacacacttctgggaattgctttttttcactctacaatatgttcataatgtcatatatactgtaatttattattgtttcttgtgtaatattctgtgatggatctatagaaggtttccagtttcttggtcttagcaagtgctatgaactgtaacatgtcttctagagcaagtgtgtaaaagtttctttatggtatgtgcctaggacttaaattgttgaattacagggtgtgtaaatgttaagtttttttttttaagaaaagatagtgatattttatcttactaacaagttatgcctgtttatacgatcactcgctgtagcagtatacaaaaaattctgttgatctgcattctctccagaatttggcactgccag

SEQ ID NO: 832 - DNA, 1339 bp, Homo sapiens
cacaggtatgcaatttggctaaatggccatttccaaaccatagcacacatttgtctacttgttcacttttttttttttttacatgagagtttttactcttagaaaagtcaaagagtaacccagtgcttgtcgaggggtaaaggtatcatttttatgcagcatattgtgaagtgattaattttttaggtgaaaaatatatagttcacatagagattatttgggagaaaatgattttttaaaaaatatgcagtatctgcgggcaagcatacgaacaaatatatatacacacacacgtatcagtatagaaaaatgtgtacttttaaaattcagttgtcttaatctgaagctatttgagtcatattctctggattttttaaagcatcctacaatctgtatatataattaggggaagttgtaataattgcaggagttataaaagcgaaatttaggtggtgggtaagtgtatctacattttggcataaatcactacttttagaggatttatatgtcagactgataagtttcttaccatggtgaaatgacaagaataccactcaggcattggctgagacataattttgacagccagcaagcttgcagtgttgctgagtgcacagatttccacttcctgccaagattaaaattggcaaaaaccaaaaaggatattagggattgtcactttaagaagaaataacatgttaatgttctgcatttgcttaagaaatgtaagagtgatctcttgaactgtagtctgttgaaacttacaagtttgcaatcaatagaagagtttgattaatatgagcatcaaaaattaaaataagtagaggctctctgacacttgttagaattaagactcattataggtttacttaataggacataattactttccttctatataagatgaattcttcacaaaagctatgaaatagttttcctcacagtccctgaagaacaaaggcctactttaagtttgtagatttgaagactgaatgcttgctttacttcctgaattttcttattttttcctgtgtgagcagatggtttttctttttataagttgccagatctttcctataacaataactgccattattgagaacctactgtgcgcttattctgtactgagcactcagatcttcagagttttttcttacttaggactttttgtttaactctaggtgtaaaaatgaagaaaaaattatatctcatgttgtgaaagagtcagactctgaaatctgcttatactttgctatttacagtaagtacttttgaaacagctgtagacgttcaaatgaaagtagcaatgtggagtggggaatgtgggaacattcatttg

SEQ ID NO: 833 - DNA, 1022 bp, Homo sapiens
acattctagcctggacaacatagcaagaccccatcttaaaaaaattttttttttttagtcagccaggtgtggtggcctttgcctgtagtcccagctactcaggagactgaggtgggaggatcacttgagcagggagattgaggcttcagtgagcctcagttgtaccactgcactccagcctgggcaacagagcaagatcctttctcaaaacataaagcaaaaaacattatttcctttctcctttcagaggaaaattatttccagattattttttcttatatttttttaaaagttggctttaagggagcacgtttctctttgagggtggcctgtttcattgtcaatatttgctcttcattggaagctgaggtcatgtcagagttactcaggagaaagacctggacttttcttcttatcttttaatggtttatcattgataagtttggacatggtatgcatggtgacttttttcactcttgtcacttttctatatttaccttgttcatagtatgtaatctgagtgccttcaagacactagaaaagatttgatctcaaacaccacattttgggtattttaatataatcaggagaaaagtggatataatattcagacaggaagctggaatacactggcataggtagaagtattcatttcaacattaagtgaatatatatatatttgttgttgtttgttttgttttgtttttgtttattttggttagaatctcactctgtcacccaggctggagtgcagtggtgcgatcttggcccactgcaacctacacctcccgggttcaaactattctctttgctcagcttcctgagtagctgggattacaggcaaaggccaccacgcccagctaactttttgtatttttagcagagacggggtttcaccatgttggccaggctgatcttgaattcctgacctcaggtgatccacccacttcagcctcccaaagtcctgggattacaggtgtgagctactgcacccagccgcaaatatatattgataacttact

SEQ ID NO: 834 - DNA, 1025 bp, Homo sapiens
ttgtgttggcttgtaaattccttatttcctgcatgtgtgagtgtattttgttagaacattccattttaaagcatgccttttttatgacaagaaatacttttaaaatactatttgcttttgaaattacagtagggaatcaaaggatagtctcttgttgagaggaaggtattagaagcatgtagctttatgaactatattttctgtgaatatagcagaattagtttaattgttcaatttcaccctctccagcatgattgcacccatcagggcagttaacagagacaccgctatttgtgttatactaggaattctttataaacttaataaatgaaagctttttctcttataggcccgattctctagtggacttctggtgaaattatgtggctaccttccattaatgttaatggaggttatggatataaatccctccatagtgatggaagaatgagccccagagagaagaatgtttctaatgaatcactggattgtgatataggattaacttggtgtccctaataccatttttttttcctcctgaaagtttaaggtcttatgtttaggaactagtttctctccaccttaatcctttattgtcaagtctgcaataatgttaagaacaggaaaaaaaaatgtagattcctggataggcacagtttttatattaatgtaactatataggcatagtttttatattaatgtaactatacagcacctatttttgtgttttactattacttggcagacatcttgagtgttttacaaggttatcgtatatttcactaataatcgttgcttgataatttggtgtcctgacagactgcagtttattatttagtattaaagctctcaaatgtatttattgagcacctgctgggtacaaggctttgagcttagtgatgaaagcatatgacatagtctgtagcctcaaattttctataatctcgtgataaaagtaggtaccagttcattagttgctttccagtggggcacaaattatggaacatcgtctggctggccgggcg

SEQ ID NO: 835 - DNA, 2639 bp, Homo sapiens
tccctttgaaaggtataatgtattcaaacctttttaattagctaatcttttcctgtgaaatcttaaatatttgcacgtataattggtaattttagcttttatgtaggtatgtttccccctggtgttacttacaaaacctggcttactcaaggcccaaagtccaccccactagtaaactctctcgtctctgttcctgtgccaagtgctcttcctttgttaccaggtccacataattaatagctttatcatatgaggtaattcagttactcagcaaaacaaatgatatacacttttagaaatagctctagaaagtaaacttgaacgtaaaattgtttagtaagaggaaatttctgtttgtctttaattaagagaaactgtatggaaatgtaagctaaggatgcattaatcagagaagttggcattgcactgttcttcatttttatttggcatagattgcatgggtgctcattaaataatttgtatgactgaaataacttgtgatagttcttgctaaagttttgcatggactcagactaaagaaactttaaaatttgaattaaaaaacattcaattcttaggtttgaaggtttgagttacttattataactgaaaatctttattatcaaaatgtgtgttcattatagtgtttgcttgccttcttgggtgaagaaatacttattatgagagtatgtagattttccgtgaagaattagtaatcatgcatcaggttgatacctggtgagtagatatttgtatttaatgctcttaaattttaacagccttgcctctgtatgccctgctcatctgtgtcttaccaactttgatattgtttgaaaaataaacatttgaaggaagaagtttgcatatttagagggttggtagttcattacctgcatgtaggttatgcccacatcgcaaagaaatctgatctatatgggtaacatatttggataatcaaggccaaggtaaagggattcattcccccttcttgaattttatggtttctgtatgtcaaaccagatttcattggtttaaatcttgtggtgtacacttggccattgatttggtttgagctctgtaatatttgtaattatgtgagatgacaagattgaattaacttaattgtagagttttacatagtgtctgtatcaacatcctaataaaataatatgaaattcaataagtaatgccaagtgggacagtgagccactcacataagcttactaaacttgatatattcttatggcactcctccagaatgtagaagaaacacatttatctaggtgattagtattctttctgtctgccagatttaaggattgtttggaaatattgttagaatcaaaatcaacgtttgttactacacagggttgagcattccaggcacactctggtcgttttgttattctaatgtccacttatttcatgtctgccgtgaccgtgacagttttcagtcacacagagctgccatcaaaagagtgataagcttgtaagtgaagcctttggggaagcaataaagtcatttttctggtcccatctcaaaagacattattggaaatttatttaaaagtgatcaaggtagcacatacgaggccttctacagtttgcattttggaagttattaacaatctgcagttaagtccatttaaaactgaaagtggctcttccacaaactactttttaaatagcttgctggttctaaatttaaggagaatggaaatattggaaattaaaagtcaaaagaaatttctggggcataagatcctttcaagtttacaatttctcactttagatttaaaacttgaacacggccatactttgcattttatgatatctaattagtgccttgtaatatattttgtgaacagtatctgttagccataatatcagggacagtttaaaaaatcttcagtacatttatgataaaagtattagcattgtaaggtcttaaattgacatctaggacattaggaaatcaaatttaaagcattgcattgtctgttactcaatggagtggactgaggacagcgtgtgacttgtgtactgcaaatgatgcaatagctaaatatcctagtgtgagttaaggttgattaagtgatcatctttaactctgcttttcccagggctctttgaactcttgttttattaggtaatatgctatgctgttattttattgctgtttaaaaaaccttctcttttgggaaagaaaacatgtgaattctttggtttctagatagaaattagcaatcttttgctcggaatgtaaaagtatgctgtattatcacaaactgaccctcctcctccccaagaattctagggagtaaaatgcgtgcacaggaaatcagaaatggatcaacagagttataggttttaaaaaaactgccttgcatttttgccctggaattaattttcagtgaaaattaaaatattttttctgttcatctggaatcagtttttacttcattagcaggaaatggtaaatatacattcagcacaaatagagttttctttatgggacacaggatttgtactccataggtagatgtgtaacataaaagaatctttctgctctccttgtaattttctccctcttaccctcaataagttaaaagaaaggaaaattttttaacctaacctgt

SEQ ID NO: 836 - DNA, 1022 bp, Homo sapiens
aggaggctgaggcaggagaatcgcttgaatccaggaggcagaggttacagtgagcactccagcctgggtgacggtgcaagactctgtctcaaaaacaaaaaacaaaaagaggaataatagtatctgctctccttgccttttgtgggtttttttgatgattaaatgatatctgagggatacaaaaatgctttggaaactacagggtgctttacagactgtgtgtgtgagtgtgtgtgtgtgtgtgtgtgtgtgtgtgtgtgtgtgtgtgtacagaaaatcctttatctctttgcttctcaatttcttttcttaggaaaatcagattatttaaatcccattatgcacagctctcctctgttcttactaagcctctgtattccattacctccagtaaatcagtaaaaggtggtgagtcaggctgtagtggaaagcggggtctgctgttttctcatgtccatgttactctgtgggactcagaaatcttgcttacatgtctcatgaactttcttacctgtttgaactatacaggctataacatatgacttagagtcttttagttatgaccactcttaagattgatgactaagttgaagtatttattagttgttattatggtggattgataatcatgcattttaacatagtaaactaaagtctgtgtcgtagaattagctataatttactttttaggctggatgaggttactgatgcttgtaatcccagcacatcgaaaggctgaggtgggaggattgtttgagtccaggagttcaagacaggcctgggcaacatagggagaccctgtctctattatcataaataaaaacaaatttttttaaacaagtgtatatatgcatatgcttatgtgttgtaataataatatgtcccagagttgcacatctggaagagaagaagatagcaactgaaaagaaaatagaatggtattgacaaagagaaaagatggcgtcattaggacaattactttttatttttggaacaactcgaggctttacacccattctttt

SEQ ID NO: 837 - DNA, 1415 bp, Homo sapiens
tcattttatttgtttgtttgtttatttatttatttatttatttatttattattgagacaagatcttactctgtttcccaggctggagtgcggtggtacaatctcagctcactgcaacctccgcttcctgggttccagaaatctccctcctcagcctcccaagtagctgggattacaggcatgtgctactgcactcagactaattttttgtatctttagtagagacatggtttcaccatgttggccatgctggtctcgaactcctggcctcaagtcgtccgcccacctcggcctcccaaagtgctactattacgggtgtgagccaccgtgcctggctagaattagtcattttaaattcactggggctgggcgcagtggctcatgcctgtaaccccagcactttgggaggccgaggtaggcagatcacttgaagccaggagatcgagaccagcctggccaacatggtgaaacctcatctctgctaaaaatacaaaaattaactgggtgcctgtaatcccagctacttgggagactgaagcacaagaactgcttgaacccgggaggcggaggttgcagtgagctaagatcacgtcactgcactccagcctgggcaacagagcaagactgtctcaaacaaaacaaaagaacaaaactctctgggcttgatttcttaatctgtaaaacagaaataattcttaacacatttggttactctgaggataaaagtggaggaaaaaacatgcagaggatagtccggaactccccatgtagatcccattattaggtaactgaggtacaagtatcttaggctactggtccgggcaggctttgctgaggggctccgtgcagcttgctggtgcagccgagcaaatgggcctgtagccgactcttaatccaggttggtgctattcaaagagatcatctttcacccgagggatttctgggcatctattttgcggatcagaaagtagagaaagaaggtaactttgccgaaagctagtctggggagttagtagctgatacagatcagcatttcctaactatgagatttcataatattctctcttgtctcgattctgagtcactggtgcctgctgtggtggcattgttcatgaacatgtacagttattgggaagtgatcttgtctttcctcctgccttcaggcactgctacctaaattacaccccgacagatgtattcccattcttctttaaaagactatgtcatgagctgaactattaagttttaaagttgataagcatcaggctaagcatatttttcctgccatctcccacggaggtataacattgttttctatacttagggaatttaccaaaaaaaaaaaaaaaaaaaaaaaagttggtatctgctaatgggtcaaattagcaggatgttttgaaaactcagtggaagaat

SEQ ID NO: 838 - DNA, 1076 bp, Homo sapiens
gccagttattggtaccagtaccaactaattcctcagagctatagggcagtattaaattactaagccagtgtggaaacagcatgatctaatggaaagctaattagcctttgtgtcagatgggtgtgattcaaatcttgtctgtactgctgatgggctgtgtgactttgggcaagtagcttaacttctctgagttcccctgtctctgttttttcatttgtaaaatggagtggaggggacaatattaacttgcaggatggcttgatgatgagaaatgataaatgtcttagtctatattagatcttcagtaaatggtagttgttttgaccactgttactgcaatgagccaaggtggctataagcccttcagtgtttcagtaaggacaagcttacaggtaaccaccaagatcagggcagaacagctgatttaggtctaaacaggttccatcgtgtgtcttcaaaaaggttttcctttttttcctctggagaaaattcagactggtttaagaaggaaactgagagcctcttccctccctatgttctgagtgtttcagagatggccagaaatggatactagttactaagcaagacctttaaaaaatacacgttacaaggcaggttggtatgaaggaaagagcactgacccgtgagttattctcgcggggccaggctctgctccactcagctctgtgttctctgccaagtccctttagatcaatgtgtcgcatgtccccccattgtgagttgagtacattggaccaaaggattatagtttgttttcttcccaggcaagtgcctcctcctgatggggagttagtatgatgtgggtggccccagtaggactgggctggtcttactgttctaagaagtgttagcagaaaaatggctaggcattggagtaaccctgtgatttgacattttggggcatcctttcatggtacgatacacctggccaaaagtctcccagctcagaaattctataactagaaatgctttgaataaatatatactgagaaggtattttggggggaaattttaaaattcttatctgacttggctagagcaactgcttacgacac

SEQ ID NO: 839 - DNA, 1037 bp, Homo sapiens
tgctttactgaacttaatagttgaagaatgtgggaaagaaatggtgtactttctgggtaaagtattttagccaccctggagtagttgcattgcatcttgatcttttttcatcttggtagaattatactgtaactaattgaatccattgatcactgtcttgttttttttccatcttcttctccgaggattcatttcataggggtctatacatcagtcaagaaaatagctaccgaggaattaccgagactagtaataaaggtaatttaacctagtttaatattttttttaaaggcaaaacactgtaaacattttttacctggtgagagttaacttcttaattaggccatgttggaaaacaaatcaaaaagacacttactggtagttttcagagagtgagagaaaaaaagaggcaagagaaagcattgatcttggaattagatgacctggtttctaggcctatctaccccaatgcttttcaaacttcaatgtgcatacgaatcaactggggatcttgttaaactgcagagtctgaatcagtatggttgcagtgggcctgagatgctgcatttctgacaagctcgctgagacatccctgctgtagaacctctgaccacaccctgagtagcaagggtctgctttaccacttagctaactttgtggctttgggtatactgtttaacaactctgcatctcagtttcctaatctataaaattgggatattaatctttgttctgcctacctcattgggttgttatgagaataaaattagataatgtagatgctttttttttttttttttttgagatggagtcttgctctgttgcccgggctggagtgcagtggctcgatctcggctcattgcaacctctgcctcccgggctcaagcagttctcctgattcagcctcccaagtaattggaattacaggcgcctgccaccatgcccgactaatttttatatttttagtagagacggggtttcaccatgttggccaggctggtctcaaactcctgacctcaggtgatcctcctgcctcg

SEQ ID NO: 840 - DNA, 1073 bp, Homo sapiens
ccaaagtgctgggattacaggcgtgagccaccgcgcccggcctgtagatgtaattttaaagtgtcaaataagcataaggcagcaaggacatttgtttatagatacagacattctttggatacctttcatcaaatcagtgtgggctgttctttaataggaggggcctggaactgtgaggcaggagaagggaactggaatccctgcctccctagtacccattctgtgcctttggccaaatcatctcccctggtcccctgttgcgtcatctttaaaataagggcttgacctaggttagtgctcttaaagggtagttgcaagactagcagcatcagcatcactgggaaacttgctagaaatgcaggttagattcctagccccttccgagacctggtgaatcagaaactctgggaatgcagtccagcaatctgatttctaatgagctcttcaggtgattctgatgcagctaaattttgagaaactttctgaagtgtcatccaactttgaaatgagatatttaagccttctctttataggttcagccaacagagagcctatctgtgtgatctctagacactttcccatctcccaggtagaggaagattggggaattgaaccttctgtgattgtattgcattgagcatgtggtaaggaggactgaacttggacggttaaaacctcacctctctggaactcggaatagattataattgcattgacttacactggtctagcttatccagttttggggctgctttagtagcccacaaacgctgactaatgcagatgactgtacacactgagaaagttctcttccattttagtttcctccttactctcttcctgttccccgaatggttgtcatcatgatatagcaccaagtcacattttatagacttttcaataactttctaaagttgatcacaatctagattatttgcattgttgtgagatgagggaaactgagaaagtaaaatacatgttttgttttgttttgagacagagcctcactctgttgtccaggctggagtgcagtggcacaatctcagctcactgcaacctctgcctcccaggtt

SEQ ID NO: 841 - DNA, 1043 bp, Homo sapiens
gaacaatgaagaaagacatggagacactgtccaagaggtcgagatggatagtagcttgagatcctctctttctctctagacatgcgccatgtgcaacacacacacacacacacacacacacacacacacgcagacagtctctgactttcaacggtttgactttatgatgagtttatcaggatgtaactctgtcacaagttgaggagcatgtgtttatgtgtgtatgtgtatccgtatacatttacatttatatatacacacacacacacccctctataatcctgtatacttaaattcctaaatagttgtttgggtgttcactatattggaacgctttaacttgtgttcttaataatatctttaggaaaagattaaagcatgtttctgcatataataatattagtaacaaatgatggaagattttgctccaaaatgagttaatgtagaaaacaggtagtgattaaagtggtgaatgtaagcaattttgtaaatttataaagtcatagacatctgtagttatgaaggacctcatagataattttctccagtggtttcaaatattatttaaataggaatgtttccttcaggaccaaatctgtggagaagctatgtacatgtatttatttttttaagttgaaaagtatgcgagtactggatccatattattaataactttggcccacctgttctttctcccagaagcagccccagttggaatcagcccctagagcgaggagtcacctgggaagcttgttacatgcagattctgattctgtgtgtctgggaaggcacctgagactctgcatttcagataaactcctaatgtgttaaacatgcattggccacattttgagaagcaaggccctgggggaaactgtgcacgtagttcgaaaacctttgatgggttaacttcttcatgtttcaaatgtgaaaagacagagttataaatgatctgccaaaagccacatgcttacctggggtcttgagtcttgggaaggctgtgttcttttacccaaggcctgggtgggatggctgtgtcctta

SEQ ID NO: 842 - DNA, 1090 bp, Homo sapiens
gtcttatcataattttgttggtgagaagatgcagctatataaaacaaagaacaaacctgtgaaacttctgctcctcctatcaggctctgtttgtgggaagcctaaatgcataaaatagcaacttgttaaacttagccttgactctgtttaaggggatcttttatttgcaaaatttagtcaattcctccctaaaggaaaaaaagtcattttagtggatcttgaaagcttttagataaatattccaagttttttttcccctgctgctgcaagcttaaaaggcaacatagaaggtctgaagcctggtttttccagctgtgtaacaagcacagaagagaggattctaaatatttactcctttttccttcccactattctgtgttccagtcaaacttgatttcttgctgtttgtttccaggacacttctcaccctgcattctcttagtttgtccccccaaggaatgctcttctttccatcctcacatctctgtccagtagaatcctatttgtcattcaatctgcatttaaaatgctatcagctcttcctgaagactttatggacacccccaaccaaatgtggaaaggggtccacaatttccagtgcaattaccttacctactttttggctggactcagtactctcattctaccttgtgtgttaggtgttcgtgtactcagtaatgttcggtggtcaaccgatatttactaaatgccccttattgtcaaacactgtgttacttactggggaaagcgaacggtttaaaacatggcccatgatgtcagtaacctctttcttgttttttttctccccaacttggttctgaattcccagttggtagaaatggccttataattctttggtgttctctgtgaatcctggcttcttgcacatagtagctgctcaagaaatggtcattgagccatattagttgagtaaaccagttttcttctgattgaatttgaacagcaaagatttttagctttcttctttggtatttaaataaaagtaatgttatttgttctatttgccattatattgtgatttttggtggtacagaaaggaagatttttcccattacccctaccatgtagt

SEQ ID NO: 843 - DNA, 1031 bp, Homo sapiens
atagtaggaagcatttctttaccttggaactttagaagagggtctgaactgagcaaaaattagtgtccctgcctttttaacggctggacacttatcacaaagctgtgccaacatcagtgatggtgcacccacaaaggtgtttggtcttgataagcttctaaagaagcagactttgttgttgttttaaacagtaatgaactgtttcagtttcataaaaaaaaaagagacattctttcttaaatagaaaagggcagaaagtttatagagaataatgtctaacttgctaatgcagtgtttgcctttgctctgtggcatgtgtgtgtgtgtgtgtttatgtaggcatgcctacacggctgcttgtgttaatacttagtataaagccttaaaatggataccagattggctatgtaaccttggaagatttatttacactctcagtttcttttattcccaatcttttatcaaatggtgtttattatattctctgaaaccattaaataaaaaggactgtggaaaaattctaaaatgctaaaattattccaggctaaaaaaagtattacaataggatgatgatgtttaacccatctacttgaaataaaaagccgagcaaatcgaaatgtgatatattttagaaggtatttcttagagaaaaaaatgtttaatgttccttctagactgccattattcattgtatttttattttaaacataattatgaaatattttgaaagtaatcaagtaaatgtggtgacatttttttctctggttgagccaagtgataataacagataactgttatctataatgcatactacgttgactcattaaagcctcatctttgttaaaacattgaatataggatttgagaagaggagaagtttccttatttaggaaaggtttttggtaggtctttcttgaagaaatggagaaaatggcctgctgatctaatctgaggacgaataagagaatcctcctccctgtggctatcattcctatggtgctatacctgtgtgggtgtggatgtgatggtgt

SEQ ID NO: 844 - DNA, 1054 bp, Homo sapiens
tcctatgccttctgtacacatcttcaacaggatttggtgaattcacagtgagagtcataataataatcgtgattttgaaaagtaatagttgtctaacactttcccatttatctagtgatgctatatgcattatcacatttaatgcttaaaacttgagctattgttatccctattctaacaagataatcaaagcatggagaaattaactctgtcttgctaagatcctcagatatgttctgaatcataaaaggttatgttatatttagcacagtgtttatagtaagaatgttttctctattgtgtgtgtgtgtgtgtgtgtgtgtgtgtgtgttggaataccattataatctataagtctctcttgattttcagctagtgtgactcccctttccataactcccacctcaaatttgaaccatcctgaatagagaggagctttaataaaccaactctattattggttctgtaagaccttgacatttgcaaactttattttttgccttttctcccacacagtagccactcttgcaaatcaaccttgggaagttagcattcttaatgaagatctataggagactttatccttagacagtaaatcagctctttcaaggcaccattcatctcccttcgagcgcatgaattggtatatggcaccttacaagagctcatttatcttatgtgggtccctagttattacttttgcccacttcccctagatcgccagagatcaaggcagaaatgaagtagaggatggctttgcactttgaaaatttgccaaggtcagctgaggtacctgtggcattgacttagagctggtgttgagtattacccataacttttagggtgatatcacccacactggcaaataattagtttagtttgtcaaagcatttgaattgtgcttggttaaataaaaatggctagaaggtaaagtaataggggaaaaagtttgttaccttgagaatttttttcctctttaacatttgtccaaatcatattgacatacttttggcttccatattagtgataaggatgaatttttactaagtgccta

SEQ ID NO: 845 - DNA, 1058 bp, Homo sapiens
agggattcaaaccctatgtaggcccctttctctcatctggtttctggcctactgagagttgctaaccctgctttgcaccaggtgagactgtatttccaatagccccctatcgagtgcagagatgttttggggggtgaaagttgattttgattggatttacaaccccatatatcaagcactagactaaaggtccatcagcctttagaagaagccacagtggttttcatttctttcactctgtttatcttctgaccaaaggctgactcttccacaggcggctgatatcgagtcaatcaggactctttatgcattatgtgaatttggccctcacacagctgagaatggcctgaatagctaagagagcatcctctctgcagcacctcttgactcctcaggacgagtcacactgaaagaggcaggtggatgcccctgattgtgtcccctcccatccagcatcatggccagcactgccattccttcaccccacccaccccagttagcccctggcttgaactccgtcactcaagagggaacattaaaaaccccacacctctgactcatactttgattttgtggcctaaagaggcaaagacgccgtaaggagcttttaggggccatcactatggagcctctttattgcccagcaaaagccttaaatgataatgggaaacctcactattgattggctgactcttaattcttcctctttgggttttgaagtagaagtgatggtccagaatatttatattactcattggatatattaaattaaacatacaaaagtcctacagccatttaagatggggttgcagcactggtgaatacgactttattaccaagagagaagagtagcttttagttgtggcttagctggaatatattgatgataagaatggctcagcagacagaagtcttgggactctcaaaaaggctccaagtgtgctttcttttaaaaaagttatttaggcccatcctttataaacacccaagtagatggtctgatggggtcatggtaacaaagattcagcttctatctaggtggatggtaagacccgcta

SEQ ID NO: 846 - DNA, 1033 bp, Homo sapiens
cacgtgacatgccacgagggcacgcacagccatttccttgtttctaaaaaacttgctacctccacagagtactttaccttgttttgcatgccaaatgttcttgctgaatgtgtctagcagactggcatttgtccataaagttattttagtaggtaaaaagtctctgagcacttgagctttgtgcattctttatgtaaaatggatttcccttcttggccagaggccaagggtacagcacactcgctgggtgagaagagagcttctctgctgagaaactggtggaccgacacactctaattttttggcttctgaccaaacaagctagaaggatgccaaaattcaacaaaataacacattattgtgtgataggagccgtgctccaagagagcaggaactcagaggaacttcatactggccccttttaaaaaagcattgtcactttggggagctttcttagagaaacgagaggaaaatggtaaaatgcaacctggagagtaaggtataatttgcacatgaacacgaaggaaggaactgaaagaaaacagaggagtttaaagttacttctatgaacttttcccagacataacacacagttctctgacttgacttacattcttttaaccctgaaagttccatctctgtgtctgagcagaatgctggactgcttaacgttaatatgagaactaatgtgagatttaaacacttttaaaaggttttaatgtctaaggatagctgcaaattccaaatatgaaaatttggcaggcttttggggggtaacagaaaactttttaaacttacatgctttatctttgcaccctgacatgtgttaagtgagtcaaatcttcctgttaattactcttgtgacattagcaagttatgtaagcccactatacctgtttccacatatgtataatgaagacgttaaagaagataggtagtagtcttctgagccctaaagaaattgaatttgaataaacaactggaataagtataaaatgcatttctagtttttatgtggaaatttgtcaatcaa

SEQ ID NO: 847 - DNA, 1045 bp, Homo sapiens
tttcagtgctccattgagagtcggtggagcacactggttgggagaagacagagctgtgagccatccgtctgcctgtgcttgagtcttggctctgccattgactagttgtatgaactgccgcaggtggttcagccactcagaacctctgtaaaagtgagatgtaaaaacactttctacatcataggattattgtgaagattaaatgtgatatgttgtaaaattctggtcacacaagtattaacttactgttatttttgctgccactgctattaattaatggcagtgtggcggctcagtactaggcaatgggcgtgcaactgtgatgagaaacgcttctgtccattaaatcgttcagtcagtggaagagacatgtatgtaaataggtaagttacctaccatacattgtgccaagacctctcacattatgtgaacagaatattaaagaattataaaagagggagcaattgcctctgttaagtagacagcaaagatgccttataggaagtagcatttgagacagattaagtttctttttaggtaaaaatatgtcccctagagataataataaaataatagcaacggatacctatgtacttcttttactaatgcaccagagtctgttttacatatattctctcatttaatccttacagcaaccttatgaaacagtactgttatcaccttgattttacagagaaggaaagtgagccaaagagaggttatgtggcatgcccaaggtcatataactattaaatgtcagtgctgggatctcgtacattttcactcttaggacatctgtgctatccctgcttagtcactttggcatcccagtggtgctgtacttttgctttcataatacatggaagccctggaaggattcagtaaagagccagtttcaccctgttagcccttgttgctttatttgtaaaatgtcaactgtaaaagtatgcacctaccttatagggtgattatgagaattaaatgagataattcaggtaaagtgcttagcatattgcttggcatatggtaagcatttaacaaatgt

SEQ ID NO: 848 - DNA, 1023 bp, Homo sapiens
atgtttaatttttttaaggttaactgtgtgcaaatgcatatttgctgtccaaactagttaatgggcttacaactgaagggtgtaaattctagtatctgtattctccagcttgaagcagtgttgtctgaagcctgaaacggctgatgttaatcttcagcttattttgttgatatccaaaaattaacttgaagtagaataaaatgtgatgtaaatcgacttctctgcatactcataacagtgtcaatagttaaaaaataaagtctatataggtcacactgtttaaaaccttaaaggagtgtgtgtgtgtgtgtgtgtgtgtgtgtgtgtgtgtgtgtgtgcgcgcgcgcgctgtgtgtgtgtgatgcatatgtatttgtgtttaattaaacagagggaattgctggcttttaatcaagttgatgaattttgaatttccacttcagtgatggctctaccttaaattcatttggctgatgtgatagcagtattcggaatgcaacgaagagataagagtttggaccccatatttataatattccagaagaatttcattatgtaatggctagaaactcagatttcccacagagttgtagagtgtgcagtttggcatgcttatttactactctggttcttttttttttttttttttttttgagacggagtctctctgtgtcacgcaggctggtgtgcagtggcgtgatctcggctcactgcaacctttgcctcctgggttcaagcgattcttctgcctcagcctcctgagtagctgggattacaggcgcctgccaccacatccagcttatttttctatttttagtagagatgggatttcactgagttggccaggctggtttcgaactcctgaccttgcgatccacttacctctgcctcccaaagtgctgggattacaagcgtgagccaccgcacccggccactactctggttcttaatagtgaaagatttatacctcaaaaacactctgtagataaagaaggattcaaatatgattctcttaatattgca

SEQ ID NO: 849 - DNA, 1001 bp, Homo sapiens
acctcccattttgaaataggaatagtccttattttaagggagaaggagtggtgtgaagaaacgtggctggtacccttcagtagaattctaaagaccagaaatgtggttctcgtgtttccagtggttcatacagatcactcttcaatgctgtcctctctttgtgaatatgtttagctctttttatgtttacatttgaaattttaaaataggattagatggagcattcttggaaaacagtaacaacaaaatttaatgaagtaggtcccttcgtgcaaagcaaaaaagacatactgctggttgaggatatctgttaatagctaccatttattgatcatttacaaaatgctaaggaaaaatgcaagtcgatttacctgtgttgcctcatttgattctcacaccacttctattctgtggcaactgctaacactctcattttagagatgagcataccatggcttatgtagcatttccaatcttatgtaccgtatctcgtgagtagtagacatgaaatttgaactcagatccgtttgacttgagattgtatatactacattgcttccttcctgggaagaaaatggaagttttttctggttccttctaatcgtagcttcatagatatgtggtgtgcttccaagtgtgtatacttttccatgtatgctaagttttggtgatgtattaaaaaaaggttgaatggccaagtacagtggctcatgcctgcaatcccagcactttgggaggccgaggtaggtgggtcacttgaggtcaggagttcgagaccagcctgggcaacacggtgaaatcccatctctactaaaaatacaaaaattagccgggcgtggttgtgcgtgcctgtaatcgcagctactctggaggctgaggcaggagaatcacttgaaaccaggaggcggaggctgcagttagctgaaattgcatcactgcactccagcctgcacgacagagcgagactccaactcacaaaatatatatatgtatatatatat

SEQ ID NO: 850 - DNA, 1023 bp, Homo sapiens
ctccctcctcagcctcccgagtagctgggaccacaggtgtgcatcaattaacttttttatgcccaactaatgtttttaaaattattttttgtctccctttattgctcaggcttattttgcagacatttttaagacaaaatttttgttatgtaagactttttgttataaaaattgttatataagactttataagacataaaattttgtaatatgaggcttttcctggttgaaaagtgtttcatttttcaatgttttgtatttgtatgaaatcagtctttttgccagcacactgaatcttgtcagattggatgcagagtttctttctgcaacacttttactgtttggtaacaaccttttcttaggaggagaagctacagatactaccttggctgctaacaagttttcagattagaccaatttcacagtgttgactagggaagaaaactgattgaacttccatgggctttagactgaaaccaatgactagcattttatctcttttggatgtgagcatgattagaagtcagtctgaagattttctttcaccagcattgataattcttgtcagtgcgacctcagacacatattgccttcttttctgtgcatcctctgaccagatagaatttcttctattttggatgacatgctgcattttaaagatgcaaggtgtaatctagataaatataaattcattggatgctacctttggaaaagagctgaggattatcttagagctgttcttttcctctttttctttcagaattgttattttctgctcaagattgccctcccaagcctacctcatggcagcacacacacacatacagtcacattcaaacacaccattgtactgttacttgcaaaattttgcatatttgggaccaacatacctgttattctgaagtgctgtcgtatgaaagaataagtaaaggtactgtttatatctttcgatgtatgtctagcactaatgggagttaggggacagatagatgtcaactccatgcaaagaaagtcattatgaca

SEQ ID NO: 851 - DNA, 1023 bp, Homo sapiens
tcagttcatggtgctgggtagttcacatttctggaagggctgtaaggtttgcataatcgtccagtgctatcatcatatcatctttgcctggaagatgcatctgcatagcttcagtagtttttaatgtcttgggatgcccaacccagtactgtgggtttcaatttttatctgtcatcgccacaaacccctaaattaaaaaaaaaacatgaagaatattcaggtgactataaacatttcaaagaaggcctctacttcttgctctgggtaaaaggtagatgcagtctcatggtggaacatgagagttatctcagttggctcttgaaatgagaatgtttcactgtttcagctgaactgaatagtcactttagtttttaaaaacctgctcaattcaacaaaacatgattgattgctcaggtaaattaattgcctctgagacacatgtttgaaatagatatctatactctctctgatactagtgtgtagcaataacttttactgtcctattttgtttaactgtctgtgtatgtatgctctaaaaaggggattgaggctggaagcagtggcttacgcctgtaatcccagcactttgggaggccgaggcaggcagatcacttaaagtcaggagttcgagaccagtctgaccaaaatggtggaaccccgtctatactaaaactacaaaaattggctgggcgtggtggtgggtgcctgtaatcccagctacccgggaggctgaggcaggagaatcgcttgaacctgggaggcaaaggttacagtgaaccaagatcacgccattgcactccagcctgggtgacagaatgagacttcatctctaaattaattaattaattaattaataaaaaggacattgattaaacttttttttttcttttttcttttttttttttgagatggagtttcactctgtcacccaggctagagtgcagtggcgcagtcttggctcactgcaacctccgcctcctgggttcaagcgattcttctgcctcagccttctgagtagctggg

SEQ ID NO: 852 - DNA, 1052 bp, Homo sapiens
tgagctctgccacttaagaattctgggactttgggcaggctgcttattatccactaacctcaatttcttcagctcctaaaagggcagttgtcatacctatattatggcactgttttgaagaagaaatgaggtaatgcctaaaagtgtttaacatagtcactggcacagagaagatacttaataaatgttgatttccttcttgttcagcaaaaccttaaggcagaaagctcctaaggcatgattatatatttcattctttcagtagcatttgccaaacatttttaccatattgttgctaagtaggtaaaacagaaagacacatatctaaatatgcagagacatattttgtaatggaggtaccactctgtttttgtaaggcgttgctgattctcacttcgcttctgcatctctgaatatgttacaattgtaagagatgtttgaagctttggggatcttctaatggaaatgggggttcttcaccgaatgttcatgtaccgacttcaagaggtcaaagaatcacgaattgatatacaaagtggtgtatgttggagtatagtcgtcgcttggtatctgcaggggattcgttcccagacattcccacagatgataaaatccacggatgctcaagttcctcacagtcagtccttcatgccagtgggttctgtatccatggattcaatcaaccacgaattgaaaataccgtcatcacgtaaaacttgtaacatacattctaggaaaaagaagaaaataaaatcaccttgggaaaataatccttaaaattttactatgtagggatttattcttccaaacatatatatgtatttttgaaatcctttaaaaaataatgctgtatcacaagcacctttccctattatgtattcttctacagaatcatttcagtgggcgtatagtatttcatgttattgatggatcatttgtgaaaccaattctgtgatggtcactgagtttgtttgcaagtttttattattataattaatgtggcaattaagatctatattgctcaaacatgactgtgtacttatagatcatct

SEQ ID NO: 853 - DNA, 1034 bp, Homo sapiens
cctgttcatattgcctccctatccatcagagaatatcttaaatgccactgggatacttgatgccatcccctccatttgtgggtttgtgggctagtccagcaacaggctttggagaagttactcgctactttattataacatacttaaactcaatagcaattcaggccttactgggtatttacctaatttattgtggcaatgcggtatttagaccactgattaagtgaagtttgtcagtatagttaaaagaaattagagacactatcattgctaaatcactttacaattcaaagaagaattgtaaacatatgaatccatttaattataatagtgccaattataagagaaattgtaacgctgggaacagtggcttttatgtaatcataataatggcatgtatttatcttggtttggcaagttaggcctttctttaatacttggctttgcctaaatagaatgtggtttgctgaaacccacaataacccccacaccctccaatttgttattgcagaaaatactgaacaataatcatgcggtatgaatgattaatgtatgcatgggttagtaagtatatttgaggtttaaaaagtgtttttatttacattcttctgttggctgaaggtataaaacaaataaatataaatccacatgttaaatattctcatccctttccatacagatacttgcagtgtgaatacaatcatagctttaattcattgtttctgtgcttttttggtttactcaacacgtgtcttttaaatatatttcaactgtagtatttgatagtaatccattttttaatttactaagtactttgaatatagcttccccaaaacatagaaataatcaatttaataatatctgaagattggcaaacttcatttataatgttgtgttcaaataatactatcagaataacagttgtttgaagagtgtatgtataaaaattacattctctatttaataagattactattattattgaggaagaggtgctatctagtggtataaacaaaattattatggaattgaaa

SEQ ID NO: 854 - DNA, 2055 bp, Homo sapiens
tattaaaccaaagtttgcctcatgctgtcgacgttaagcagccacttggtaaagcctgggaagtaacatgtgcctcaacagttagcacttaaagactgtgttttaacgagtctccagatatgtatttacatgatagaccatactaacaccttttagtgttatctgtcaatcaagatttcataatattcctttacaaaatgtatctgctgtccacatccattatcctactctacttactttgtatttttatgtatttattaggaattcatagtcacctgacctcttggcagccatccctaaacttcacattaaccctgcttctcagggattgcaggggtcattttaacccccatgaacctgaaaggtccaaataattcagtccaaagatggttgaaaagggatctgcaaagtctcctcccacaaagaaatgctttatttcatgcatttggcaaccaacccctcccatctttttatttttatttttatttttggtaaagggattttacatcagacagatattattaaaaaattttatttaacactcagacacattttattctaaaacgaatgcttgctcaagagtctaagaaggcttcatgggaagagcaaagcaatctaagccatatgtattgggcaggttgccagttgtttgccaatatgcccaagccacctggctgtgcattcagccaagtatgccattccgaccagccagctttaacctcccggctgcttttcagcacttaggaaactccaaaggcctgggagctgcacttcatttctcccatgccaatagttttcacttatacaaactgcacagctacactgaccggtaactctcaaacgcccattttgaatgagctctccttttgtttaaagcaccattcactggtgttgaaccagtgccataagatgagtctggagatagcagactgaaacctttacccatatgccatagacagacactttgactgacaagcagcatttttttcccaagcctgtagcgacagggttttgtgattctggtttgctgagatttggattggctttatttgccgctggtttcaattttattttgggtggttctaacttttaaatgtttggaaacgtttgttcatttgattttccctttttgtttagtttagaaattggttgagctgtttcataatttatcaagcttgatttcataatctttggcaatctaggtcaggaatcatgcagaacaggcacgatttgatgatgggatcttgaagactgattcgttctttttaaaagtcacgatagagaaagctttactcctgaaaggcggtattctttctttcatcagggcgtaaaaattatataatgccttgtttccctttttgccttggctcccaagaaactcagagataagtttaattcttaaccttggtgaatatttcagcctaagtttttgcccccactacttctctaacccctgcagtttttgttcatgtttttcttcttttatggacttaaatgtgtatgtgtgctaatttactatatgtttatgaaccatctcaaattatttttggaaggtagatgaagtaaccagtaagtaaataaaacttcagattagaaactttagtctattcctaattaaaatctttaagtggccttgtctggtatcataagcaggtgtttcagattcattatctcaggttttaaatgaggaaagctgtgaatatttaagcctagaagtttcattattataaatttttgtgctagcctttggactgaccaatttattattttctatcactattgtggtctgtacattctcaagttgatgccatttccctcttcccggctcaatgaccactatctctcagatcttgaagatctgttttggcttggttccaatttaatcagtctgaatggatcctattgagtaacttgactcattcaccctgctaaagagagtctgaatacactatttctgaaggtttttttaaacctattataatgttcttttttattagaattgtcagtcatttcaggaaaaacatgtgatctgtatgtaagtgtgttttgagagtc

SEQ ID NO: 855 - DNA, 1052 bp, Homo sapiens
cattaataaaaaagaatgcaaatatattgcccaaaaaaatacacaaattattgtctttcatataggggaggaaataaatatgtttcatctgaattgtctgaagtaagtcatgaatggagtcagggtaaaagaaaaaaaaaaagcaacgtaattttttcctttattggaaccaaatttcttaattcctctgtacaaatcaacttgaccattttattgaactaaaaagcataaaatataagatcacgttaaagatattcttagaaagataaattactatgtcatttttctcaatataacccgcaaattactcagtcatatattctgaaaataaatatcttttgtatttatgcttgaaattttgtgatatatttatagtgcagtgaatttttcatcccatctctcaaatattttctcatgtacataggcctccaaaacatcattgttgctctaggtaagatcttaggaaatgttttattaaaatttcttgtatttgattttgtttgataagctcaaacaaaaatggaatgtgaaactagatgtcatctcaaagagaaatcaatattggttcatttattgaatgcctactatgctaggtgctataagaatcccatccttgctctgtgatcaaagtctgattgaatcaggagctgtgtgtctttccttcctccccaacatgcatttattgccttttcattcaaattttaaatattttaaatgttgacttttctacaaaaatctgggatacaggtgtgaaaaccttactaaaaatcatgtggaacaaaaagaatttgatacaatttagcattgattccaaattttttaaaaccagtaacaaaggagaatagtatccttaacaggataaaattatctatgtcatgtcaacagaaggaatcatactgaattgtgaaatattggaatcatctcccctaagatcaggaagaaaacaaagatggctgctatcaccattattatttaatgttcttctagaagttttggacaatgtcatattatatgacttagaaataagaattataactatctgaaaggaagaa

SEQ ID NO: 856 - DNA, 1035 bp, Homo sapiens
gtccattgggggtgtgctgtaattgctcttgatgccacacttaatgggtgggggaagaaagtagcattatgtgtgaggggaggtgagagggatgccctcgggccgttgctgacatctggtcaccactcctgttttgctggcttgtctgtttggtgcctacaaatattgggcctttgagttgagtttgctgccaccattgggttccttgcagccatcattatttcacagctgggccatggttttaacttggaaaaagggcattcatctcagggccagaaatggtctactgccaacatgatcctgagaactttcttagtttaataaatgagagaataagtattctcatgagctcctgtatcaagtgtttcctggttttgagcttttttgttttttggtgagaatgttatctttcattgttatttctgaacccttaaaggactaaatttccttttcaagagtttcaagtagttcttgtacatgtgtgcggtgataagcaaacattagtctgagaaagttctgaaaaatctaattgagccagcatttaccaagcccttctatgtcagctactgaactaggtgcagggaaaaaaataaaggtcctcaactagctcaccctcaactagctgtccctccagctagagaaccaaacctctgcataattaaccataataatgggcagatagattcaagggagaatgcagtaaaatatgtaatatcatgagtgcagtttttatctgtgtgcacaattacgcaagccttttaactaaaaggcttcggtgagatggatttcgtaaaaatgcacagaacttcctgaagcacaaattagacagttccctaatattaaaacacagccctgagaggtagggtttcaggctttctggaacccccaaacttgaattggtccacagaactaaattagaagtaacaacctttccttatgatgtgtgatttctcaaatggtggcatcttcccagagctgtgtgttcttttgtttggagcacagctgcttcctattgttaagttgcaccggagagct

SEQ ID NO: 857 - DNA, 1104 bp, Homo sapiens
taaaaccatgagaaattatcaagtacagatatcatatgatttgcttgaaatacttttgcattatgcgttactttctcctgaccttctaaaatggggcataagtccgaatttagaaagaggaaaccacatgtgtaataagggaaacagactaaggagacatgccatgtgtatttcagatcttattgtgatgggtaaactgtttgaaatgtggtcacattaaaagtatgttactttgtgggagactcaaaatcttttacgagtagatttttattgtgttccatagtggaaatagaactagggtttggttttggtgggaagttttggtcttcaagtcaccttggcacctgactggcagttgtgaaactaagtagaaaagatacctcttttttcttggcacctcacacgggatcataggattcttactatcatacaatttatatatcacagaaatgaaaacttcggtactttgttgtataatacagatcttgtgcttgttgatttttaatttggggctcaagcttcccatgtcaactaatgtggccgctgctaggctgccctcgggtagaccaaatgtaagctcactaggaagtatttctagctctgtaaatacctagcatatcgtttagtccaggcatgtccaatcttttggcttccctcgaccacattggaagaagaagaattgccttgggtcacacataaagtacactaacattaacgatagctgatgagcttaaaacaaaaatcgcaaaaaaatcttagcatgttggccaggcatggtggctcacgcctgtaatcccagcacttggggaggccaaggcgggtggatcatttgaggtgaggtcaggagttcaagaccagcctggccaacatggtgaaaccccatctctactaaaaatacaaaaaaaattatctgggtgtggtggtgcgtgcctgtaatcccagctactcaggaggctgaggcaggagaatcgcttgaaccgaggagacagaggttgcagtgagccaagatcgcacctctgcactccagcctgggtgagaaagtgagactccatctaaaaaaaaaaaaaaaaaaaaaaaatctcataatgttgtaagaaagtttac

SEQ ID NO: 858 - DNA, 1149 bp, Homo sapiens
tgatcagctattgaaatagcacgtatgttagagacagtcctcccagcaaacatgattttctattaaaatacatccaggtgacaaaaaagaagcttttagaaaaaaagaatttgactgagcgtggtgactcacgcctataatcccagcgcttcaggaggctgaggcgggtggattgcttgagctcaggagttcaggaccagcctagccaacatggtgaaaccctgtctctactaaaaaatacaaaaaagaaaaagagctgggcatggaggtgggcgcctgtaatcccagctactcaggaggctgagacgggagaattgccagaacccggaaggcgaaggttgcagtgagccgagatcgcaccattgcactccagcctgggcgataagagcaaaactccaccttacaaaaaaaaaaaaaaaaaaaaaaaaaaaggatttcccgaaggtagtttatttggcaaatcccacacaaactattagtagtccttatacgaagacaatttaattttgggattattactaagcaaattactcacaaatactgagttactgaaatggaaaatatttttatctccccccagtgtaactacagacaagaatgtagatagtgtacttaggtgtaaatgacagatggaatgaactttgggtgaaggcgagagcacagaagctcagtggtactgagctgggtttgagtgggtgggaccccatgactggttactgatctttgaaagcgtttcaggatttcaaagctacataagcgaattcacgtgttttagttatctaggtttgttttttccttgttatataggatgtttgcagttttcccatttgtatcaactcatacatctttgaagttttgtaattcagtatagctttggttatagattaaagttcactggaaaatcactgactaatccttttagcatgttccactgttccatagtataaagatacacagaacttgatggcttccaagtgtggttcaaacatccaaagcactcgagattagcaccatgtgaagaaattttaaaatattgtactgcaattaattttaaataacttagcactgcatatgtcagggagaaagccatggtagaattcaaacagaagctcctataagtgaaatgattcacttacatcatttaaataa

SEQ ID NO: 859 - DNA, 1099 bp, Homo sapiens
tcagtcctggtactctctagagtcaggtatttggaatgagtcagttgaggttcagggaggtaaaggggcttgcccaattcctcaaagctaatataaatagccaagaagggactcaaacccaggttttcttttatcatgccttttgccttttttcactataccatagctacttctggtagaactgtcatttctattaaagggaggataccaggcctaattcagaataacattctgtactatgtatgcaattgtttctaaggagaaaagtctgatttaaaaaaaaatatttttatacttttaggctgggtgccgtggctcatgcctgtaatcccagcactttgggaagctgaggtgggtggatcacctgaggtcagtagttcgagagcagcctggccaacatggtgaaaccctgtctctaccaaaaaacacaaaaattagctgggcgtggtggcagcacctgtaatcccagctacttgggaggctgaggcaggagaatcacttgaactcaggaggcggaggttgcagtgagccgagattgcaccattgcactccagcctgggcaacaaagggagacttcgtctcaagaaaaaaaaaaattggatactttacaccatttccagcaatgctagttatgcagtaatagcttaatatttcacttaaaaaaagattctgcctaaacctctctttatctcactagaagagctaaccctaaccactaccaccgccagttagtatcagggctgctgtaaattgttccaagggtacatttagtggtattgattgctgctaatagtaaaagaataaaagcaattatgaatgtacacaacaacttgttgctctaccccagtttcaccaggagataggatttagtcaagaggggatgtcacagaatctttatcctgattaggagctttttgaggggagggaccttgccttttttcattttgtatctccaggtatacagggtgaaaggcaccatagtagatgccaagcgaatgaatgaatgaacgagatggataggcccaaagacaactaaatcaaaaaacctgtgttgtttcagaggagaatgatccagtatcatttcccctttgggtaggag

SEQ ID NO: 860 - DNA, 1030 bp, Homo sapiens
agactgtattttcccttttcctgggagctctgggctcaagattttgcaggtgtgtcatctgatccatggcttgcatcgatcaaaactgtgccaatgcatatttaattagcaaggggaccctggatgcattatagccatcatccctatattgaatggactgtcagactctccgcacacttctccacccccaccgtcccctgaacccgtgctccctcccttgcctcgttgtttgggaagcttctgcattttgtctgagcagctaaaaagtttctttgtttttagctgctgatgcatacagcgccactgaggagaatacaaacaagtagagtcctaaagtgtttattttgtctaggaagacaagctaaaccaatttgattccttcggtaagattttcaaaccctgtagaaaaccgacaagaaaagcaaaaagaaaatgaatacactgttcaactcttcacgtatagaatttaaaaaaaaaaaaaagaattggttatattaggaataaagaagacttcggacaaatattttaataatagaattaaagaatactttctattatgatagaaggtattttattttaaaagctctgttttgatacttaaataagacatttgttgttggcaaatattttattgatcagtctaatttgcttgatgcaattcaccattctgacatgaatctgtcattaccattaggaaatccaatgcctgtacaaaagttatttatgatagaaggtgacaaagagttagagctggatgtatttttttttaaagtttctaaggttttgtgggtgtttctgttggtgagaattcttaaagtgcaggaggtttggagttttgccacagacaggttatttcatgggattatggtcactgttcattttcacacaggttccaaagcttgaatatccagacagtgttgtctgataaacagatgtaatgcaccaagtctgcttagaataaagagcaacagactgtgagcacatgtttaggactcatttaaactcatcagcatagtctagctcatagttc

SEQ ID NO: 861 - DNA, 1029 bp, Homo sapiens
cttgtgacctatcttgtaatcagcacaaattagttttagggcaggaaaatccagctgcatattagttttattagatgttcccaaacattttattgcaatattttggaaaaaacatccacaaacaaacctaagttttcaatgtgtttcctattcaatatgtattttgttttgaaggataattagattgtatgtttataattcctttgttcttaattcatcaaattgctgccttttgggaaaataatttcagcataggaaaattactctttttttcaccaacctgttctcagaaagggaaatgtatctttagtacacccccaactcccaaaaatgttctccacattctaaaaatgcttttaaaagttcaaaccattattcctcatttggttctaatgatattgaaatggttttttcctattttgagggtcacaattgctactgttaatctaatggctaaatgatctgtgcactgtgtctgcttttcatcttcattctctttttattggtgaggaaactgaggctcaaagcgattaagtaccttgcacaggtcaaatggcttctaagaggcagaatgtaatcattccttctctcaacattcaggaaatatttaatgagcccatactttattccagataccttggtagttgcacaggatacatcactgaataataaaatccctgcccctcaaggagcttaccttctagttgatggagacagataattaaaatatcaatgagaaaagtatctagtgcatgagatgataataagtgctatggagaaaaattaagaaagaaagaggaatagggagtccagagtagttttggtttgaaaggcaatgatggccacaaacacattgctaagaagttgacatttgaacaagacctagaaaaggtgagggagtgcgacacacagatttccttggggaagactagtgtggatggaatgaagacagcaaggtgagcaggagaaaaggaactcaggtaaaagcctggggcagttcatgcaggacagtggctgtttgacttcagc

SEQ ID NO: 862 - DNA, 1083 bp, Homo sapiens
gcacagccaggcattgtctgtcttgacatatcagggtacggaaaactcttatgctgtaagaagagtcacactaagccaaagtttaggaaccagcctgctccagtatgccttttggaggacttttcttttctaattcaccttgccttcctctgtcacatctaacccaatactgtccatataggaaaaattcagaaagtattgggttggtgaatgcagcacagattacctatttaaattaaagctgtgtctttagggaaaaaaacttctgggggatgggagcagtggcatgagcttggaaggatttttgcattctacagcaaaccacagctgctatggccttaatgtttgtgtccccccaaaattcatatgttgaaatcctgactccatggtgatggtattcagaagtggggccttttgggagactaggtcatgaggctagaaccctcttgaatggaactagtgctcttataaagagaacacagagagctagctagcccttctgccacgtgaggatgtggacggtgtgatctatgaggaagagtgctcccactgggtaataaatccgttggtgccttgatcttgcactttctagcccccagaagtgtgagaaatagatttctgttgtttataagctactttgtttatggtgtttcgttacagcagcccaaaaggactaagagaacaccaccacccaacaccagaaaatgggatttgcttaaaccaatctgagaatcagtcacctggataagtgtgtcgagtgatccattgaatcagccagcaatgcataaagaatcatttccagtacccacatatgactgtgcttctgttttgtgttttattaagttgctctggagtaatgccactatcagtgcttccccagcacaaggaggttggcaattgagttacctgtttgtgacagctaaactttcatgaatctttaggagatccatttgctagcatcttttaaagactctggatttttctgagcattttgtgatgataactgatgcatctgaagtagaggtgggagcccttctttgtcaagagttagaaaatacaggctgtcttgtcttcctataaatg

SEQ ID NO: 863 - DNA, 1062 bp, Homo sapiens
agggtttacagaccagaaatctgcttggcaaaggagttgctgaagactgtggcgtagaagctgcagagaaagtacctttatgattgatttccattcaagtcagactgactgcagtgtggtcatttttctaacccataactgctcacactgcagcagtctgctatctgcagggtgtctgaattatagcagtctatgttcgtgttacctcttatacaaattacttacactggtttctttttccatgcaaattcatcagttttacagcctctcacagccacagtcaggaaactctggcagagagcacaaattgataaaatgagttaatttttactatacttattttttttctttctaaaagccctttctcataggcagtgttcaggaagcatattacggtaaaagggagataacaaaggagttgaattttcttgccataaattactttccaagttaattccctttaacgatgattccagatttgcttgagttttcatagcattgtgcgttttacaactgtgcctttgatagaaagaagaacaagtattttcccatgttcagtccctttgtgccagtgacatgaactttcttacaagatctttgccactggaatgcaaaacaacactaaattgtgctgggtccatagaactctgtgctgctattggacttttcccctcccccggtcttcaaatacaagttcccaaagtctcactgagtgttttagatcatgtaatcagaagaaaaatatctctccattttttcatatttgtaagttggaaattgagttgggttacttattgccattctttcatattcctcggtggccatacagatttgaagaagggacaataatggtcagtctctgaaatgtaagccccacaagggcaggggttttctatatcttgtccactgatgtttctcaagcatctggaatgatgcctggctcactaaaagtgctccataaatattgttgaattccattgaatacagcctctctgaggatatgtactattaaccataggctggacaaactagtcatttcgttaatgctccctgctgacttcc

SEQ ID NO: 864 - DNA, 1024 bp, Homo sapiens
catccagtgactcaccagactgaacagaagtttaaaaggagtcctagaactacattaagttgcccaattgcttcctcccttggctttctttcaaccagaggtgcagtgtccaagagaaaggtggttgcgattgcttttaaacatgcacccatttgttatttcagctccacaaagcgcctcaagtctgtggaggatgaaatggacagtcctggtgaggagccattttatacaggccaagggcgctccccaggaagtggcagtcagtcaagtggatggcatgaagtggagccaggtaagcagagtggcggcacgggcatgtggctaacactgtgaaactgaaaatacgtgtggggtcccatgccacgcataaaagtgaagaaagaaagctcaaggtagttcactttttcaggatgagcacttgtttgtattgtaatctgattgccacattcataaaaggatggctgtgcaaagcagtagtaattcaactgaaatgcaagactggtgagatggtgtatgattttctgctcttacatattttcccctacaccacaatccagcatttgatttgcttttggtttttttgtttgttttgttttgtttgtttgtttgcttttttgagacagagtcttgccctgtcgcccgggctggagtacagtggcatgatcttggctcactgcaacctccttctccctggttcctccttcttctgcctcagcctcccgagtagctgggattacaggcacctgccaccacgcctggctaattttttgtatttttagtagagacggggtttcaccatgttggccaagctggtcaatttttgtatttttaaaagagacggggtttcaccatgttggccaggctggtctcaaactcctgaccttgtgattcacccacctcggcctcccaattgtttttgtttttatactatcttttggtttagtttttgaaattatcttttaatcctaataaaaatctatcaactttttcagcaggatcgataacattcgaaagaagaatgggt

SEQ ID NO: 865 - DNA, 1031 bp, Homo sapiens
actgtgattaattagaataaattgaaatcaaatacagaccgacttatcaggggactattctgtcacctctttgtttctgtgacaaatgcaaagcaattcacaacatctttttcattcacaggtggatttctctttttgtttgtttttaattctttaaatgttatcttttaggttgcacaaatcattgttccatgaattaaagtgtacttaccagttgatccttcttgccaggaatgccatctccaaccacactgaagaagtcggagaagtctggtttcagcagcccctccccttcacagacctcctccctgggaacggcgttcacacagcatcaccgacctgtcattacaggacccagaggtgagctgctccacaggcacccttggttgtgcttatatcatggcctttggacccaagtagcaaaatgagaaacaatgaggactccccctgaacactcgtgaggcagtgagtgttccaatttcttacccttgggggcagccttggaattttagagaccaaagagatttggcatcacattttttgtcctttcctaaggcaaaaagagaccaaatctgttttttgttggccagtgagatttttgcagaaagatgggaagtaacttgaattgaaccaaaatcaaatctgttctacaagttgtgtgtgtgtgtgtgtgagagagagagacagaatgtgtgtgtgtgtgcgcacatgcgcgtgcacacatgcatgcattgggtgagtatatttccatgtggtcaattacctgttttcaagtagtagctttttctcatccctgctgactctctttccataaaacctgatttcaatatgtggcattttgtgttgaggttgtttgcatcagggtgttgacgagcagtcttcattcactccttttgaagtggtagatagtttgtctggttttcattgcaatgttttcattatttttgtctcatatgcttttaagtttattattaaaatgtgtccacgagaaatatgatttgtatttcgcattaaagacaagccttaagcct

SEQ ID NO: 866 - DNA, 1050 bp, Homo sapiens
cttcttggtgctaggattcagcagggaatccctggccttatggaactttgattctagagagggaagaaagacagtgaacaaaatagtgagtacgaaaggtacgtaggatataagatggtgatatgtaagtgctacatagggaaatcaagccgagaggggagggatgcagctctaagcagggtgatcagaggagggctacttgcgaagggcaaatttgaacaaagtctggacaaagacgagagggtgagcaaggatgcagtaggaggagaggtttccaagcagaagaaccagccagtagaaaggcagaccaatgtggtgagatcagggaatgaaagcaagggggtgaggtcagagtggagtgaggatgcatttgggaccttggggatgtaaattacaccggttcttataggctcttataaggacttcagcatttaccctgagtgagatggggcagagaggtaatgccacctagattttaatagatacatcctgaaggttttgttgaaaatagattgtcaggagcaagaattaaagaattaaagcagggagttaaaaagctggatttttccaataaataaaatgagcgtcttctacatgccagccagcattctaggtataagggatataaaagtgaacaaaacagacaaaaatcccttgccctggtggagattacattttagtggaaggggataaacaataattaaaatataagtaaattagcgagttaaggaccagtaagtacaatggagaaaactaaaacaagcagggttgatagggaggggcacttattgcaatcttccaggcaagagttgctaatgacctgcaccaacgtgggagcaataggggtgatgagaagtaagcgggttccaggtatatttgaaaggtagagctggcaagatttgctgacacattagatgtgggttgagaagaattggtgatgatgcctgtgtttatgacctgagcaactaggatagagttgccagcagctgagatgggaagaccacaggaggggcatctctgggtgaggggtggagatcagaagttcggttt

SEQ ID NO: 867 - DNA, 1436 bp, Homo sapiens
caagtatgtgatgcacctaatctttatagtcacctaataggatagagctctactttatagatgtggaagctgagactaaggagattgttgattttcccaaggccatacaatatagtcaggagtggagcaagaatttgcacccagttctgtctgacagcaaggcctgtgctctctaaccactgtattatgttactgccttatgagctggtgagctcttttccctggggatattccaacagcaactgatgctcacttctcagggatactactggtggagtccctgcttttgtccctaagactgcattaaaatataatctttagcgtatacccccaaaaatggcaagcaaagtttcaaagagatatttgttcacttgtggttgtagcagcattctccacaatagccaaaaggtggaagcaacccaagtgtccattgacagatgaattggttaaacaaaatgtggtctatacatagaatggaatattactcagcctttaaaaggaaggaaattctgacatatgccacaacgtggatgaatcttgaagacattctgctcagtgaaataagccagtcacaacaaaataaatactgtatgattctacggatgtgaggtacctagagtagtcaaattcatagaaatgcaaagtagagtagtggctgccaggggttaggggcagggcagaatggtgagttagtgttaaaggggtacagagtttcagctttgcgagatgaaaagagttctggagatggatgttggtgatgtttgcacaacaatgtgaacataccaaatcccactgaactgtacactcaaaaatggttaagatggtaaatgttacattgtgtgtatttcaccacaatttttaaaacgtgatcattaaaaaagttctaaagtccttttcacctcttaggagtaaaaaattctgtaaaacagtcagagcaagtggactgttgatcagagtaattgtgtgctgactgctcagaaaagcactaattatcatgcccagcacatagtgggtactctgcatacattggctgagtctaaatggttcagaaagaactttaaaaatatgactttttcttattatattcataatacatgttaattgtggaaaatacagttgagaaaaataataaaaatcacttgtagtcctactgttaacatttctgtataaatccatccagagtgtttctgtgcatacaaatatattgcaaaaagtgagatcatattatatacgctgtttggtagcctgctgtttcttccccttaacaatatattatggccttctttccatgtaaattggaaaaattgaatattggcttttattgcatctattcatcatctgtaatgattggtggggaaagataacgtggataattgaaagccatttttcctcctctttcccttgtagtctgtttttttctccagagaattcctccc

SEQ ID NO: 868 - DNA, 1038 bp, Homo sapiens
agaacatctattttgccagattcctttttccacaaatttttagagctctggatactgtctactttggatttttatgaagagggaagaaaggatatttaaatgtctttatatgatgactcagacacatgtgccctgtaccattttcaaatccattttaagatgccagtatttttcaaaagttttagaaatttccttaaagctggtaatttccttaaagattatctactccagactcccatcatttttcagatacaactttaagaatattttggaataaagttcatatcattttaataaagtagcacctccaaataagaggggccaaagcctggggaactgaaacaacttgcaaggccccaaagctaatcagagacagagcaggactgaaatgcagggacctgttatgagtgaaggaagggactaatggtttaatatgtggcttagaaaatgggtgcatggtttccattttacaaaggtgttttataaaagcccaatatcattagactgactcaaacgcattgcaattccaaggaacaaatgcatgtaattcagaagttcactttgcaggatttactttcatagactgccgtgcaggggtgtgtgtgtgtgtgtgtgtgtgtgtgtgtgtgtgtgtgtgtctgtctgtctgtctgtctgtgtaacctgtgcttccgtctatgctcctggacagcttttttttgcatattttcctatcttctgatcttcacagtgcagacaaaggtcaaaattcccatctaccttcacaggcaaacactttaaagtgcttctacatgaggcaggttgtagggaggacctttgatttaaagttcagcatttacatttgtaattttgactaatttctgtgctagcattaattaaattgaaattatttaattagaataaaactgaaattgatcattaggattaatttaacctgatagactttgtgtgcctttctagacaaatattatgaaatatagtgataatgaagtagtgagaggtataatttcacatcttataatgattttagtatccagt

SEQ ID NO: 869 - DNA, 1044 bp, Homo sapiens
aggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggag

SEQ ID NO: 870 - DNA, 1093 bp, Homo sapiens
tgcatgaccattgctatgttttcttccttagggttttgtgtagatttggatgccttttttaaagcccttattttaggttccggtgcaaatggggagaaatttagtgcctgtcaatacccttccttttaagtcagtgggatagatcgatgctgaagatgtagagctcacttattttttgtgttcgtacagctgtccagccagtaaagtttggagacaaggaattgggtccacctaccatataacgcttgacaagtcatttaattctggtcctccagaatctggtcccatttgcaaatggtctgccttacagagatttggcgaggttgaaagaaaagaatgttcaagaatgtgtcttgtaatctgtaagctgttattctcctgctttttgttcctcccttatgtttaattccggtaaaattatggagttgtgatctttttattgggaagaactcaagtttgtgagtgctcttactcagatagttactttaagaaaaggcatagagaccatatgagctgaactgatgaagtctttcctaaaaacacggtggaggaagaaaaaacaaaaccaaacagggatctttctggaaaggcatagattaaaactttactacagtaagccactctcacacgtgggcatgggccactttatattgggttagttaggattgaaatgtgctgtaaatgcacaatacacacaagattttgaacagatttcatgtaaaaaggaatctaaaatatcttattaatttttattttttgagacacagtttcactctgttgcgaaggctggagccgcctcctgggttcaagtgattctcgtgcctcagtctcccaagtagctgggattacaggcgtgcgccaccacaccctgctaatttttgcatttttagtagagacggggtttcaccatgttgctcaggctggtctctaacttctgacctcgtgatccacccgcctcggcctcccaaagtgctggaattacaagtgtgagccactgatctgaatatgtttattcttaagagggtttagtttaccaaagcacttacactgctatgtgtatactgccttaatgccttttttttttttttttttt

SEQ ID NO: 871 - DNA, 1059 bp, Homo sapiens
aatttggaagtaatctctatgaattttcaaggagggtttggcctctattgataaatattggacaagtagacagtgaagatggggtgagaggaggttattggtgtagttgagaatattgttaccccagtgtggtatgggtagagatcagattggaaggggttcgggaggtttgggttcatgcagtaatggaggcagtgtccatacttgcaaaaccttggcggtggggtcctatagattgtttttgtttatttttctaggcagatagcttttaaagtgtgtctgtgtgtttaaggatgcactaccaaattaggtaattagttaataacttctgtgaaaaacactctgaagagctctgttatataattaaataatttatttgataaatgtactaagtaaagtagtaccataggcaacaaactgcttaactttaatagatttttaaaaatcaggttattagatcacttaaaaaatttcttttcttacatgattaagggatcaaagattaaaggaaaatgatcaaatattggccattaatcacacgccattggatcagaacatttcccatcagcaagcaattgcattattacaacaaaccactggatctttgagactgattgtggccagggaaccagtccacacaaaaagcagtacttctagcagcctaaatgatacaactctgcctgaaacagtgagttgcaaatttgaaaaaatacttaattttgaataatgccattgatcgtaagaagtgtaaagacatttagaaggtgtcattttacctttctttccttttttttttttgagatggagtttcgctcttgttgcccaggctggagtgcagtggccagatcttggctcactgcaacctccacctcctggaatcaagtgattctcctgcctcagcctcccgagtagctgggactacaggcgcccaccatcacacttggctatttcttttgtatttttagtagagacggggtttcatcattttggccaggctggtctcgaactcctgccctcaggtgatccacctgccttggcctctcaaagtgctaggattac

SEQ ID NO: 872 - DNA, 1061 bp, Homo sapiens
tatccagacttgggtatttggaagatgttttcttgagaatggatgatgtgaacctgttatttcaaggaaaacaactgacactgtttgttagcaacaataaaatttgagcttaagcaaaaaattagaattttggaaaatttgtattttaccataagcatgacatttccctaatacttaaaagcttttctaaggctgggcgtggtggctcatgcctgtaatcccagcactttgggaagccaaggtgggaggctctcttgagcccaggagttcgataccagcctgtgcaatatggcaaaaccctgtctctacaaaagacacaaaagttagctgggcatggtgctacttgggaggctgaggtgggaggaggtagaggctgctttgagccgagattgtggcactgaactccatccagcctgggcgacagagtaagaccctgtctcaagaaaaaaaataaaaacaaaagaaaagaaaggcatttctgattagattgttgattgatattaaccaatatgattgtcttgatattatatgatgaaatatgtcggtatttggaaggtctgcataactgtgaatggatattctattttcttccttttttctttctttctttcttttttttttttttttttttttttagcatagtcttgctcttttgcctaggctagagtgcagtggcgtgatcctatctcactgcagcctcgacctcccaggctcaagcagtcctcctacctcagtctcccgagtagttggtactacaggcatgtaccaccatgctaggctaatttatttttatttttatttttttgagacagggtctcactctgtcacccaggctggagtgcagtggtgctatcttggctgactgcagcctctgcctctggggctcaagtgatccccccacctcagcttctgggggagctgagactacagacccaggccaccatgcctagctagtttttctattttttgtagaggtggggtttcaccatgttgcccaggctgatttcaaattcctgagctcaagtgatcctcccgccttggcctcccaaagtgctggaatt

SEQ ID NO: 873 - DNA, 1043 bp, Homo sapiens
taacagttttattttttttaagagatagggtctcactatgttgtccaggttggtctcaaactcataggctaaagtgatcctcccgtgtttccctcccaaagtgttaggattacaggtggagccactgaactcggcccatttttttatcgtttgaagaactttctttaaattcttgctgaagaaactaaattagtgctgtgacctaaagtttccagaatttagtcttgcatgtttcctagaaatgtgatgggtctcactgttatgaaagatgatgcctgggaagaacacaggatccctatgtcatgttcagaagccaaaacccaggtttgactcctttgcccacattagaggtagtatgcagagtaacattgtgcagtgtgcgttagttttttagatattataaggagtcctttaatgaatgtttcctaaaaatcaagacccgggaatacaggctttaaaaaaggcttcaggttcagatgttcaaggaaagaaaagtggtttatcttctgagtgtaggcagtagttgttcttgaacttaaaacgtttttggtaagctttatttctgttggcaaggtgccagaagacaacttcgacagttttttttccaacattttttagcatcctgtcactaaacattcccattctggataagcagaggccagggcaattgaaacttagagaagccttgtaggcggcctcctcaacaattgataagaaaggaaagatgttcttgcctgagtggtttcagaagtcatagtgtaattctgcatgggatataagtgctgagcctaccttaaactcttctgtcacatgcagttttaagaatgtattttctttttttttttttttttgagacagagtttcgcccttgttgcccaggctggagtgcagtggcacaatcttggctcaccgcaacctctgcctcccgggttcaagcgattctcctgcctcagcctctctagtagctaggattacaggcatgcaccaccatgcccggctaattttgtattttcagtagagacgaggtttctccctgttggtca

SEQ ID NO: 874 - DNA, 1034 bp, Homo sapiens
agacatcagcaaagctggaacagtggggcagtgctttgattgtcatatgggaatggaggccctcaaggatgggagcaaaggggagtatggggatgggggaaaggtaactgagacttccgttaatcccacctgagcatgacagtattttcaccccatatctgcaacattgccaactgattggaccctgattccaaagtttctagatgaaataaaaagcagaagtggtagtgagtttaccagaaaatttgttcaagatgaatgcatggaaagagtttcagtgatgattataggaaaagttttaggctgggtgtggtggctcacacctgcaattctagcactttgggaggccaaggcaggaggatcacttgagtccaggagttcgagaccagcctgggcaacatagggagaccccatctctatttaaaaaaaaaaaaaaagttttaaaagagtatctacattgcttagtcagaggtcatttatgattttctactaaggcaagtaccccaaatatactatgaacttatggattttttttttttttgagacggagtctcactgtgtcacccatgctggagtgcagtggcacaatctcggctcactacaacttcctcctcccaggttcaagtgattctcctgcctcagcctcctgagtagctgggattacaggcgtgtgccaccacacccggctaatttttttgtatttttagtagagatggggtttcaccatgttggccaggctggtcttgaactcctgacctcatgatccgcccaccttggcctcccaaagtgttgggattacaggcgtgagccaccgcacctggccaaatttatggacttaaggaagacatttgatgcacaattcatcatattcttataaacatgataaaaacaattggctgataatttataatgaattactggggtatatcctatgagtgattaatgggtttatgcctgcataagtacaggtctctaacataggccataggactctatgcacaagttgccttggttattctttttctcgggaaatg

SEQ ID NO: 875 - DNA, 1074 bp, Homo sapiens
tctaattgaaataacttgcttctgtgtttcaggtgtctggagtagatttgcagaatgcctcacacagcgaagcagttgaggccattaagaatgcaggaaaccctgtggtgttcattgttcagagtttgtcatccactccacgagtaagttttagttcatattttcaaaaagtttaacaacactctgtatacctgcagaccaagctttggcctctaagtattttccacatattttcattgtagttcccaaactatatttaaagtatgagcttcataaaaatttagtcataaggttcccttttttcccctccagttttgatcttctggtcaaattggagtcattacagtgtgcattggtttaagttactgcttctggaatcaaacagacctgttttcaatttcttgattccttatttaccagctttgctaacttgcaggttacttttctgagccagttactttgtttatgaaatactttgaacagagggtcaggtgtaaaaacattgtagagatactatcacatgttgtgtatatttattaaaggatgtaaaaataaaaacgtgttgacatgttgtactgttgtgtgttctaatgttggagattccaaatgtaaaaacagcaatatttaatcataaaatttttctttttcttctttttttgagatggagtcttgctctgttgcccagtctggagtgcagtggcacgatctcagctcactgcaatctctgcctcccaggttcaagtgattcctgtgcctcagcctcccgagtagctgggattacaagcatgtgccaccatgctccactaatttttgtatttttagtagagacgaggtttcaccttgttggctaggctggtctcaaactcctgacctcaagtgatctgcgcaccttggcctcccaaagtgctgttattacaggtgtgagccactgcgcctgacctacaatttttcttctgtaattaattactcctttggtatggaattggaactctgatatgaaatgtcagtggcaggatgtggattttatactacaatgtgcaacagaaacatcacccttaaaactggaagcaatat

SEQ ID NO: 876 - DNA, 1046 bp, Homo sapiens
tacactctgaaaaccgaaaccactgatcgaaatggtctttaaagtcatgggagcccataagtttacttaggagtagtgtgtagacagcaacaagaagcaaacccagcacctgctccatgagccagcaaggagcacttccaggagattaggggattgtgttgtttatgagagaaaggtgtttcaagaaggctgtcactgaccttcaatggtcaagggtggaatgctgctaagaagttgaggaggctggagacatgaaaataaccattgaatttaacaagaaattgatgaggaagaagagaaagaggacgcttgataaaataactgtagtgtgcgggacgcaggggctcacccctgtaatcccagcactttgggaggccgaggtgggtggatcacctgaggtcaggagttcaagaccagcctggccaacatggtgaaaccccgtctctactaaaaatacaaaaattagctgggtgtggtgttgcacacctgtagtcccaactagtcgggaggctgaggcacaagtatcacttgaacctggaggcagaggttgcagtgagccgagattgcgccactgcactccagcctaggcaacagaggaaggctctgtccgaccccctcaaaaaataataagcatagtaattattgttcagattattatgaaacttaaatgtaacaaccaatatagagagtttggtatgtaatgggcatttctattttagctcacttatcttgcatagttgcacatattttatgacatcctggtgtctaattatcgtaagaagtcttataattgaactctggttcaattagtgaaattaattgagaattatgaaaaaattaagaaacaatgtactgcatcaatgcgtagctcttggcaaaactaccattatcaaaggttgcaggatttgtcaaaggtatgtattgatggtgcaggaacttttgacttaactttgtggaaatggcctttcatacctggaattaaaatcagacgcctgtaatcccagcactttgggaggctgaggcaggcgaattacaaggtcaggagt

SEQ ID NO: 877 - DNA, 1095 bp, Homo sapiens
tccatagagtaaagtgaaagcaaattaggccaaatgcggtgtctcacacctgtaatcccagcactttgggtggccaacccgggtgggtcacctgaagtcaggagttcaagaccagcctggccaatgtggtgaaactccatctctaccaaaaatacaaaaattagcctggcatggtggtgggcccctgtaaccccagctactcaggaggctgaggcaggagaattgcttaaacctgggaggcagaggttgcagtgagtcgagattgcatcattgcactccagcctgggcgacaagagcgagacttcatctcaaaaaaaaaaaaaaaaagcaagtttattaggaaagtaaaggaataaagaatggctactccatagagcagctggttgcccatttttatggttatttcttgattatatgctaaacaagaggtggatgccttccctttttagaccatatagggtaacttcctgatgttaccgtggcatttgtaaactgtcatggcgctggtgggagtgtagcagtgaggacaaccagaggtcactctcgtggccatcttggttctggcgggttttggccggcttctttactgcaagctgttgtatcagcaagatctttatgacctgtatcttgtgctgacctgtctcatcctgtgacttagaatgccttcaacatctgggaatgcagctcagtaggtttcagccttattttacccagctcctatttaagatggagttgctctggttcaaacacctctgacaatagaattctattgcagagttgaattgcatggagaggattaaaaatattcagtttctcattctttgtaagattaatacttgcaaatcaagcattagtcagttaactaaatgcttactattagccattttatttttatttagatatactaagaactgcctttttattcctaaaatcttgaattttctaaacttgcttttgatagttaaactatagttttactaatttaaccttaaactatctctaagagttgaactttctattcaaggaaagatacctttcagaagcattcaatgtctgcttttcataagattgacttgattagatgttagaaaaaaa

SEQ ID NO: 878 - DNA, 1031 bp, Homo sapiens
gtcatccataattttacttgcctaataataactactgccacagctggccaggtgcaacaggaagaccatcgccatcaactctttcttccaaaccttggttgcttctccccacttaaaacctgtttctgcaaagaagtcacttccaggattacttttcttttcttgttcttttataatatagcaccacgaatgggacccacattgggtcgtaacactgactagcataatcattacataaataaagtcaaagatgaccttatgtaaccaatattattcattgcctcagtttgtttcctttggcttatgtttagagacttcctcagagatgagacaaaagtgatgctggtagtaaaaatgatgaaagttagagccagtgtactcagttattgctagcactgtgcatatgcattgtacatatttgtattcggtattcttaaaaatcctttatggtaacaactattattatctccattttatggattagaaactgggtaaatagtatacctaatattgcagaactaagtgaataagtgtggataagaactcaggcttgccagactccaagacccgtgttacagccactaaagtatactatgttccctgtgggattctttttttttttttttttgagacggagtttcactcttgttgcccaggctggagtgcaatagcacgatctcggttcactgcaacctctgcctcccaagttcaagagattttcctgcctcagcctcccgagtagccaggattacaggcaagtgccaccatgcccagctaatatttgtatttttagtagagatggggtttctccatgttggtcagggtggtctcgaactcccgacctcgggtaatccacccgcctcagcctcctaaagtgctgggattacaggcgtgagtcaccaggcctggtccccatgggacttctttaaccaacccaatttgtttagattcaggagattcctgatttttgatgctttagtcttcagggaatcatgtacattaagtcactctgttatgttatacatatctag

SEQ ID NO: 879 - DNA, 1090 bp, Homo sapiens
gctgctctcagctcctagaggtcccccacagtccttgtcaggaagccccctccatcctgaagcaaacaatggtgcttccaatctctgacttcctaggcattccacaaagaatttaattggtttagaattcatttaagtcaacctactaatttaaggatttaggatatgaggttctaagtgaaatctccagatttgaagggcttgtatgattaggtcaggtccaaactgataatctccctttatcttacagtcagctgtgacttatcatatagtttaattatggaagtgaaatttgtctgtaaactgggggcaggaattttgggagacttgttagcattttgtctaacacaagttatatgatttttaccaatgtgagtttcatttttataacaaagcagaattcaaatcaggatccagaatgtgtgttttccacaaacataaatatattctacaaacaagaagctgaattagaggtattcttagcatgcttttggagaaaaactaaattgagatcccttgagtagtgtattagtctgttctcacactgctatgaaaatactgagactgggtaatttataaaggaaagagatttaactgacagttcagcgtgtctgggggggcctcaagaaacttataatcacggcgcaaggggaagcaaagcaccttcttcacaaggcagcaggaaggagaatgaatgcatgaggaactaccacacacttataaaaccatcagctctcctgagaactcactcactgtcacaagaacagcatgggggaaactgcccccatgattcagttacctccacctggtctctcctttgacacgtggggattatggggactacgattcaagatgagattttgggtgaggacacagccaaaccatatcaggtattaatgccacaattgtagttgttcatttacttagctgcattcttcactaattgctaatatcatcaaaggcaagaatggtcttttatccatttttgtgtacatagtataaatatttgttaaataaagaaatgtatatattcaaaataaaatcaaagctatgtagttgagtttcaaccaatcaaagtaaccaccagcca

SEQ ID NO: 880 - DNA, 1103 bp, Homo sapiens
gcttagagaactcatcctactctgtcaaatgaaagaccaaggcctcttaccttttctgatgtttgcatcgtattccttaaactcctccctgatgtccttcaatgtccacttctcagagatgtatactcgttgattagaagttttatcagcaataccctcagaagaagtaaaagatagctctccagactcactcactggggttattatcaggcttgggaattatagagaagaaaaacttcagaactaaatcctttatcttggattattggcagacttgaactgtttttggaattgaacaaatgaagtggagaaagaatgagaatgcagtctctaggaccctctttctatgcattttccttccctgagatccattgccagagatcccaggctatgaatgagatcccaggctgtgaatcccaggatatgaatgagaatgaggtctctaggaccctctttctatgcattttccttccctgataccattgccagagatcccaggctatagacaatgtgttctaccaaacctaaaaggcaccatagcagagtaatgatgctggttctttggcattagaattttagatatttaactgtgggactctggacaaatgacagcctttctaagttaaatctgcttcttcatttgtgccactgtggtgataacaaaaatctacctcttaagattgtcatgtgaattaattaagataatgaatatgaagaactttacccagtgcctatttaaactgagttcagttattattaattataaacatttgtattaaagtagatccttaactttgtctgtgtgtctttggtatattacctggacagtgaaatgtggctttgttcctagacaattgcatatttgtttttcaacatcaaactttaaaaaagtgatttggctgggcaaggtggctcacacctgtaatcccagctctttgggaggctgaggcacgtggatcacttgagcctaggagtttgagaccagcctcggcaacatagtgagaccccatctcttattttaaaaaaaaataaaataggctggacagggtggctcatgcctgtaatcccagcactttgggaggccgaggtgggcggatcaccag

SEQ ID NO: 881 - DNA, 1051 bp, Homo sapiens
tgtaaccttaactgtgctgtcatgagcctcgggcctgatcacaagatagatgttgttgtttagaatatccacaggcagatgaagttctgagtgggtatgaaaagcaccctcaactaaaatgcaccttcattcttatttcttgccctctctgctcaggagaaatggctgaggtttcatgtgaatttcccaaatcaacaatcatctcctaatgtttcccagttcctgtcacctgttggcgaggttgatttctaaaacttaaatgagtctacctgttttgcatttaatttcagtgttccgatttctttttttttttttttttttttttttgagacggagtctcactctgtcacccaggctggagtgcaatggcgcaatcttggctcactgcaacctcggcctcccaggttggagcgattctcctgcctcagcctcccgagtagctgggattacaggcatgcatcaccacactgggtttatttttgtttttttagtagagatggagcttccccatgtgggccaggctggtcttgaacttctgacctcaggtgatctgcctgccttggcctcccaaagtgctgggattccaggcgtgagccactgcgcccagcccagtattctgattttaaccaactggttctgattatatttaccaaaactggagttaacttctctttccttatactcttctctccctatcccctactcacaccgaggcttaacagcaacctcagatctcatccaatggacagaaacaaatgttaagcaacttgtcatctcactcatgatttacttatgctaattgtctcttcaagtaagcaagaaaacattagcagtgtaattaatttaccagtgatccccaagatgaaataccagattctcctatgggaaattactgtgctgtcttctgtatgacttatggtcaaataagtctcaaattcatttctctggatagatctttatatgctagtcattggtgattttgatgagtcaatttacagactgtaatcttctaaaaattctgaaagactaattgttttctgtgccatataaa

SEQ ID NO: 882 - DNA, 1118 bp, Homo sapiens
ttacaggcgtgagctatcgcttccggcccttgaaataataagtttttactacttatactattttactgtaggtctactaaataggatattttgtaatgcgacccttaatccatagcaggctgattttaaaaattcagtagcttctgttttttgttctttaagaacagtgtggtatgcttcttcatttaagcaataaatattgagtgcttattggcaggcattaggttttcaaatgttaatttctaatttgtaccattcccttggtaaatttgttttcaaaattgatgattttgttgccaaaactgataaccaaaaactaatgaaactttctctgtgattaacagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaatgtatgtatcttacatttctgtactttaaaaattctacagtaaagcagcagtgaacttggttgacaactccagtctgacttgatagtctgtagcggcacaaaaaagtacgcttcagtgtacttcttagtcaaatctagcagtttatagtaggaacagcaaaactggtggttccccgtaggaatcacatcgataatgtttaactcatgttaacactgtgctcagccatttagactaacttggagaaatatttgttgactaaaattgtctttctgagtttaaatttgattatttgtagtgcaaaacatctgtgtaggggtaaaaggttttatatatatatatatatatatttgtttggttcagaagacttgacagttataagacattttaaactctagtcatgtaactagtcatacctgttggaggcatatgattgcaaattataaaaataaactttaagtaatgcttttgatgcaaataaattatttagctacagaaaataaatcagaacaaagtggaatactttattccaccacca

SEQ ID NO: 883 - DNA, 1055 bp, Homo sapiens
cattttgactaaaacctggtgtatggtaagcattatctaagtattagttattaatatatttagaagaggatcaaagtattataatgaaaatagggtacaatttactcttacttttagttacagataagaaattccaaattagtgctgaataaatgtcttgacatttaaaaaatgaaataatttatgattttccttacatgaattaatttctatataggctttatgtactgtatcttcaaaactagaatagatgaaatggaaatttttatttatagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggttagtataattcttagactttgataggtagaagcattagcagctacagaattagaattttctcttcctagatacatgtacaatataa

SEQ ID NO: 884 - DNA, 1040 bp, Homo sapiens
ggtttacctatcacatattgaaagttggcaattaaatgtaaacagactaggcttattttgtttttgctgtctatcatattttttggccgatcaaatatatttaaaaggtatgtatactgttgaggatgcacttatgaaagtagtttctgaaagtaaaaatctctttagttatttaggaatgggtcggtcaattgaaattaaatgctaattttgaacctgaaactttgtggtttattttttgaatgcctgagagaagtatttgagtgaaaggattctcttttttagtttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtaagtattgtaaataagaactatatgaagaaaatgagctgctgtagaagataagtcttgttcaaaatgctgtaatagtaggaatataaagtactgaaatgaagtagattgtaaagattgcttcagtaaagttttgttcttattaacagtttccctgtaaaaatgaaacaacttaaatccttttgatatgaatacatattctattaagtatgatttcttctccttttttttttgaaacagggtctcattccagttgtccaggctggagtgtagtggcacagcctcagctcactgcagtcttgacctcccaggctcaggtggttctcccacctcagccttctgagtagctgggactacaggtgcatgccaccatgcccagctaattttttgtatttttagtagagacaggatttcaccatgttgcccagtctgatcttgaacttctggactcaagcaatccacctgccttagcctcacaaagtgctgggattacaggcgtgagccaccatgcccggccagtttctttattcatcttttcatattcattccctct

SEQ ID NO: 885 - DNA, 2063 bp, Homo sapiens
attcaaagttggggtcttgttttgattctgcttttctgatatatgaacactggatattaagggttcattcagatttttacttggtttcagattggggtataacattttgaatttaaaatagaactgcaggaaaccttttctttttttcctcccaaaggtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaactatgtatatgaatatttgaattttttacttgtatatttttataaatacagctgagttttcttaaagcgaataagtgtgtgtatatatatatgtatatatatgagagaataagcatgcataattacctttattactgaatactttctgacagtgcaggagtttttcaaagaggagaaattgtgcttagtccagccaagctgtcatacttaaaagaggtttataatgaaatctgttgcatctaattgtcctttaaagtagacatgatttaatggaatccaaaactggaaaagttaagatgatgctttgggcacacataaaaacttggttaaaatttcattttaaactagtatactgaagtggtaagtgatgaatgatttcatgacttgttaatggacattcttggtactaagtttttcc

SEQ ID NO: 886 - DNA, 1104 bp, Homo sapiens
cattaatttggggctatctatgatttttattctgctaggtttggaactagttcttgagtcaaccctttaattgttctctgccattgtcaataataaaaattttgaagtcccactcggtaaaattagtgtaaacattcacatatttaatagtacctttaaaataagcattactacatttaaaatggttccaaaatgaatctataaatggtaatataaattaaaaaatacgaacttaaagtgaataaatttttaaccttagctatggtataaataatggtaaatgtatagtgtacctttgagtcattaaaatgtcttaaaagataacagcttgttaccagaacattagaaaccatagccatgattctcaagcgttaacaatctacatttgatattttcttggccactgcattcttcaatgaataataatttccagaattccattccatgttgttttccaatagatcttttcacactcgatgttgaatacatggctctttgcagatgaataaaacaagtgcattcagtttagagatccattttgcgaaggctcattcgactgaaggaatctctgggaaaaaaatgagaggacatagttagttaaagagaacaatttttgcatatacctttaaatgtcttacatggttttttctgccagttaccttaaagttttgccaccatttcttactaacttccaagttggatgctcatcctacctactctgccttatattttggcttatagatttagctatagaagtgtattacagtcaccacttactggtcttttgtattcgtttgtctgactgatgctgcagatattgtaataaacaagacaaggacttaagggataatgggagagattttaggaaaagatttggggttttttacacggcaaaaggcaggtgtttattaaattttaagtcttaaaccagttctcaaactttgtctcaggtcccttttacactcttaaaaattattgagaaccccaggaatcttttatgtgggctatatatggatgtttatcatatcagaaattaaaactaagaacatcttaagttactataaaataacccattacatgttactataaatagcattgcttatt

SEQ ID NO: 887 - DNA, 1315 bp, Homo sapiens
tccttccaattcctgtttatatctctgttttcccaaagagagaattctgattctcaattatatcactatttttactcatctaacctatcctacaacacacataaaatagttttggaattactagactgactgataccgcttccagcaacagatttaccaagtaaagatttctttgccattttatgttcttagaatatatcccactaaaggtatatatagtcaaaataggtgttcaaagttatttgaattattttttctgtgtgattatgttatgaatgtaaaatatagttaggttcctactaaattactttttaatatactctttgtaaaatcagttatctgtaaaactactaaagtgacataatttaaaactttgtaatatatagttatagagaactctagaacagttatatcagctggagaatattaagttttaagacttgtaagctctaaacttgtagctctattttttcagttataatgatatttaaaattaggagtgcaagaaaagtgacatcaagtgattccatttgtaaaccaaaacaattgtgtttgtgaacattttaaacaatgctcttcttttaactgatgatacaattcaagcattaatctttaacaatagacataattgttgggggtactttaactaattcccaagtaataggtctaatgttttcctgtatttataaccagaatggaaagatttatgttttttgttaagtccttctttgtatttgaagaatacttgttgtgactgtattttaccctgtgatattattcatgtgtgaatattctcattggaaagggggaaaatatgtctcttaatagttatgatactttatatctctattgtgagatataaccacattcagccttatggttagttataaccattttgcttattagaatgtaagattaatgagggcagatactgggtttcatggctcattgtatctccctcagtgccttgtaggagtaaccactcaaatacttgatgaataaatgtgatattttgtgtttaaattacatgtagtactagcttcagtaatatggatgcacctttttcttggcaagagtaactaatataatgggtcttggaaatggtcttatccattgtcgtagtctgtctttcattgcttataacagaataactgaaactgggtaatttatgtaaaaaaggaatttattccttatagttaacaaaagctgaaaagtccaaggttgaggagctacatttggtgagggccttcttgctggtggggattctgcagagtcctgaggtggtgcagggcatcacatggtgaaggagctaaac

SEQ ID NO: 888 - DNA, 1101 bp, Homo sapiens
taggtgtatatatttatggggtacatgagatgttttgatatagacatgaaatgtgtcatacttacatcatgaaaaatggggtatccattccctcaagcatatatcctttgtattacaaacaatccagttatgctcttttagttatttttaaatgttcaattaaattattattgactataatcccccgttgtgctatcaaatactgggtcatattcattctttctatttttttttttttgtacccattaaccattcccacctctccccaaccttctcattacccttcctagccgctggtaaccatccttccactctctgcctccatggatttgtcacagcatcttatcttgcttttgtatttacttaggcatcattatctaagatatagacttccccatataacatgtctaattgctcactgtcttcattttttccccatccagattaaggcatcttggttttcacacttgctgaggactgtccagagtattctggatggctggtgatgagaactgtctgaaccaaaaagtcttccctgtggccttctttctttcagacttagaaagaagatacctgcatgcacatactctcattaaaaaattttggatctagaagaccaagcttggtggctttttaaaaataatttttttaaattctaaaaataataaatgtttttgtataagatttggaaaatgtgggcaactgtggtataaaaataaccacagagaaactacttttaacattttgctgtacttctttcttactttctaactcccttcattcccccttcgctgtccctgcgcttgcctgtgtcatatgacacataagtttcagattctgcatagtgtttccccattttaggagacatttttaatggatgcataatccatcatgtggatgcactatatataattcacacattttataaactcttttccttttcttgcttttccagattttgctaaattatgtatgcagttttcttgaggaaaattcgtctttccttttctttattctagtgtcagttaaaaaaaaattctaattctggtgagagtgctgctagtgatatacctatatttcatatcagttcactgattcctt

SEQ ID NO: 889 - DNA, 1897 bp, Homo sapiens
acacacacattctgtttagttatctatcatctgtttattccactggaatgtcatctcaacaagggaaggattttgttgattttgtttctttttgtatccccagtgcttagcactggctatcacattgtagaaggtcagtaaatcatatttgttgaatgaagaaatgaattaaaaagactttgttataaagttgtcttataagttagtaaagaggtcagtgattgagttatagaaaatctacagtgtgtttttacctacttcttctattttccttaaattgctgtggatttatcttaaaacttgggatagtccttttattcagtgcacaactcaaaatatgttttgttcaaaaaattagttttcatatttattaaagtagtacatacactaactttaaaaatggaaattgcgataaaaggcttatgctgaaaatcaggagtcccttgccattttacttcccactccaaagaatacctcctcaggtatattcacttttaactcttttagctatttatttagaattttaactctgcatttctaagaacaataagtcttcccttaacatcattgataggttcttggaaactgtaactttaagtgaaatgatataaaatgaaactggttttaccataggataattgatataaacaagagttaagttcctaagacatagttcttgtcacagaagcatcaccaaacttacaataaagacttaaatacttctactattaaacattgaaataaatgtgagctgtacttgtatttaagaaagattgagatatttcacagagatgaccgaacatttaaaaaaaataaatagctacaaagagaactaaggaaatgaaaaaggagtgggaatactaactccaagaaaaacaaagcttagaaaaaaaggaatgtaagataattgtttatgtaagataattgtttatcttacaattgttggtggatcagtgagcaacagcagtcgtggtggtgggttaaatcaaggaatagtttgcaaagcgaaaattgtaagaagcacctcctaccaccacacagttccagaacaatcacaaatctggcaggcttactgagtgccttgttaccgtgtgtttattgtcaagcatttgtgtgattgttgtataccttacacatttttatttggcaataatttgtattcattcattcattcattcattcgttcattctccagctggcctattcagttcaggttgtaggtggccagaggctattctggaggctcaggacgcaaggtgggaagctacccggagtaaggtatactcatacacacaccattattctcccagaccggatcagtgcagacacaccagctcacctcatgtgcacatgtttgggatgtgaaaggaaactggagaacttggagtaacctccttacacaggcatgaggagaatatgcaaacttcacacagatagtggctctggctgggaattgattttttttcttcatgaacattataatcacacaatgttgaacaaaatgacattatttgggaacctgctgtaatgtgcttattctgcagtttcttgattagtccactgtagacattctttgttattttttagttatagtacttgaggatttaactctcttcccataccctttcacctggtttctcttctcctagccatactcccactacagttataacatagattttggttagtcactattcagtgttcacattatgcctccataatattgtttactaatcacataatgtgctatgattacatttcttttttcctatcctttgtatttcttagagttagtactcctttccccttttttcatttccttagttctgtttttacctattttttttttttctaaatgttcagttatatctgtcaactacctagcggtaagtttttc

SEQ ID NO: 890 - DNA, 1032 bp, Homo sapiens
tattttattttatttttttgatacggagcctcgctgtgtcgcccaggctggagttcagtggcgcaatcttggctcactgtgacctctgcctcccgggttcaagcaattcttctacctcaaccttccgagtagctgggattacagatgcacgcgaccatgcccagctaatttttgcatttttagtagagacggggtttcaccatgctggccaggctggtgtcgaactcctgacctcgtgatccacttgcctcggcctcccaaagtgctgggattacaggcgtgagccaccgcacccagctagagggcccacattttaatagttaaatggtcacaacagagggtgataattataatgtaggagtatgtgtgaggtacagagttaatagagaggtaaatgatcaagatgcattagagaaaacttcaggaaagatgtttgcattcaagatttgaaggatgagtcagaattttctaggcaaatgaagtggagaaggtattatagagtgcaggaacttgtgcaacagacatggtgtcacagagcatggttattataagtattgtatttgagttgcatgaaacataggaacaaaaaggatgaggagagagtgaccagagaataggttatacaattagctgggcaaattatttcgttgtagaaaaataacttatgttagtgaaaaagggtcataggaaaaagagataggtaaagagaaaaatgagacaataatattaatagttgtaagagctatgatatatacacagacacatatatatacacagacacacatttactctctacttacacatttactatatacgaagatacatatatggaaatttatatatatgtgtgtctatatagtaaatgtgtatatacacagacacacacatatataggtattttatgcatacctatatatgtgtgtgtctgtatatagtaaatgtatatatacacagacatatatatggatatacacagacacacatatatataaatatctgtatatatgtgtgtatatagcaaatgtgtatgta

SEQ ID NO: 891 - DNA, 1022 bp, Homo sapiens
ttgaattttatatgaaagggacagcatagtaagtattcttttgtgtttgatgttttgggctgaacattttgtttatgagatgtattcatgtagttgtgtgtagctgcagtttgttaaaaaactatgaaagtgaattcagtgttcactttcattgctttacgatattccattgcatgaatacatgtaattctatcactgagagagtaatttgggttgtttcccagtttgggccatgacgaataatgctgccatgaacatcttataaatatctccttgtacatatataaacattcttcttataagtggaattgttgagttatagagtgtgcacatgtcgatttttagataatcccaagttgtttttagcagcatgtaccaattaagactctcataacaatggtgtaagagttccagatgctctacatcttgaccaactgtcaatggttttcgatttagccattctggaaaatttgtagtagtatgtcccctgtgatttgagttaaactctgaaggctttcaggcatatgttatcttgtaaggatacatttttttcttttgagacggagtttcggagtttcgctcttgtccgccatgctggaatgcaatggcgtgattttggctcgctgcaacctctgcctcctgggttcaaacgatactcctgcctcagcctcctaagtagctgggattataggcatgtgccaccacaccctgttaatttttgtatttttagtagagacagggtttcactgtgttggccagactggtctcaaactcctgacctcaagtgatccacccaccttggcctcccagagtgctgggattataggtgtgagccactgtgcctagctctaaggacacattttttaaccattatgtacttttctcatttgcaaaatgtggataatagaaaccctgactttgtaagcttagtttgataattaaatgaattaatatttgtaaagcacttaagacagttcctgggagacactaagcattatataggcatttgttgctattattac

SEQ ID NO: 892 - DNA, 1020 bp, Homo sapiens
acttagcttctgtgttagacactaagctaagcaatcaatactctttcagttaattcaactatttaatttgtttcgtattagttaatgagggactacaaagtagaaaacagtggcaatgaacttaagtagcttaaatagttatgctataaaacagatggtattaagttctatcaggtacaaatgaagtcctatgatggtgtgggaaagggagatattatctcggggggagattttagaatgctgtttagggcaagtgggatttgagcccaaatttgaaagtggggcaaggttagaacagcaggttatatagcagaagagaagttcaaaacagaaggaagaagttgaaggtccagaggtgggaaaggacacaggatattctgggaatagctattaaacaatataacttgtgtgagttttgtgtgtatgtgttgagagtaggagaggatatagtgaaagataagggtaaaaattgaccaaattattgaagaccttgaaaatcttggttgaaaaggtttggagtttgatttgtgtgcaagagaaactaaaaaatatttttgagaaggagagggggcagatctctgttttaggaggatgacttgtgtcagtttgaagatggactaggtgcattttctacagtttagggtttttctgagtagctttacaaagtcttcttggttgtgtttctatggcatttaaaattttgttcctgtgtgccatggtctataaaatgacatttaaaaaataaccttttaaactatcaagaacatttagtttctgaaaacagtaagtcctactggacttatgtgaggcaacatttagaaattagggttccaagtctgggactgccatgtaagtacgttggataaaaacaagccagaaaagaacataacagcgaaatacttcaaaagtgcatctcattaccacaatgcaaaaaggatagctttatgttcctcttttctttttcattatctttttattgatgatttgtgttgtttgattctgtgaatgaactctgagcat

SEQ ID NO: 893 - DNA, 1036 bp, Homo sapiens
attttttttaaactctaaatagcacattattaatttataaaacattaatatattttattgaagtgcatgttttaaaacaccaaaatagatttgttttgccggttttagattctgaccttcttgtctttcatggttttaaatttaagttgtctgagattccaggggaggatgaatgtatgattgttgtgtctgaggtatttactagttctgtttattaataactgagttatgatgaacttagatggttaaataaagctttataatcattgttttttgaaaaaatatgtcaattttttaatttgattaaaatatgcatactagtgttgtttgtattttacttctaaatagagctttaataaactttcaactttcatttgaaatgatttttatttagattctataattaacttgatatgctatttcacaagttgttatatctcatttcccccccttttttcttaaaggttagctgtgcgctatcattctttttattttctttccaagtacatgaaaaatccattctcttggtgtcactgtaagtagaaacatttgaaatatgtgtttatttgtttataatataactttataatttacatacaaatatacatttgaatgcaaaacaaaactacacaaatgttatatctttgcataaaatgatttcatagtcaggtttttttccagaatttttgattttctttataaagtgtattttaaactgaaaaattttggtagaatgttattgacataatagtaatttcttcctgttccttcacttatattttctacatgctaataaaaaatatatccttcaaagaggttttcatcagattggagcctgtttgtcatctttgctttttcatttcattcatttccacatctattcggtagccttcttctttccatttacttccatggggtcttttgtatgttgccttctttctctttttttgccacaagcttagtttaggccctattggcaatctgtaaccagactactttgttttagaagcattaaatttttttcctgatgttcata

SEQ ID NO: 894 - DNA, 1024 bp, Homo sapiens
accctatgttcactaggatcctgtggaagatacatgtacagaatgaccaatgacaaatggcaggcagtattgcttttattaggtggagctttggactaaaaccttcgtgcagagctgggctggcctgtgtggaaggcttcttggctctaaataaaacagtctcatatcattgtagactgggaagactgcttaatgccatcctctgaggcccaaacctgagttagagcttaccactattgtatgaggctaggctgaccctacacaaatcactggtaccaggggatgaaactgtggagaggcattactttcaaacatgtattaatatatttccccagaatttatactcatagaaaggcagctcattcaggacctataatctgaccagattagttctcagacactgaacttctaggggttcattttttacaaatgcacctagattatttgtaacagtgcatggctttaatctatttttggtaaatggttttacagtttgcattaaaagttccttttgggctggacctggtggctcaagcctgtaatcccagcactttgggaggctgaggcaggcagatcatgaggtcaggagatcgacaccatcctgactaacacggtgaaaccctgtctctactaaaaatacaaaaaaattagccgggcatggtggcgggcacctgtaatcccagctacttgggaggctgaggcaggagaattgcttgaacccaggaggtggaggttgcagtgagctgagactgcaccactgcactccagcctgggcgacagactgagactctgtctcaaaaaaaaaaaaaaaattaaataaaagttccttttgacctggtcccagctaatcatatcattaaacaaatatttcattcagtaaatatttattgagtgccttctatttatcaggcactgttttgtgcacatgggatatattccagacaaaaatccctgccttcttagctatcattcttaaagatagacacttattaaaaaaaaaaaagaagtgagtgtgttagaaggt

SEQ ID NO: 895 - DNA, 1017 bp, Homo sapiens
ttgtaggagatgaaaccagggagaaacaaggacaaaatcaggaagaggtttctttttgccataattaggacttgggcttttgatcagagaaatgaggtttccccctcgttttttgtgagttttattctccatatataaggtcaagattttatcttaatctttcattttcagcagtttgactgtgtgtctaggtagtttttgtttttgttgttgatgctgttgcctgggtttttttgttttttggtattaatcctgcttggggttctctgagcttcttggatatgtggcttgttgcctttcattatttttagaaaatcctctgccttatttcttcaaatatttcttctgccctctttcttcttcttccacttgtatggtacctgacatctcttcctgttctgctccaccacaggtaagccagtgcttgcatctcgtctctcctgggaaagatctgtctttccttggattttaagcttatagttgtcctgtaaccccagctctgatgggatcaagaaaagttatgattttgtagttcattaactttttcttattgttaggaaaggagcaatattctcccaactctgctccattagagggttttgagtagaaggcaggacataatctgatttatattttaacaagagcagttaggttactgtattgaaagtaggtagaaggcagggttggctctaacgaatttgaatgaggagcctcagcacttttcggcgccattttcgagtgatacctgatctcatcaatctagcggaagagacaggataacctatccaagagtatagcgccactatgactccgccggaaaaattactttaaaaatcgccaaaaattacttggagcaaagggcagtaggcggagcttcgccaaggctggcgcagtcggttttgacctgtagcagagaaccaattctggagaacagcctcacttctttgattgaatactcacataatgctttggaacaggacatgagattaaggtttaataatgatagaatgaagacca

SEQ ID NO: 896 - DNA, 1045 bp, Homo sapiens
caggctgggtgaccaagtgagactccgtcttgaaaaaaaaaaacatggaatatgtatttctaaagaaaatatccaagaagaaactagtaacttattttttatataggaaagaatagatagtgattgcttattttaaggtgtttgggcttttttttttgtttgtaggaaaaccatccccttggttatccgttgatactgccttgtatattctcaaggaaaatgagagtcaagcaaatctacagcttgtgtgttttaccgaactacgaaatagagaagtatacatatttattttctaatgtttaatttttaaatatagtatgaactgcagtttggggaaagtatgtttctgtattttattttttaagctttcatataccttccaattaaggtataaacagcacttaaacactatagatattatatgtttttaatttaatcatattaaattaaattaaataattataaggattttttcttgtttgctgcgatttcttaagaattaaggatgggaggagctgggcatggtggcatgcacctgaagtccctgctacttgggaaactgaagcaggaggattacttgagcccaggagttcaaagccatattattctatgatcttacctgtgaatagccactgtacttcagcctgggcaacataaccagaccctgtctctaaaaaaaaatttaaataaagaattgaggattggttggcagtcttgagtcttggcttataccttttaagttgtataatattgtaccttactttcatcttttctaaatgccctgatgcctcatgtgtgaacatttgatatactcaataaaaaaggttgatgccagtacattttttttccctaaatgcaagcaattcaagactttggaaaagctgctgtagacgtttgtcttacttatactactactgcaaaacagaaaaacttaagattactatcctcaggcttgacttattttatagggttcaaaaatagattgatatgaaaaaatgcttttaaatgtttttatatgttgcccatggggttgttctgatctttt

SEQ ID NO: 897 - DNA, 1054 bp, Homo sapiens
gatcacttttgacttcttttgcaacatggaaactaaagcaaacagtggaagatggattgtactgtatagaaacatttttagagaaatgagaaagcaaaaaagtcagacaaaaattacagtgtagccgggtgtggtggctcatgcctatatctcagcactttgggaggctgaggtggaaggattgcttgaggacaggagttcaagatcagcctgggcaacatggtaagacattgtctctacaaaaaataaaattagctgggcatggtggcacacacctgtagtcccggctactcatgaggctgaggccagaggatcacttgagcccaggagttcgaggctgcagtgagctatgattgcaccaccacaatccagcctgggcaatggagcaagatcttgtcttgaaaaaagaaaaaaattacagtgtatttccaagttacaccaagtgtgcctgcctcttctgcttctgctactcttgagacagcaagaccaacttctcttcttccaccttctattcaacatggagataatgaggatgaagacttatgatgatccactttcacttaatgaacagtaaatatatgttctcttatggtaacaaataacattttcctttctctagctaactttattgtttatgttccataaggcttctggtcaacataggctattagtagttaagtttggggggagtcaaaagttatggatagattttccacttgtgggggtggttggcattcataacccccatattatttcagggtcaactgtacattgttgagcatttttgtgactgcataaaatggatgttggtctgtagttttcttaattggaaatgtctttgtcttgtttgggtatcagagtaattctggcctcataagatgagttgggaatgctttctcgttttctggaaaagactgtaaaattggtgttatttctttaaatgttcacttgaatttctcattagaaacatctaggcatgaagatttattttggaagaggtttttttttttttaatacaaattcaatttctttaacagctacaggatattcagtt

SEQ ID NO: 898 - DNA, 1041 bp, Homo sapiens
attaactttggacggattcattgatctctttctctctcacgttactgttttgtggaaggaataagtaataactacctgacaccacacagtagccctgggaaccaaggcaaaaaaatccctactttataacagacagaaaaacctggtcattcagaacagcagtcatgaactgtctagaacctagagtatcataaaaacaaggccatgtctgtttttgtgccctaagcacccaactcatagtagagactgcataaatacgttttgaaccgataaatgaatgagttaacaggtgaacaatagccagagtagaataaggttaggaggggttgttcagagaaagggtcacacccttgaattagtcacaatcctccatataaaaactattttaacatgattttattaattatcaaatataattgctaaccaagtattacaaatcaaatccttagtacctgcatttatgattagttaaaactccattataccttccacttactgaacaaaagcgctaggcacttttgcatgcattgtctcactttagcctcaaaacagttattgataaggtagctgagattctgagagatagggcagctggccctgtagtcacacaattaatagccaatagaggctggattcatagctcatctgtctgattgcaaaacccagactcttctattccacccctctgtgcctagggtttagaaaacatttctctggagtacccagaggtcaaaaatgtaaagcacaaacacctggttgtaatttcttgttgtttatcatgttaactaggggaaagagctgactttaagattaaggggactgtttggcccttgattcatagaatcctggagccagaataggctggccttaattcctcagcatttctcatgtctcagaggtgtcatcttgcatatatgatatctatttcacgattacaaataaatatagactctgctatcttgagcttctaaaaaataactctctcaagagggtgtatgccactaggtcaagaaaagccacctgtacaagtctttaacatca

SEQ ID NO: 899 - DNA, 1059 bp, Homo sapiens
agcagaggaatcttttgattccaagagcaggtccagctgtggagcttccagagcaggtttcgtctgctgttctttctcagacccctgtggttccttttctccatgtggccacagcattctcaaacttgattttaatacattctggggttttgtcacattagaacaatgggatacaacccctttgagcatgagaactgtttcttaacgtaaaagacttcacccccacgtcacggttctggtgcttttagtatctgttaattgagaaaataactaaggaacaaaagcctccaggagatggaggcacacttgagaattacccacgtctatatgggagccaggatttaaccagtctgttgacatggctgttgtaacgtatgcatctgtggagccatctgaaagaactctgcaccccccacccccaaggggttgggaaccgttgcgctggaacatgtgtgttaagaagccacatagacatctgtccccagagtgcagtgcatggctgccttctctgtaaaccgtggggtgcataaactcagctggttctaattgcacagggcatgccatattgttgcccgatgtaatgtcaatttttatttatttgtgtttgtgaaaagcagggctgattagaccacttaaaactgcacaggctggttagagccaggctggcgttagtgatttcagctgccctccccaaagtcatcagcgctcccagctctcagcctccctctgagaatataaaataggggccttgtgctatcatgatttctatttcatcctgactcttataaactaccatataaaaagcagccgctgatggtttttttacatttcaatttcattttgaggcttggaaaatcacaaaataaaaatagccctgagagtggaaagtttgggggagtttgtttagctttctttgaaatatactttgtgaagaaatgtcagtcatgagatctctcttggtggagtgctttactgttggtgtaatttttttacatcgctttctcctgtgtaatcctaagggagaccctgtgaggtgtgaatgattactatcctcattct

SEQ ID NO: 900 - DNA, 1055 bp, Homo sapiens
gtgattggggagacaccaatgagcagatgtggtaccacaggcaactatctctcccacaagtgaattataggaaagagttgtggaaaaaatgctgtgggaacatggggaagaatacattaattctcaggggattagagggtcagaggaagaacatgagtgcctccttcataggcttattgtgaagagtcaatgaaataattcatggaacacactcagactgtgcatagtgagcgctcagtgagtgttctgctatagttatgtagccagtgagaggcctgatcaggatttatctgcctctaaaacccatgtactcttgctcccctgtgcactttttaaacagacatgtgattgttggaagagtaagtaactgtgcagtcaccaaatgaaagggaagacaccaatacagttgctctggtatattcaccacctgccctaatcctggcttttaggactggactgctttgggtatgggaggggatttggatagatgtggggttggaaagaatcaagatgtctcatcatgaactatagcgctcctagaactctggccaggatttaccacctgccctcattcattcattgatcatacattttctatgcacttacagtgaaccaaatattctgatagtctcactggagatgtaaagatgaataaggttagatcattgccttggagggtttttcaaatgacagatttatggcagagattgctagctgatcaccaaatatgtttccatctcttccggtcatatgactagacaacatttctcagctttctcacagttaagtgaagccatgtgactaaatactagccaattaaatgaaattggaggtaatttttgtcgcttgtaggcttgacccataaaaaactccccaggcagaatcggtatgatccttcttcggtggcttgacaaccttagaagtcatgtgttgaaagtgtcacaacgtggaaagagcctgagactctcccttaatcactgtgtggtggaagccacacttgtttaggttttatgtgaaccaaaaacaagtgtccattgttaaggctgagattttga

SEQ ID NO: 901 - DNA, 1025 bp, Homo sapiens
ttctactaatgtctgtgggagtgaattaactagagtatccagttgaattaagtattttgctgaaagatgaagggactgtgagataaagttggtgccgaggattctcacatttctaaaggaatcacttgaggtgctaggactcccagtccactcttccacaataccagacaacctgtaatcctcagacccagaatcttatgacagctttctctgatttcacattgtgtagattagctacccaaaaaagtaagtggcctcaaatagtgctgccctttaaaattattctatgcatttgtcccagagtcttgtgggatgaatggctaaatcctactggattaggcgagatgggtattattatctggggctacagaatggaaaaactcaggtgaaggaagttatcccaaacttcataattgatggtgagcctggatactcattctcaaatctggtgaggcatcgttggcttctaccatgatggcgatggtaagctcatttgtcaatcaaatgatcgattggcagtagggtgatgacagttaataataatctattatatatttcaaaatagctagaagagaataattagaatgttcctagcataacattatggctatcccagttaccctgatttgatctttacgcattctatgaatgtaccaaaatatcacatgtgctctgaaaatatgtacatctattatgtgtcaataaaaaaagttaaccaaatgatcgatgaacacctactatgtgccaggcacagtgctgggtgctggcaatgcagtggtgaatgagacagggacctgggtgcttgctctagggaatgcccttaggagaagctcagggtatgtttttttatttggaatgcttgctgattcccctcccaggacctccagaaagaagtggtggttgcttcagcggtcacttggtgatgactggcaggtatatacctgtgtagctggcacatctggtgcctgtgatcagagccgagccatccagtctgagctttgtttttcccagtgcagcagtggttt

SEQ ID NO: 902 - DNA, 1052 bp, Homo sapiens
tcactttccaaagaattgggcttaattttcacagaagcaacaactcgtcttatactcttgttttattaatttaaattctgtaaagtacacaatttccaaaaaattatatagctgaaactgtataacaagctttgggatcaaaccctactgaatcttgtcagaatagaactcaagaggtgggaatagtgcatggcttgtccaggagcatccacggagcatccttggacactaggtggggtgctctatagagggaatggagagccctgcccgatctagtgagttagttatgtggaggttggttaaaaaaacttctatatttgtttatttgcatgctactttacagttcttgaagtactttcaaattgattttctcatttaatttttacaatgctcatgaaataagcaaggcaagaatttagaggtgggaaaatggaggttcatagaagttgaattgtgtgactatgaataagtaatttccttgaaggtgcgttggaagcagagttcagatttttcagtcttaagccagatctctaccctctcttctcgattgcctcttttcttgctgttttgaaagcagtgatgagactttgattttatttagatatttataattttcttatagcattatgttaccatcatagggcatatcagtaatagtaacatactacatatgtcaatgttagacatttaatcacctctagcaacctacaagcaaataaagagacaaaactcctctggaccagcactgtccaataaaattataatttgagccacatatgtagtttgaaattttcctttgggcacattacaaaacaaaaaagaaacaaataaaattaattgtatattttctttaacccagtaaatccaaaatatcatcatttcaacatgcaatctttataaaaattcttcttgtgatattttgcactcttctttttgtactaagtctttcaaatcaggtgtgtaaattgctttacagcacagcttatctcagactagccatatttcaggtgctcacttgccacatatgttgaacaacacacctctgaacttta

SEQ ID NO: 903 - DNA, 1047 bp, Homo sapiens
agggcccaaatggagccaaaaaagagtcagcagcattgccacccacctgcagacacacaataggataaaagcagcacctgatcagggaggggaaggaacgaggagggagagggacaggcttggccgtgggtgtagcccggagttgggaagcccgtggcccaggatcaggtcagccactggctcagtgtgaccttggagctcagcctctgtgggatttgttttctcatccttttaaaatggagatggtagtatagatccttcctacctccagaaacatgtagacagcagaaagaagatgggggcaaatctatgaaagtataaaatgcactataaaaaagtataatgcagtttataaatgattgctcctaatgcatcaactggagtgaaactagccagagtgtaagagaggaaagaggggaagatgcagaactctgttcttgtatcttttttaaaaagcacaaaaaggtgatgtcttggtaaagagtagaagtttgacatgttttgtcgtgataagaatagaattactgtggtgactgtccatttatccacttgggatccgagcattccaaagtataagatgcttcattacaggccgggtacagtggctcatgcctgtaagcccagccactttggaaggtggaagcaggaggatcttttaaggacaggagttcatgaccagcctgggcaacatagcaagatcctgtctctataaaatatatttaaaaaattagcctggtgcagtggaatgcacctgtagtcccaaatactaggaaggctgaggtgggaagactgcttgagcccaggagttcaaggctgcagcccaatatgattgcatgactgcactcaaggctgggcaacaaagcgagacgctgtctcaaaaaataaataaaaatgctccttggctgtataagacatattttattgcccttttggagatttataatgagcacattaaagttttggaaaaatcctgcaacaaagaaatccgttttactttgtttagttcagtaactccttagtttattatccatggacccctctcctgtg

SEQ ID NO: 904 - DNA, 1050 bp, Homo sapiens
cctaaagctttgcagctgagtgaatggcccattgaaaactagcacgatgatcagatggacttctctctgtctaagggcattgattgagacccacatttatattgagggtggaaatgtccaacaaagacaaagaaaagcatatttattgctttagatagaagtcatatttgtttctttcactctggaagatatagtcacataaggtcatgagctattttttcttcctacttaattgctagtctgtgggttggtgaaagctcacatgcttagcttttcagtgaaactttcacagtccatgtggctctgactcagaattttttcccctatctgcttcttctgttgccaattcattgtttatctcctttgtgttttacatctgacctattattttgcatgctgttttggattactgaggtagcaacatccaaatagtttctgtgtacattttagcttttgggagtcaggcagctgctctggggcctgtttgagtcaggtcagggtcagaaatgcccttctgcttttgtttccgtggaagaagttggcctggaactctctctgggcaccttctgcgccctctggcaaccagaaaagcaaagtcgttcatcaaaatctcagactggagcaactccttaaaacagcttccacagttcttgcacatactcctttcttgatttgttgcatatcatttcaggcacctcttttaatgcagctattcaggctgcctaaggcagtggtccccaacctttttagcaccagggaccagttttgtggaagatagttcttccaccgatggggtgggggtggtggtttggagatgattcaagcacattacatttattgtgcactttatttctgttattattatattgtaatatataatgaaataattatataactcacaataatgtagaatcagtgggagccctgagcttgttttcctgcaactagatggtcccatctgggggtgatgggagacagtgccagatcatcaggcattagactctcataaggagcacgcaacttagatacctcgcatatgcagttcacaac

SEQ ID NO: 905 - DNA, 1089 bp, Homo sapiens
acaagctgtgcttgttaatgctctataaggagcctctgggagcaaggaaaagggaaagattttttgtgttcactttgcatccacacagccctttttattctcaagattatgctggggggaggaagcactagaactaccgtgaattaagtgttcacattgtacctagattaaagcaaggtgctctgcataattctcacatttaaccatgctgtccttatccttatttcattgatgagcttcagaaagtcaggttccttgaccccagtttcacccacagaggaagttctgatggtgaaatttgaacacagaatgagtccaccaccttgccttcctcttcggttttcaatgacttctccctgacagtcctgcgatggcatttgtggttttaatttcaaagacccttacaattgttgatggttgatagcatttggtatccattggaaactgccaacacttttcactgctgcatttggaagaaaatcatagtgagttgatgtgttagtgattcaggacttctgggaaactgagagcacccgtgtgtacttatttggagtcaatactttatgaacaactttggcccaaaaggagaaaaatctgtcttctgaaattgagtgcaggtctcttagtggcttacctcagcagggagccagttattacataagctgaataccaggtccgtgggtttccctaacctgaaaaagaagcagcgtttgcagttatgaggaaaacagaaagacccatttctctgtggcatgatactgaacaggcagcttcagccgtgaggatattttggccggaggaaaatgtagcttaagaaaagtcccagctggttcaagtgacttaagcccagctattcatgaaatattatctgacagctcccccttctcctcaagtggctggggagtgagtcacaattgccccagaaacctgtgttctcatatgggattttggtattccaggtttgctctactttgcacactggacagcttcatgaaaagccatatttggtgcagacattttcttgtgatgataaaagcatttagtaaatgtactgggaagcttgccgtgatgaatccttttgttaagaaa

SEQ ID NO: 906 - DNA, 1247 bp, Homo sapiens
gcaaatgtattcacttatttattcatttaatcaaccagatgcagttcctgccttcacagagcttaataattggacaaataagtaatttcaccaaagtgggaatgcgggtgatagggatagtgtgatagggaatgtgcagcgtgctatgggagcaccgtcacgagggattcctaattcagatgtggggacaggaccctggaaggcttccaggaggaaggaacatagaagctgagatctggggatggaatgggcattcaacaggcgaagggagtgtgatgtaattgatggcatggagagtattgcaggtaggaggaataatgtacagagtctggaagtgcagaaccatagagtactggtggaactgaaagtaattcaatctttctggaatatccagtgtggggacagataagtggatagggatgtggctcgtgatatagtctggggacagatcaaggagcgctttgcaggccatgctggggagcttggacttgatcctaaggacagtgtggagccatggaagtcttccaagaaaggagtgacttggtctgactttcattttcaacagtcattttatggagtaagacagcttatttcctcgccaaggaacttgaacacaagctcccaggaagggaggttgtgaaaacagtgaaagggccttccagaaagtaaatccttaagctccatgaaattagcttaaattctgtttgaatctgactggtgaatatcatagcaatgaggccaaaaaaaaaaaccttcataaaaacttaattatctttgaggccgtagctcatacttgagggaagggacatgggtaacgctagagacatatatgtttgcattaacttttacgccactgtggggcagacaattaaagcaggagtggaggagtcagagcagttttgaatctgcttttaagtcccagagagtgtcacagtacctcctacccagcactggttgccaaagtaaaagaaagtggtaacaatagggcataaggtggtggagaagaggctgggtagaccttggccatattcttgctttgcaccttacactgctataaagaactacccgagactgggtaatttataaacacaaaagaggtttaattgactcagacttctgcatggctggggggtctcaggaaacttaaaatcatggcagaaggtgaaggggaagcgaggcatgtcttacatggcagaggaggagagagagagtgctaagagagaagtgccacttttaaaccatcagat

SEQ ID NO: 907 - DNA, 1014 bp, Homo sapiens
ttcaatgagataaagcacagtcagtgctgctataacagttgttttgaaaacacacacattttttcaaagctgattgatgtattcagaaaaatttgagaataatgcaaattttatgtttacttacatagtcagttttatccacgaaaagtactaggtggactcagaagacggcactcagctaaagtgagatgcatggcaatatacaaacacacacacctgaaacatctaccagctcctcagttcaccaggtgtgttgagttacactcgagttacactcatccacatctgccattacaactttctgtccattttctgataaccagccccccacccaccacttcacaataacccataagctgtaacccttacaatgcccatttccacaagaaagtagtagtgtgttccaatcttgttttcccataaactctgctgtttttactgcacaattttgcatagtgtggtgatttctcagaactcatatgttgtgttatagcagaactgactctgtctaacacaattcctggcagacagcagacactcagtaacaggtagctgttttattattaatattaatccacttaagtacaattgtgggttggggcagggatccctagttacaatgtttagctgctttgattagtagtgttaagtgaaatggactgcctgagtggaagggttttggtgcttttatcttttctaagtgtgtgctggtcagaccacccttggggtattaacagtgacaaaccaggtatgtccagaaaagagcaagccagaaaaggagaagacatgagaatgatctttaaatagttagagggccatcttggaagaaggattgctttgttttgtgggtcttcagggtgacaaggggaagctcccagggcccagggttctggctagctcggggacgagcctcagaatagtccctgggggtgatgtgttctccaagctctgattggctgctctgggaggggagaggacagagaagagtcaagcacgggtttggaggttctatct

SEQ ID NO: 908 - DNA, 1050 bp, Homo sapiens
tcctctccatctaagcaggctgttaagctcttgtagtaagaaagatgttaccctgggcttagaccctctcggtggagctgagatggagaagcctccggaagcatggggcatttgagctgagggatggcaggatctgcttcagatatttaaagtgggttactctgagcctgcaaactagagagtctagtgtggtgtctctagaagaattacttttgtacccttagatgaattaaaaagtaattatactgagtgttttatcttgcctgtatacggatgtataagattccaggtttctagttgatgttactgttaaaaacagaagatgttcaaacatatttgattttattaaattagttttccctgtagtcataggaggggtactgctgtttacatgctgaatcttagcaaaactataaaatagcatttttaaaaaatggcagctcttctgttctgatgctttgacaattaatgttatctctttttgtttctatgatgagcacatgggacttaggcttactcttaaaatggatttttccaaaaccaagagttattacatttcttcctctgagacaaagtattcaggcctcctcctcttctagcactcagtctggaaaatgtggttagtctttccatgtgggagctcttgtgctttgtgcattggttccaagatggcaagtggactactgttccaagatctgggcccaaggcatgtcgttgggctcgcctgaacttgtatataatgaccagaaggaattggtctgcactgccattaccgccagccactacctgatcaattctgcttgggaaatggctctaatcaacattcttctagacctgctgttcatggctgcaggtggcaggctcatggatcaataattggctggggcggttggccccactggtcaacctcactccttgagccctatttacctgttgctgcctcctccatcctcccctaaagtcacacagcttcaaataaggtggtcccatctattttggtgctttcccttctttcttaacctcccataatggaaaaagcacaggttccag

SEQ ID NO: 909 - DNA, 1046 bp, Homo sapiens
tttgtggctgtcaaaagaaagtgtgtatctttgcttgaggccaggagttccagaccagcttggccaacatagtgagacgttgtttctacaaacaatacaacaattagctggacacggtggcgtgttcctgtagtcccagctacttgggaggctggagtaggaggatcagttgagcccaggaggttgaggctgcagtgaaccgtgattgtgccactgcactttagcctgggtgacagaaacgagattccgtctcttaaaaaataagtatgtatgtaattgtgtatgagctaagttactcttcctgtcacatttgtatggtagctacagtcaggcactgcataatcatctttcagtcagcgttagaactgcatataaatggtggtccaatagggttataatggagctgaaaaactcctagagaggctgtagttattgtaatgttgtagtacagtgtattactcatgtgtttgtggtgatgctggtgtaaacaaacctgccctgccagtcctgtaaaactatggcacctccagttatatgcagtatacctaattgtataatgataatagtaagtatatttgtgataatagtaagtatacttgataatagtaataaacaactatgttagtggtctacgtatttactatactttttattattattattttagagtgtactgcttttgcttctaaaataaaacattatctgtaaaacagcctcctgaaggacctgaaggcaggtccttcaggaggtatttcagaagaaggcattgttatcatagcagatgacagctccatgcctgttattgccccttgaagagcttccaggggacaagatgtggaggtggaagacagtgatattgatgatcctgaccctgtgtaggcctaggctaatgtgtgtgtttgtgtcttaatttttaacttaaaaatgtttaaatagaaaaaagcttatggaataaggatataaagaaaatatttttgtacagctatacaatgtgtttatgttttaagctaagcattattacaaaagagtccagagttaaaaaaata

SEQ ID NO: 910 - DNA, 1034 bp, Homo sapiens
ctccattcatgataagtgctctctacaggtgtaacatttttaatcttttatactgtatttttactgcatcttttatatgtttaggtatgtttagctatacagataccattgtgtgacagtcgcctacagtattcagtatggtaacatgctgtacaagtttgtagcctaggagcaataggccatatcataaagcctaggtgtgtagtaggctataccatctaagtttgtgtaagtacgctctgtgatgttcacatgacaacaagcatatcaactaagaatgcttttctcagaacatatctgttgttaagtgacgcatggctgtaattcatgcattaattggttacttgtaccctctgtttagggcttcaaaagtcagatctgtccatctaagatgcttttaagtaacatttaccttaaagaaatagatggttgattggtttaaagaaagagacagctgaattggacggggaagccagattttgaccatatttctaagaggagctgttctgtaatgttttggtaaaagaatgtctgtctccatatcatctatctatctatctatctatctatctatctatctatctatctatctatctatctaatttggcatctatttatccattaatctgtctgtaatacaaatattccaaacatttaaaaagtataagaaggctctgtagtgcaatggatagcacattgaactttttttttgtttttatattggcttattgcaattaaaaaaggtgcaaataatatatgtaccaaagaaaattcagaaaataaagaaacactgagaaagtgaaagactagggctcatattataaacacacaaaaaatcacttttaatattttgggtacatttccttgcaggcttttttgccctatgcatacatttttatccataaatgtaatcatcttgtctatgttattttgtagcaagcttttttttcacttaatacataatactattttttccaagtctttatagatattgtttttcttttcttttatttcttttatttagccatcactca

SEQ ID NO: 911 - DNA, 1088 bp, Homo sapiens
aatttctgacttggtgtggccaccttattaataaaaaagaactgatggaagcaaaaaggcgtcttcatttttaactccagaagcataacacaaatgctttccagtctttctttgtgtggagagcagaccaagtgactgcaataagatcctgttacacatttgaaaaaaagacttttgcagagtggaggtaactcagtttgaatccttcttttgttaaactttaaaagaacactataaatatatgcccctttccttgaagaaggtatttcgaaggaagcttcaggattatattttaaagtaaattaatattttaataacataaggaaactaaaaaacacctaatttatttcagatagtggaggcctgtggtactttctaaaattattctttttgcttaaactactataaactgcttttttggatttaattactaggcttagatgaatgtgccatgcatcttattttggttctttttaaattcacttggaattaaaaaaaatcaataatggcaaaaacgtctggtagtggatttctgcttgatttcatcaagcctgtatattcccctataatggtaaggagtttgaaatcgtggttatcatcctggaaattttttgtccccaaagggacaaacctacatttgtgaagacagaatgatttagaatcttaatgtactcagtaaaccgagtgaacagagcagaaaaatgctgggaattcttcacataggctcagaagagctctttaattcacttagataccaaagacttattgatatgtcaggctgtgggcggcatcctggggtctgttatggcaatgaattcctggtccttaggtgacaagaatgggatgagtgtgctatgcctggctctgagataaagaaaaaacatggaatgttaaggatcttaaagtctttacgggtttctttgcccactagttttcaatgttttttaattaatgatgcctttcaggctgtccatgggcccacgtttagaagtgttttgaatttcaaattattaatggtaattgttgttttctgttttcattaaccaaaggcatgtataacaacccattcagttcatttgtttattgat

SEQ ID NO: 912 - DNA, 1051 bp, Homo sapiens
atcctgttgtttaaagacatctccatccttccctatcctttccctttcaaatctatggcccagactgggggtggctttaactaacaacagcactttgcattagttaagtagagtggaatttctcattctacctctcagctattgatgaaacctttccctgatgcacaaattaagactgggtgtattttgcatattttcctagaatgacacagtgattctgtggctaaaccaagattagaccctaccactttaaaaaatctgactttttgcttaaagtgtaaactgtgttgcttctaaaactactagttgaatttaactttcaagtgtactttgtatttaaatctgatgatagtgttgtttttccttttgtcttgtttagatgagggtattttcttcacttccctgacccctagtgcctcagtgacctaggcagcaagttttttgatgctgtccagaatgctaattaagatatttattctctttggccctattgtttatgatacttgtaattatgtctattagatggtaatctctgttatctcccactatactaagtgtactactcggcacataaagaaatgtgtgagtatgtgaatgtatactcacatgtttgaataaatgtgaataaatcaatatatttatatagttactgatttaaatgtgttccgtcttgggatgtgagatgggataattgaataagaaattagcctgtgtgtgttaaggtagtcaaagtttttatggtacctttgtacaaactgccccttctgttgtgtgtgtgctgacccatgtcatgatgctcagcatgactggaggagtcctggtgtgtttctgtcctcacttgctccctgggttgggcgcccctctgcagggtacaaccaacacagttgtatgaagaccctctgactttcattttctggctggctgggggttttggtgttgagcgcttttaagtaagacagtcaccttatcctactcaatgttttcttgaagtgcaggccctgtgaagatgaagatcccctcttctattttggggacacttttgtgatgcttt

SEQ ID NO: 913 - DNA, 1035 bp, Homo sapiens
cttattactattattgttctaaaattcaggcctttcttcaccacactgacactgagtaatatatattgtagctgttcaataaaactttattggatttaattggttatgaattttatgtgtgggaaggtggttaactttcctatctgtaaggagaaatgctcaatagaatatcttaaaatgggggaagttatgaaaatataaaataacaaccagagaggcaaaccagtttatgagattctgtattagaaagctggaaagaagtttttaataagaagaatggaggctgggcgcagtggctcacacctgtaatcccagcactttgggaggccgaggtgggcagatcacgaggtcaagagttcgagaccagcctggccaacacggtaaaaccccatctctactaaaaatacacacacacacacacacacacacacacacacacacacacacatacacacacacaaaatagccaggtgtggtggcacgagcctgtaatcccagctactcaagagggtgaggtaggagaatcgcttggacctgggaggtggaggttgcagtgagcagagatcgcaccactgcactccagcctgggcaacagagcaagagtctgtctcggggaaaaaaaaaaaaaaaaaagaagaagaagaatggaagggtacaatctggtggtagacaccatttgaaaatattctgtctagcaaatagtgtttttgagtaaaagaaatagacatgacaaatcagttatgtggccatcccttataacaatgatgaacagataggagggtgtgcaatctttaaagtttagaaacaaatttgtccttctgacatccttcccttctcttgacacacggttggtaatggccaagattctgttttgcctgatggagttttgagtgagttaaattaggttgtcttgaaaatagctgggccagaaaataaaaaggttttctctctttggaaaggggctttactccagggaagaacacagctgtccaggaggaatccgggactgttgagtccagaaacttcgatccttct

SEQ ID NO: 914 - DNA, 1060 bp, Homo sapiens
gacagtgagagggtgggagatgatttgagagggtatttacattcccaggattttcagatatatttatgattttatttttttggagacagtgttccaatagagaggtattctgtcttctcttttcttttttctcttctctctcctccccccaaatcgaggttgtaagtgatgtgagagacctgctgtgaactgctgtcaccagatcctgctatgatttctctttgttcttagttctggagtcatcaaggctacatggagacacgtaccttccactgatatgtttgctccttgattcagggctgagtgcctgtttgagtgattctggctacagctaaatgatatttctgtttccaatagtattgtaaactatagagtaagaattttcttgttgttgttgggagagtttgtttttcttcttagtgtgtattatctcccaccccactcctccaacccgttctttaaaaaacaaaacaaaaccaacaaacaaaaacttgcattgaagcaacacccagaaggagtgagcaggcctaggctggagtcttatcctgacatggtagaatcctgttactgtctcttcgtagattcatttaaattgttttgactgattcatgcaatctctcagtccattgatcaagtcaaaagaaaaagtatcactaaaaactcacaggactggtgcaggtagaatattctttatctatggaaaattcattatcctatctagaaggatgtcttgaaatagcagaatatttttattatgttttttttccaagtaatacatggttcaagaaaaaagaaattttaaaaagccacactaatagcaaaactaaaataagcatgaatcttaattttaacaaagattacagtagtccatgggaaggattgtctgcccattgcagtgggtttgattggtttttttacttggaagtgctcatattctggaatgtgtttatagatcttgaccttagatacttctcctgactcagaaattgtaaaatgttttgctagagtagccagtggtgagagaccgctactgctgtatgttgctcagggctaacctgtt

SEQ ID NO: 915 - DNA, 1399 bp, Homo sapiens
aacttttgaattattgcagttacctggatatatgatgtttttctgctgtgtataaagtgggctagaaggatcctcactcttccacactctgtcctcctcccaaaagaatttcctatttgttcaaggtgcaggattgacagcccaggagaccttgtgtctccacctgggcaggtcagaccatggcctatgtgggtggcttgcagcatgtctgtggaaagtgggcacagaccacctttgagggacaaaggggcggttgtctgagggcccctttaggagctcaccttcctttgccctactatttcctgttttgttttgcgttttgggatgggggggtttggggatgtataggccatgcttgttcaccctgagttgctgtcctttcttcccataacaatgtctgaagaaagaagaggagggtgggcttgaaattgtgatggggctaatgcttattttgaatacatgaggtaattttttgggtttttgtttactttattcttgctgttgaggtataattaatatagatgaattatgtgtttggttccatcagtcttaatagtcatgtccactcatgaaactacctaaagcaagctatagaacatttgcgttatttcagaaagttcccttgtgctcctttctagtcaattgtactaccctgcctcccatccctactcccacacctctacccagaggcaatcactttctggcttctatcaccatagtttatacacagggtaattttaaaaagcgtgtattcactgcaacctgtgtaaatccaaaaagggttacagttctttggggactgtttttaaaaaaatcagaaggctggagctagaagcagctttctcccataccttgaacaaatctttgacaatgatgggcctaggtgacctgatctctaaaacaattataataataattcctaccacatagcagaaaatgataataatagctgcatactgttattgaccacttcactcttctgaacattttacttcattatcttatttaatcttcagaatgacaccttgagatgtgtaccattttttctattttaacacatggcgaaaccagagctttcagaggggaagtaacttgcttagggccacagagcagtcagtcataattcaaatcaggagcctttgtgtccagggctttaacctagagcaggcctatgagagacggactcttgtgaactgaagtagcagctaagcagaggtcattattattttaaaagcagtatctattggtcagagaggacagtcttcctttttttctattttattaccttttaaatatttacatagaaaaaaatctagttttcagaatgcttgacatcagtgggtatctgcaaattagaactgtgggtactaagtttaagccttgtgctaccaacaggaaa

SEQ ID NO: 916 - DNA, 1025 bp, Homo sapiens
ctaaaatgctttgaaacatctttgaaatgatggttcaatgcacagggtcaaagggtaggactggttctcttcaagcattttaaaaaaatgcctcatttttatttaacattgttttgggaaggagtgcattatattgacacattgagaaaaaaattcctttttgtttttctaaaactaataggagcttaggcattatgattaaggaccaaaaagagccaatgccgatgaatgccctctttcttcagctgtaaaatttaatggccgctaccgagaggtttttcttttaatcagcaaaaaatttattttgtccttgacattttatgccaaaaatcagcccagagaatgtgttttatagcctgggctgaattcccctaaaggtagagttttcctatgagcagtgttcattgaattggctttttttttttttttttgcactagataactatattaatttattagataatctttttattgtttcagcaagatagaggaaacttacacagagacagcagagcataatgggtaagcatctgggttcttttggaagacgagatattggtttccattggccttgctacttcctgtctttctgaccttgagtaaattactcttccagagcctgtttctttgttcaattggggatcataatagtgccgccgtcatcatgctgtcatgattaatgcacctaaagcatttagcacagctgtcagcacttattgagtattgactaattattagcgatgcacagtgatctataacttaaagcttcgtctcagaatatgccttcttatgatctgatagtaataggaatcagcagaaaataaggtggttcaactatccgggaaaactaccaaatatccgcttagcagaggcaaaataaatgtagcttaaatgcagctgaaaatgctgaaagctgcttttgtttctcatgttatagaaatgcagttatttttattaaaagtgatgggaaatccatctgtaatctcctgtctttcttttatctgtttgtaaaaatagctcagtaa

SEQ ID NO: 917 - DNA, 1036 bp, Homo sapiens
gaacaggatcccaggccatgtggaatcttgaaaaggtgattgacactggagacgcaaggtcctgttggtttgggctggttactcaatgtctttgagtctcagtttttcacctgcaagtgggaataaggatagtactccgttctctgagttgtgagggttaattgagccagtggtgccagatcacagtaggtacccaggcaaagaggattgttgtagcttactttcttctggattacatcatccttaatttttctctttccctctcctctcagaagtcatcacaaattctgacacttctaaattatgccttaagcctatctatattgtgtctagctaccaccttagtctaaatcagcttcacctctagcctagattactatactagcttcttacctggtcttctgcttgtactcccacttgacagagcatctagagtgattttattaaaatataaaccagatcattcattcgcttttgtaaaactcttcagcggtttccaattgcactttgaatcaatctgtaccccttaccctgcaaactgccacctgctgtggtccctgcccacttacccacctccactggatgcccctcgatacccagctcactgtgcctcggtcatgacggccttctttttcttccttggatgcaccaaaaccagggggcctgaggacctttgcatgtgctgtttgtcccctttgcctggaatgctattctccaagatctttgcatagctggaaattttgtagctctaaacacggggttcttccatttcataagactataaagctagcaacctctggtatctggttaacagttcactttgtgcaggttattccagatgcagatagcatgggtttaggttttcatttagagaaccacctgacctctccgtagaaactcaccacattctctcccccagtgactttctaacacattacagtgttttaattttcttcatgtactcagcactacttgaagttttctcatgtatttgttgacagtttatctccacccactagaaggtaactctggccag

SEQ ID NO: 918 - DNA, 1033 bp, Homo sapiens
gcttaggaaaaaaaccaacttgttaaacctgtcttagcaaactgaccacaatttgtaatattttctttaaaggaagaaaaattaaaccctgagtttccaaaatcccataaagacagtggaagggctctttccaccagggacttgcgtagttgcatgttgttgcctccgagaattgaaagtgtttaaagcattattttattctattgtgctgttatcacctcaatcagtataattctacacttttatttcctggtctagggactcagttttgatgagatttattgctttaaagaggatagcccttttttggagactatttagtttcagattagttgacaaagtaacgaacaagcttggggtgatcttgaactaaataaacgtcatgggaggcagtggtgctatcaatgaataccgcaaggactgtggagtcaggtaaacctggctcctctattcactaactgtgtgatcttatacaagtcactaaacctctctaagcctcagtttattcccctttaaagtggggataggactgttactgatagtaaccccttgtaggattgttatgaggattaaatccgatgttagagcttgggtgtagtgcctgacacagggcaaatgctgaacacctgccactcatggttcgttatcattcttatctttatgttctatcatgtaatttcgccaatgtggttaaaaccagttagttccctcggaagttgtcaaacaaggagacaggcataatatgctcagcaattggagatgccgctctcttggttcagttactcagagctgtcaaagcgacagtcggaatccccttcctggagtgttggctgtgcctcctgggtctcccgcgtggattcctcacagatggcagggcacatcccagctcggcatgtcgacatagtcaccaccatggcttttaatgagaaccattcattgtagatggacgcttttgagttttgtacagagataaacagatggcaaggtttgtataatttcctgctgggtaatctggtactagaagtatgatcta

SEQ ID NO: 919 - DNA, 1042 bp, Homo sapiens
aagataaaaataaatcatctgcaaaaccccacttgaaaggttttcataaatcttgtaaaagttgggccaagtttaaagattgctgcccagattggtttaaagcccttcattgtctacaatctaatggggatgcttataaagggaggatctggaatggtctgtctggcagtgtgtgtggtcaccggaatcacggccttttatctacctgatgggtatgagtaggaggagttggctcaggctccaggaaagtcagcagatgataaagcccttgtcctcggtcttgctcatgccagcagttggagagcagtatattgtgtgttatcaggttctcagaccctagcctggcattcatgggctattctccagccttgatcaaacccacctttccactgtataccgttccacacttaccctttcttttgcttagaattttctcaccctatctgagtaagacctaatcctaaagaggcccagattaaaagccatttcattcctgaagttttttcttagcactctactggctgtgttcttttcctttgcactatgcctacgtctcatgcctgttttccctttctatatttgttgtgcttataggaatttgccatctaacctgggctctcaaatacttaaagttttcacatccatccttttatttagaccttaaaacagccccatgaggaatgtagcattttcatcctcacttttccgatgaggaacccagggctcagagaggttacgtgatttgcctaaaacacaaagttttaggcaaagttaagtcagactccaactttggtgcattttttctctgccccaggctccctccttgaagtcttatgtcatgtcttgctcaagtttgtatctccctgcagtgcctagcacagctttaggctcagtaaggtttttttatttatttattcaacttacatttattgtatctatgaggtgttagttaggtcttgggtactagcattaagcaaacatagatatttgtggaagaaaagaaggaaagaagggatgtggacatttttgttttacttagtaa

SEQ ID NO: 920 - DNA, 1046 bp, Homo sapiens
gtactatttagtgttgggagtgccttagggaccatcaacaacaggcccctccttttatccatgagactactgaggccttggaggttatttgtccatccatggcgggtgcacactagaggttatctggttagtagcccaactaagattagaacccaggaattttgatttaatctcaaatgacctcttttatttctgcatccgggaaggagaagaggaaagtaaacgggaaattcatgttatctatggaaaagttatcagtttgatgtttattaaatgatttgtttcaggagattgtttacaacttttatcttcctagacaataattttctgtaagagtaaagtcatggtcattaaggtagtcatattaatgtattcagtaagctgtgtggtgtggataattttggttttgacaataattatacttttattgaacacttcctgtgtgacagatcatttatgttcttttctgctgaaaattcagtatgggctgggatcacatttattttgtagattattctgtctgcaattcccaaatatagtgggcagcacatggtaaacactttgtaaataattgtaacatgttgtagttttgttatagcgttatgctttgtaaaattaaaagtagctatatccttctatgatccagaaatttcacttctggttatataaatcaaagaaatcctcatatggttctataagagaacatgtataagcatgttcatcacagcattgttggtgatagctgggaattggagacaatctgaacacacatctgtattagtcaaggttctccagagaaacagaaccaatatatataaagagatttattaccaggaattggctcatgcacttatggagcctggaaaatctgaagtctgtggggtgcgctggcaggttggagaccaggaaagggccgatgctgtagtttcaagtccaaaggctgtcaggccgaagacctgggaaagagtgaatgttgtagttcaagtctgaaggccatctgctggagtaattccctcttgcgctggggaggtcagccttttgttcta

SEQ ID NO: 921 - DNA, 1033 bp, Homo sapiens
taataataataacagaaaataatagcagtaattttaaccagtggagtagtgtgaagaacactggctatccaaccagactcctggtctactagatatataacctggaaaataatttaatctgtctgtgctttagttttcttgttggtaaaatgggagtagtaatagcaccgaccttgtaaaggctgttgtgatgattaaatgagcaattggaactgcacctgccatatatagtatgtactctgtaaatgttacctcatgctattattatgctttcttaagcacacaaaatatttgcaaacaacataagaataaaatggtaaagaaactgacttcagctgtaataactaaggtcctccaatgtgccaggtatgatgctccatactttatatacattatctctttaatcatcataacaactctcagggagagattttctcactctccccctccgcattttacagatatggaaacggaagtccggaagactcagtgtgatcatctgaattgctctttaagacttttttattctttactactttcccaagttgccaaagcctggcagctagcagcaagtcctctgccctggatctgattggtcttgagaatggggaggactgtctagtgtttcagctgtgcctatgctgctgagagatgggcaataggggaagcgggacccctctagaagtgatggctgagaaacttcaggctggactttccacaccttttcagggttctggagtgagtcagtgttactcagcccacttagggctattcttgaagctgctttgaaccagattttaaggttttagaaacattcggtaaggcaggagtgtggctggtaccctgcaatccctccagaatggtctggtttctaactgggttgatttaggatgacatcacatcagttcacagcattaaaactgcctttagcgcctcattgtccaaaaggacaatgtcctcattctttaatattgcggttgagtggagtaagttttgacttcagaacctaacaggcacagatctgaatcttggc

SEQ ID NO: 922 - DNA, 1008 bp, Homo sapiens
taaatgtgctttgcaaactctcatggatagatagcatgttattagtatgattgctctgctaatgagtgtagactttgctgaagttctcctcctcctcttcttcctgcctcttcttcctgctcattactgtcacaactaccccttatgaatttgtgagccattagggtagattctgcatctcttaacccatgtctttttctgcctgccagtcagagtcagcaaatattagatacctaataagtgtccaacacgaaggatttaaagatcagtactcaaaatatacaaatatggacatgcagcgatacctaagtgactgtttacagttccccaaattagtatggctccctggggcagaaaaatcttttgtctacatttctaatgtctactcatccttaaaactcaactcaaaagtcagtatcccttggcaacctgagatgttcatttctgttgccctcctactcgctcttatgaggtgctctttctatggagtcccgtaaaactccgggcatacctcagaagaaacacttgtcatttgacagaggaatctttgagaattgaactctttttaataaaaattctcccattttgcacatggtatagaattttaagagtgcaaaaagatgtacagtaaaacatcctgcttgcccctgacttgaaaccaccagttccccttctctggtgtagacactgttcccaattttggggcatctcttttatagatattttataaagatgtatatttatacatgtaagagtatgcatacataatgcatattatacattccatatgtatctgtgtataagaacacacaagcacatttttgtttttgcataaattatattgttgtatacacactatgagtactttgcttttatttttaaacctaatgatttattttggtgattgttccaaatacagtgcatacagtttccttgtttttttataacagctgcattgtatttcattgtgaattttggatagccataatttatttaggtagtctgcta

SEQ ID NO: 923 - DNA, 1564 bp, Homo sapiens
ataagcttaaataaaacttattttgttattaaaattcatagtgcaataaatcttaagaggagccaaagcaaaatatacatgcagcatgattccatttatatgaagttctgaaacaggcaaaattaacctatggtaatagaaattagaaccttagttgcttcaaggtggggtgggagggagtggttgggagcagggaccaactacaaaagattgtgggggtactttctgggttgttgatgttctatcaagatagggacatttgttacatgagtatatgcatttgcctgtactcatagaactgtataactaagatctgtatattgcacagtattgtatatgaattaatctatatatatgtgatcaaaataattacatattgtaacatgttatggttgatatcagtaatattatggaaatgtccattgctttattactctgtctgcctctgacctggccttcataaccttatattgtcagtaacatgaaagtttcaggcatcctttctgatcttgtgccatgtggatatgaatgtgttgctcctacttttccaatttttgatgctttctttcttatcaaaagtgagcaaactggaaggatgtttgccaggatgttaaaaatggtgttatttttgggtggggagatttgaggtgaactttattttctctcttttgctatgctggaatttggaacaaggagtgtatatgattttttgatctgaagcacaaaagcttatccatgtagtcttttggagactttgggttctatactctgattagtgacaaattttcttccaagcagcaggctctatgggtggttatttagcagtcctctggtcttaatcaatgtgattgtttctttccttgtctgtctcacctgcctctcctgctcagcctctctgtgatcccaagggtacactggaggggatttggctgcttggaagccctctcaagctgtctgcccctctcacctgcctcctctctgtgctcacagattcttacctgaccctcgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggtaagcagacccctactggggatggactttggccctcagcccaatgtggtaggatggctagagtccacagggacaggaaggaaggaatgcacacttagtgagaatgtactctgtgcccacaaccctaaacctggtatggttgtacccattttacaaataagtaaactaaggcccagcagttagttaccatgttacccagctagtaaacagcagagcaggaatgaggtccggatctttctgacctcagagcccctaattgaaaccatcgtgccgttgagctcttttc

SEQ ID NO: 924 - DNA, 1026 bp, Homo sapiens
gttgaggatttttgagtccatgtttataaaatatattggtctgtgctttgcatttcttgtgatagctttgtctagttctgatataagggtaatattggcctcagaatatattgggaagtattcctttttcttccattttttaagaagagtttgtaaaggatttttatttaaatgtttggtataatcaccagaaaagtaatctgggcctgaattttcatcatgggaagttttaaaattactaattcaactttcttacttgttataggtctatttaaattttctgtttcttcttgagtcagttttggtagtttatgtctttctagaaatttttccatttcattgagattatctaagttattttattcctttatcattcttttaatttctgtaacatcattaatgatagtcccttttttattcctaattttaataatttgtgtctttttttttcctttgtcagactagctagtctaactaaagatttgccaattttgttggcaaagaactaactttcgttgaaaactggatattgaaatagagtattgtgacaactgtggaaatcagattgcctctcctctgatgttgctgtgtgttgtttttgccgtttgtttggtgaatttcctgaattaattctgtatagtctgtattttctgtcatgtactccctttaaagagagaagtctcagccaggtgcggtggctcatgcctataatcccagcactttgggaagccagggcagctggatcatgaagtcaggagttcgaggccagcctgaccaacatggtgaaaccctgtctctactaaaaatacaaaaattagccaggcatggtggcatgcgcctgtaatcccagctactcaggaggctgaggcaggagaatatcttgaacctgggagccagaggttgcagtgaaccgagatcattccactacattccagcctgggtgacacagcgagactccatcttaaaaaaaaaaaaaaaaaagagatgtctctactcagttagcctagtaactagttaatgattgga

SEQ ID NO: 925 - DNA, 1022 bp, Homo sapiens
cttggcagctgggccagcacacagagggccattgctccagtaaagcagctaacctccatctcttcatcaaaccatcctagactcagcactctgcagagaaggagcagatggagggaatgtgtggagagattagataagaaggatttctaatctagtgggggagcgagtaaaatgtacagaagtttgagaagccaagctcttatgtaccaatccacccccatcactcaacaatccccactgtatgaataaagcctggaaagtttccaattaaaacagtgcttgtgaatattggcaaggggtatctttgtgtgcagggtacatttaaagggagaagggtgaagatacacccttgccttctaggagtacactttctgagagcttgttcaccaggctgtgagtttctcagtctatctgtttctcagtctgttagtaatgaatgtatctcccacttagcacagcagctagcacatagtagatgcctaacaaatgtgtgttaaattgaatgttggaagtctgtgtcctgaaagcttttcttcacatattacaaggctttttatttgttcaacacatttttaccaagtttttttctgtgttccaggtcttttgattagctgtttttaagtcacagaaatgggtgtcgggaacaaaaccagtcaaaagtcctcattctacatcatttacactttcccttcctatatttataagttttaatatcagcttctacaataggttccagaacaagtggtgctcaaggaatggagaaaatgactattccaaccctagctgtaggtgaaccaaaaaccccagagaaatcaaagtgtagtttaaagcagtgcttctcaagttgtaatgtgcatatagatcacctggggttgttattaaaatgcaaattctaaaagagcaggtctgggagtgggcctgggactgcatttcttacactttcccagggggtgctggtgctgctggttcacacacttagagaagcaggggtttagagaagaggtgcctggccagatgctagt

SEQ ID NO: 926 - DNA, 1066 bp, Homo sapiens
cttcacggatatagtggtgaacaataccaggcaaactctttgtgctcatagaacttggttctatcaggagaaatggacgataaacatggagaccaataaataagataggaagaagaaagtctaatgtgtcagagagtaatgtctgggggtaggaaatgggcaactttaacagcttggtgagtaaaggttttctgccaaggggctgacatttgagctgacctctgaggaacagagtgagccaggcttgcagagagcaagggaaagaaagattattctaggcaaaataacagcaagaacaaagaccatgacatggaaaatggttttgtcacgatcatggaacagaaagaaggccagcgtggccaaattggatgagcgagttgtgggaagtatgacttcaggttagaaaggcgagcaggagctacgcgttacttagctgtgcaagccagtgtttgggcttcattccaagagccatggaagccatgggagggtttcagctaaagaggtgatgtgtcctcatttacaatgggaagagcactctggcatctgtgcggagggtggacgagagtatgagcaggagctggaagagcaataaggaagtttttgcactagtctagatgtgaaaataggtggtttgatgacttggaccaggtcggggtaggtgagttgtaaagaagtaagaggatttgagatggcttgaagaggaggcaggtgtgaaggtttaaattatataaataaacaggataaatggaatctgcatccaaaatgcctaactgcttagaacagaggcggtgatcaactcatgtcccgttctggtccactcccccccgccccaccacccacacagacacacacacacacacagacacacacacacacacaaaccttggtggcttttgaagaagtatttatgggtttcatcctcatctggattttcccatcatcaggaatgagtggcaactgcggggagaaggatgtggatgtgtctctgattttcacagcatgaagacagaataagtctaccattttctattcctctataatcttggtctcttagaatagctatagc

SEQ ID NO: 927 - DNA, 1075 bp, Homo sapiens
catgcgagcctcctctagtaagtaggcagtccttgcacgtgggctccccactaggctgacccagattctgagggctgaccttggtttaagctcttcccattcaatctcccttcttcccactcttctttctcagatatcaagtctgtatcatggtctgaatgctctccctgcctgctcttctctctctccctctttctcttccacaaacactgcccccagtaaatctcttgcactttgaattccatcttggtatctgctttccagaggaccagaaccaacacaagtgatggttacatatccaaaagaaattattgtggaaggaaaatagtacagttcttgaaagcaatcaggattgagggataactgaatctcaagagtctccctaatagcataattagagggaggagtggaggacaaggtttgaatcttatgttacagtcataattgggaaagagtacagttagtcttgtaattgggaagagaattcaggatggtggggggaagttattgaaaaagtagaaggaaactctgggaagtgtaggatcatagaacatgaaatagagagagagcgttttaggaacaggtgataatcagcgcagatgtcatcaaagaaaatctgagtagggactgaggtcttgtatttagagactgacagtgtggctggctggccatcaagtgattatttcagggaaagaatgagaataggtgccaagtttacaggaatgaagaagaaacatagtgggaaatagctagaggtaatgacagtagacctcacattgaaaatgtttgtccatgaatgagaggagggaaattgagctaattagagtaataatttccaagattgagtgtgtgtgttttaggaacacctaaccatttccagaagagggctttaaaggtgctagagagagagagaaaaaaaaaaaaaaaacaaccattgtagaattaaaatgctgaaagcagtgggaagagaaaagctactgaggccagagggaggggttagattttaaacagaagagagaaacctcttttctggaacgtggcaacaagaagatggcagaaatgacagagatataag

SEQ ID NO: 928 - DNA, 1038 bp, Homo sapiens
ccacttcacctttgaaccctggaaaagggcaggaagaaaaaattatgtaccagtgtgctcaattcttgtacatctgtctttaattctcaaagcaactttacaaggtgggcattattattatgcccattttacagaaaggttaaatcacttatccagtgaaactcagccagaagtggcagaacttacattgaaagctaggcctatcaaatttcaaagctgttctttctactataccacaggattaaacaatgccaactattgcttgtcataaatgaaaccctctcttaacataagtttgactcaaaaagtctgactcataattcatgaaatactaagtaactcttcttaaataactaccatagactgtccctctccaaagttttctatgtctattgcaagcatgttttgcctttaacaaacaacacccctttctctgggaatcattctctgtcattcctctaccctatctcatccagaaactggggctctagaaaccatgattttgatgtttaattcaagtctggtcttgagtgggccaagctaggaatgaggagcaggagagagttaagacgtaaaattttactcactgtatggattgagcagtggaaagagaaccaagaagagagatcttgtgacaacttacatctccggtttacttttgcatttcagttcaatgaaacagcctacttaccatataatttagtctgccttttttttcctgaagctttggtgtttgtgtgtgtgtgttttgttgtttttgttttgttttgttttgttttgttttgttttgtttgagacagagtcttgctctgtcacccaggctggagtatagtggcacaatcttggctcactgcaacctccacctcttgggttcaagcgattcttatgcctcagcctcctgagtagatgggattataagcatgtgccaccatgcccagctgatttttgtatttttagtagagacggcgtttcaccatattggccaggctggtctagaactgctggcctcaaatgatccactcgccttggcctcccaaa

SEQ ID NO: 929 - DNA, 1050 bp, Homo sapiens
tcagctttgcagcaacagcctcaccttcttggggaggcacatgatgtgagtcacacaattttcatgccagcccagagcgttgggtgccattacaaagccatgggtgtcttacatgaatgggagcctcgcggggggttgaagaggctgatctgatctgtggttcctcaattcagaggacatgagcttttgaaaataggcctttctaggtgaattggcctgcatgtcatagtttacacatactgagagctgatcatatatcaataattgttctaagttccattgtgggtgagtgctattgtgatgtgctattgtgtgtgtactattgggtaagtgctattgtgatgtttatcagatcctcatcataaccacatgaagcagtaaaggtattatctccaactggggcacagaaaaaaaaagttaacttgtccaagtcacatagctagtaagtggcaggcctagaattccaacccaggcattctatcatgattactagtggccacgaatcagatgattgtagtaacttgtcctggacttgggagatctgtatgctgactcatagagccctaacagtgtcttaattgatacgcccagtggtttcttctcagtcaccagtgaactttgtagaataggatgcagctggttaccctttcatagcatctttcacccttttttcccacctctttgagactctttttagtgtgctttgttgacttctcttcctctttcaacctcatatttgtggattcccccacaagtttctgtccctgcccttcctccttccctcaccatctaatctcacctgcatacccagtgtgctcatcaattcttataggttcaactggcagttctataaggatgactgaaatttatcagccaaccctgactcttttcccgaatgcaagacctgcatttccagcctcccattggacatttccctatggacagcctgccagcattccctatttcacctctccacattgccgcactaatttgcacagtagccagtacataataagcatgtgataaattggtaatagatgaaagaatgca

SEQ ID NO: 930 - DNA, 1032 bp, Homo sapiens
ttctgccattataaaaatttgtaagattctacctgtgacatgggcatctctgtattgcctttgggtgggtgctggagttgagggtacagagaggcattaaactcaccattgctttttacggaggccagtagtctttttttaaccaccatcagcagaaggaatgggaaacaaagctgagatgagacagaaaagcaagaattggggattgggtttcaccccacttctgagtagtaagatgaaattaaaacccttctaagatgtccctgaattccatttaccactctttccacaaaccttctctttttcaatccatgcccaaaggcataaaaggaaagaaaaaaaaaatcaaagcaattccagtaacacttgtggtagaaaatctgcctagattggtatgtgtgaatttcatattattctaaagtcccattattcttaataggcaattttagggggtggtttgaatgcctgatatttggagaactttcaaagcacatccaaggggtctctaataagaacttgggggcgctgaactcggggactccaagtgtcacctatgcatttccagcttcagcctaaccttgggggcaaagcaggcccttaacagaggaaaagtaaaaacaaccaaagcattcttagaggtgcaaggccgccctatcatgaaaacctcagtaaattgaagacagtaaaaaatcactcattcttttgattagcagtcttctgtattcttgcaaatactgtactagtgcagtcctatcatttcaaatgtgtgtttaaataggaataaaatatattacacacataattttccctcaaattacgtttgtgagatacaagcctgggtaattctgctcctgttccaagtgaaatgcaaacccttgtgtttccaaacatcactatgaagcaaagccaataccttcccttttctgagttggacacaagtaactcttccgtgctgctctggaaactatgacagaacgttattcatctgtttgttttaatagccaagggaaaaaaacttcaaaattttgattt

SEQ ID NO: 931 - DNA, 1061 bp, Homo sapiens
gtgaatgcctgggcccagcctgccaactgaaggcctaattacctctctctctcgccttccaggcatatgcctaaatcactggtgcaggcccctatgtgctaccaacctgcttattttatagttttcaagtaataaattggtagtgattcctgtttgttttctatggtttttaaatttttttcagtcaaggttataatttaaacttgtttaatttcccttgaattctaaggttctgtaagatttcttcccacctttgccatatttaaaaccagagccttttcttgttttaactcaaagtaatatcccagatgatgtttcactttattaaaagtacctctttaataagaaatcatgattactttgctttaagcttcagggaaagaaaggagtattttctccattatatttaattactaatcaaagtattgaatatcattgtaaaaataaaataggaatgtcagatgtgaactgtgataccaaattgtttgatttttaaaaggaaattaatcatgtgatctggactaagtggttggtttcaaaaatctcaagtatttaacttgatgtaactaatatgtgcatttcacttttaaacagttattccaaagtattaaaaatcttcaacattctaatttccagccgattttctctgtaatgcattggaggtgtccattaccctttaaaatgactagtaagaataatgtccattgttccaaagtgattttcttaaaatagtatgattcccaccagatattagtcttcattgaaagagaacttcggactcttaaggagaatgatgaaaaacaattatatatataatgttttagggtaattttgattagtaatataatttactagaagcactgaaggtagacaggcttgcattccaacccagactttgctactttgtagctttgacaagttatttttcctttctcggtcttaatttctctgtgtgtaaagtcaagataacaccaatgtgccttccgggttaaaatgaggaatacaaatgctcggacttcaaaaagaacctaggcagatattagttttctaatttttcattt

SEQ ID NO: 932 - DNA, 1079 bp, Homo sapiens
attgcttccacattttttgccaacagttatttagacagagctgaacatattaaacactggttgagttccccattgtcctgtctggcactctgtttccatccataatgtacactggtgtacattagatcactgaggggctcattattactgaattccagccacgacttcattcctaaaaaacacatgtgcctgcttggtattgcttgtaagctttaagctctacttttccctctctctgtgtgtgtatgtgtatgtgcatgcatctatgtgtgtgtgtgtgcatgtgtgttgttttcagataataggtacagcataaaatctttttagattataatttttgtttctattgcacattctcttatggtgggggaatttcaggttaaaaaggaaaataccaactctgtctaattaatgtcaaaatttaggtgaagtaggtgaggagaggttgaaaatttgtggtaagtagaagagtatgaataaagttaactgcaattaaaaccacttaacctgtagttacatttcccaaacccaagtggcagccttaaaactgaccactgaattatggaaactgaacggaaaaaggctttgtttcattgcatcgaagtatttttcttttcccattttgggtgcattgatctccctgtattccctggggttgctggaaaaacttggtcaaaaaggataattactttttttatttagttgcatgctcttcaaaaggcaacagcaagtattcattaatttccatctgatagagccgaacttttttttgtggttaaacaattgaaacaggaaatgacccaagatacagtttccatgacaccctgtcacttggatccagttttccagaagatgaaagaccaaagccggcttttgatagtgagtaactaattggactggctgatagtgggagttttttaatgtgaaaaataaaggagaaaaaactggaacagctgtgttttggtacagttgtctaatccccagataaaacactccaaggacattgaaattgaataatgcctttagttaaggggaaaaatctaaaatctgtcaaagcactggtttactttagagaaaat

SEQ ID NO: 933 - DNA, 1048 bp, Homo sapiens
ggggttgcaatgaaataaagtagtcactggaggcctcattgagaaaatgataattgagcaagaactcaaggggagacaaaggagtatgccatgtggattctctgggcagagcttggcccagtgggatgaagagcaaggaggctgatggggcaggaagacagtaagagcatcactagggctttaaaggccattgtaagggtaaggggaacctgtggggaatcttgagctgaggaatgacgtgattgactttagattaaaattgtgatcattatcaccatgagcttctcctcaggaggagggacctggacagtgtagcacctttacccgattactcttctttctcctattagcttaaccttttacacttgaaaagtatattccaccaccccagggtagctgccctgcctactctatgtcattgattgaacttggcagtcctgtggctgtaatggttgtattccttgggaaacaaaggaaatgattagatcttaagagggaaagaaagtagaatcctgtggtagcacagcttgtgatcctctttgaacatgacttgatctcttccaggcttcccttactgaaccaggaaacctttgtagaggatcctgggaggtgttggtttggtttagtgttttctaaatgtttgtatctccttacggtgagagggatccattatggagcagggggaagagcttaagtgtagtaatttgtcagctcatgacctgtgcttaacttctttcctctaagataatagcagcggacatactctcagcacacatggggatggaaaacatttctgtgctacttctccagtgaaaatcaatgacttttttttttttcactttaagttccgggatacatgtgcagaatgtacaggttcattacataggtatacatgtgccatggtggtttgctgcacctatcaacccatcatctagattttaagccctggctttcaacattcaagatggtcttccattatctcatttatgtcctattattctcaatcaagttaattggaaatctgtttttttagtgcatgtacaggaat

SEQ ID NO: 934 - DNA, 1044 bp, Homo sapiens
aagaaaagcattaccagtgactgcccattaactatcaatcagatcctctgagcagttctagttcaccagagttaaccagagttactaagctggtgtaattcctggctcaagccaaaaaacttgatgttttagttagtcttatgacgagcacattttgagtttttttcttttaaaaaataaaatattgcaaacagctctcggtcattaccacctgttgtaagctgatctaagccagttcggttatacacaactcctaggtgcttttttctggtgaattttgatagctgccagattatttgaggtgagaggttttgctactatcccacaaccttgccacctacttatagctagtgcaagtctgagacattctgctgcacatacagacgttgattaacagccgtatatcagccagtaggcacaaaatatttctgcaacattactctctatgcttgataaagtcccagctgtcttcttttagttgttctgctcaccactttgcatgaaagctgtacttgtagacattacaacattccagaggagagttctgttatctttaatagtcagcatcaagcaactggaagtcctccaactgtgccggactcatgtccacttaggggacaagcctatcaaggctacactcttattcatacaagggtagaggtatttctagaatattttggccaattctcataatttgaatatatgtttaagtttaccagggatggcccatttctcacatttatattgctagcaaagaagccattcgtctcacacacccacacaaatccacctctgacattcactttgctaattggcaaagggcctggtgttaatgaacatggatggtggaaatatttgcagtgtgtctttctggagtatgggcttcatgcttagaacacgacctgcctacccctagagtgcattcctgaatataatgccaaccacatttgagttgtagtttaaactaattaactcacatgcaatatctcattacctatactgaattattgttaagttaattaggcatcctaacattgcctttgg

SEQ ID NO: 935 - DNA, 1030 bp, Homo sapiens
agttctataatacagcacaagtctgttcattacatggaatgcttctctgctggcttcattccttaaacttgaaattaatgtattgtggatagaatgaaaagcattcttatttcctgcctgcccaaaaccctttaaaggaaacactctagagtctgtaagttggacagtttcagggagtccaattcattgtgtttggatgcagtcctcctctccagtgctgacaatgagcaaactgatttcacctgcctgtatttgcatagtgtttgtggattcttccaggtttcttgattattaattaggcttgaagagattgagaagggagaaatcccagcaaacatctaatttaagtcaagagtttaatctgaggatgaataactctgctttctgtacctttgcttttcattagttaatgatttagaatgaatgtggttgtgtgtgtgtgtgtgtgtgtgtgtgtgtgtgtgtctgtgtaggggtgggaggagaaggagaaccagaacaatgacaaaaaagactgtcttgaagaacttattctgggaaagtaaacaaggtcaacaagaccataaactctgaaagaaccaatatctacctacagatgtgtttagactgattctcagcttattaacttgcacattaccccctggtgtctctttgttgctcaaacatggagaagcgtttgctataccagcacaggctgtgtgtgtttatacactgacgggtttggttggtgatactgctctttgtggtgggaaaatcttccatgttacagtttaatgccagactcattccgttacctgaatactggaagcttctgtaggacgtattagaaggtatcactacaccgtatattaaaatatggcaagccactatatactgtgaattgaaagatgagaaagaatgagtccctgtgttctagaaactcacaggatagggataagggtggggaggactagatatgtaaacaaatgattgcaatgccttttgtaaagtgttagaatagcgtgaggcccccaatgcataaagatcagaa

SEQ ID NO: 936 - DNA, 1031 bp, Homo sapiens
gtgattctcctgcctcagcttcccaagtagctgagattacatgcatgtgccaccacacctggttaattttgtatttttagtagaggcagagtttcaccatgttggccagggtggtctcgtactcctgacctcaggtgatccacccacctcagcctcccaaagtgttgggattacaggcatgagccaccacagccagctctgggaatttggatttgtacagaaattcaatatagggagaccattactgacatttcaagaaattgacagtagaaatgtctccatttgaaacgtcccctagtaaaggacttttaaagcaatgtttagtaggccacctccctcagggccacctccatgagtcttacacatgctgacctcccctggcttcctctgggcctctggactcatctgtggtggtggggggcctaggaatctgccttttataacaagcaatccaagatgtgttttgtacccttaagtttgataaccaccacctttgcgtcagaaatccaatttatgcaactgttattgagcccctacattgtgctccccatcgtattcctcacgtaggtaataactaattaagtcctcaaagctgtgaccataaggttgatgttattgagatggtttacattccataaagtctcctatataaagtgtacaattcagtggtttttagtaagtttctagttatgcaatgatcacatgatctaattttagaacatttttcatcattccataaagaaatgttgtattcctcccttagtagtccctccccaaacatagatttattatacccatttttggagataggaaaatggagtctccaggcatttaaacaatatgccttcaactctagagtaaatgtggagccagcagccagagtccaacttccttgcttccagaacccatgctctttccactacacaatgcttcccatccaggaactcaagccaaattaaatatttacttggtggggagaataatttgatgttctggttttgtccttgttcagtagtttgggataataaatt

SEQ ID NO: 937 - DNA, 1029 bp, Homo sapiens
atgcctgtagtcccagctattcaggaggctgaggtgggacgattggttgagccaaggaggttgaggctacagtgaactgtgatgatgccgctgcactccagtctggggaacagagcaagacactgtctccaaaaaaaaaaaaaaaaagtttctattttgccttttttcttaaaagatatttttgctttagatagaattctgaattgacagtttgttttttgaacactttaaaaatgttccactgtctgctggactctgtagtttctgatgataaatcagtgaaagtttttgttaccctgtatgcaatgttttttgtttattcatttaattattctggctgcgctcaagatttttctctgcttccgttttcagcaatttgactatgattatgcctccctagacataatggtttaaatattgattctgcttggtgtttgttgagcttttggaatctgtaaatttgtgtctttcatcaaatttggggactttgggaccatgattttttcaaatatattttctgtctcattatttgctctccttgtaggtctctgattacaggtatgctagatcttttgatattttactacaaatccctgagacagtgtctttttcttctctttttaaattttttttctcttggataaagataaagatggtttattcttatgctgcagaatttcctttttttttttttttttttgagacagagtcttgctctgccaccaggctggagtgcagtggcatgatctcagctcactgcaacctccgcctcccaggttcaagcaatttccctgcctcagcctcccaagtagctgggattacaggcatgtgccaccacacctggctaatttttttttttttttttttgtattttagtagagatggggtttcaccatgttgaccaagatggtgtcgatctcctgaccttgtgatctgcctgccttggcctcccaaagtgctgggattacaggagtgagccactgtgcctggccctatttgtttctttttaataattctgtttctgtactg

SEQ ID NO: 938 - DNA, 1026 bp, Homo sapiens
agatctggcttcattgttagaagtagtgttactttttcttagtgaatactcaggccattcttccaggttatggactttagcttttgctctgaatgagttagaaggccattgggagactttacacaggggaatctggggagtggcctctctagtatatggccataacctggaagaatggtctcctacctgttaagtggaaggaataagtacaactagaagtcatttgacaaatatttattaaatgccttctgcatagtaagtactcttttgttctaggtcaggagctgtaaacacacacacacacacacacacacgcacacacacgcacacagcttataatctggaggccaggggccaggagacatagaaacaagtgatatgttagaagatgatgaatgctatcaaggaaaagtaaagcagagatgagacatagggaatacggttggctgtcggggggaggagcagatgacttactatttcatctaagggtttgtgggtgagatctgagtaagtgggattgtagactatgggtttatctgggggcagcatatctggggcaaagaccttgaattgagtgactgtttggtgtgcttggaaactgcaagaaggccactgtaactgtggtggtgtgaaagagctgggagtagattaggccagagaggcagtcgggggccaggtcaccaagagccttattttactggccattataaggactttagcttttgctctgaatgagatagaaagccatcatgtggtggggtagttacatagagaagtgacatgatttgacttcggttaaaaggtttactgagccaagactagactggacaaggcaaaggtagaagtaggggaagacaacttagaaagttactccaaaatccaggcagcagatgatgatagcattaatagtgcagtgacagtggaggtgatgagaagcagttgaattctgaatatgttttgaaggtagaatcagtaggatttgctggtccattggatggtgggcagggtaggggaccaggtatgtga

SEQ ID NO: 939 - DNA, 1104 bp, Homo sapiens
ctttactgctgaggtgacactgagatgaagaggaagctggaaagggagctgagaagggcagtcaggcaggtagaaagaggaccaagaggactgtctccctgaagccaagtgaagaaagtgttgcaagaaagagggagagatcaactttgtcacctagtccctgtatgctgagggtccagaaaaccagccatatgatttagcaatgtagaggctatgggtgagcttgtcaagggttgtttggtagaatagtagcataggctgatcctagagggttcaagctctggagaacggaggagaggagtcagaggaaataaggacttgaactcctgagatttgctcaaaggaaagttagaaggccagatgagatcaagaagatattttttaattgagagaaattatactcagtttatgtgccaaagggaataatccagtagagattgacacaagagcaaggggagaagattgctagagctttttccctgattaggtaagagatactgcatcaccagtagaggacctagaagcacagagcattcattcatagcaagaagaggaaaggaagagtacatggatggagatgctcatatgatgatgggtatgaacgtggggacactcccttcttagtgattctgttttttcagagaattagaaagcaagatcatcagctgagagtgaggaccagggaataagcattaaagacctgttagtggtactaagattacctcctgttactgaggtttagactgaaactcagtgcacaaataatcccaacaaaatgctgatgtatttcagtgtttatttgtgaaggaagagagttcagatagtttgaaaattcagagggtggggaagaagagtgtggagagggcagaggtaagtagaatataaagaccagatcttgaatttttatatttctgtgagcatgtctcaagtataacctactacataacaagagttgttctcagcacagttgacacagctagatttacaagcagattttggcaatattcaggtatttaagaactgacttgcttgcatttgaagttttgcaacattctactaggcagtggctacatcccaaagtccacatacttgagcagttatttg

SEQ ID NO: 940 - DNA, 1030 bp, Homo sapiens
catgccactggtttataagagcccgaggacagttttacttatgtctcagcactcctctgggcacacagattgctttcaagtttttctccatacagaaggattcatattgtttaaatggagcctgcttgccatcccacttgcttttccataaaatcagcatcctcttaggtcccgctctccagtgttggctggcaaacagcaggatctttaagggctttttcagtcatgtccccttggggcatgacaagaatctgtgctgtcctccagcattctcttgccctgacctctggcatggtctggggagctcagagaaggcttcaccaaagaagcaagaagcaacatttgcactgagccttgagggggtgattaaagaaaaggtaggggcaaagaatattagaggccaaaggaccagtgtttacaaagtcatggagttgtgtaagtgcctgtaagatgctcaggaagggtcaaggccaaatcatgaagaggcgccgagtgctaggtaacttatgaaatccacctactctgccaaagacttggccatcccacatggcttctctccttctcagagtccatatcgctcattgttgcaaagaacagcagatgtatcccagtctataagcatcactgccacagttccacaaaaatataacagatgtgggtagtgtttttcctgccattgtaaaatctttttttttttttaagatagctgtttaattttccagaaatctgtattttcctcctagaatcaagtccttttttaaatacataaatagtgtatttaagcctttttgacttagctttttccacacctatcctggaaaaaaaaagtcctcaaaccttgtattccctgtatctacactaaaaaatgcaaaaatagatactcctcagagcaaccaacgtcaccatttacactacagccaggtcttcaaactccctttggcaaataagagcagctaaagctctgttttataaattggagactgttaatttgggctttgaatgacattattcccaccaactaaatagaaac

SEQ ID NO: 941 - DNA, 1260 bp, Homo sapiens
agtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattg

SEQ ID NO: 942 - DNA, 1050 bp, Homo sapiens
ttagtgtatgctgtgcaaaaattatctattaaattttcttttctaatgcaattaaacagaattgaattatgggttctacttctttttcatgtgttttgttatcctattctcaatgtaacaagaacactgaaagctgctagggaaatgtacttctagatttctgggacaccactgtctccttaagtttctagttttggaagaaattcttgaaaagtgtttgagaaatgcagttctctgctatgaaaacacattcaagaagaggaggaatactttgtggttagcatcaaaatgctgtgttaacagccattccaaagaaatctcatgtaatctatagcccatttcccagttaatgactgggttatgcttagaaattcttttttgaacttgtgacatgttttcacatagaaagaatatagtagatggtatttagttttcaggttagcattttagcctctatttaagttatgattgtttattaagtgtaagattacactaagtagtacgacaacatctaacaaagctccagctttgtgcaggagcagaaactctcccagcttcaaatcatcagtaggtactcctgcatcttatggcaaaagctcaggaagaagggaatttaaggaaattgctccttgaattaacaagactcagatcagggaagcattaaatgaagtcaactctgatcaaaggctgttactgcaaaaggggttcctattactaactacctgagttttgtctcttgattcttctatttgcacttattcttctttccttatggacaaaaagtttttgtttttcatttttagatacgggatgttgctatgttgcccaggctggagtgcagtggctattcacacattcacaggcataatcatagtgcactgcactgtggcctcaagctcctggcctcagatcctgtgctaccaagcccagccttgatttttttaaaatctttactttattttgtaaatttatttttaatttttaatttaatttttttaaaaaaagctttatgcttaactttcctcgctcagctaaaacaggcaaaccaag

SEQ ID NO: 943 - DNA, 1459 bp, Homo sapiens
gaatggggaaaagtaactcaagaccaatgatgctcttgtcctacctaacaaaacttaaaaacaagaccagaacggatcaaagtgcttcctcataacttaaccacatcctggaacaaaactcaagaatatttgtatgcatccaaaacatctgacacccaacaaagtgaaatttatgatgtcagacatccaataaaaaagtagcagacatgatgaagaagcaggaaaacctaatgtataacgaggacaaaaatcaatcacaactggcctagaattgacacagatgaattaataaaaatggacattaaaccagtttttataatagtgttccatatatatagtaagttatagtaaagattgaacatggtaaatagagacttggaagatataaaatatccaaatcaaacatctggagatgaaaattacaacatctgacatgaaatacactggataggattaatggcagaatagacactgtggaagaaaaaattagtgaacttgaaaacaatgatgtaagtgatccaaaatgaaacacagagagaaaaaagactgtaaaacatgaacagagtatcagtgaactgtgggacagcttcaagagcaattagagtccctgggggtaggaatagttaaaaaaaaattaaagaattagtagctgaaaagttttaaaattttgatgaaaattctaatcccagaaatccacagagctcaaccaacttcaagtacaaaagcatgaggaaaactacagtgtacgttgtaatcaaattgcttacagttagtgatagaatgtcttaaaagcagccagaaaaaaagtatacatcattaatacatttagcgggacaaagattaagatgaccatagatcttggaaacaacacaattgaaaagactgtagggtaacatcttttcattctttaccaaaataaacaaaaacacaacaggtccacatagaattcttaacctattgaaaatatctttcaaaaacagtgatgaaatagagatgtttttcagtcatacaaaagttaaaagaatcatcaccattagacttgcactataagaaatacttaaggaagtcctacaagcaggaagaaaattatagatggaaatctggacctacccaacaaaatgatgaatacgtgatatggtcattacgtgggtaaagacttttttcttaatattgaaatcttttaaaagtataattgactgttaaaagcaaaaataatgacattacattgtgagatttgtaacacatgtagaaataaaatgtgtaacagcaataatacaaaggctgggagaggagaaatgggattgcactgtttgaagtctcttatacagtacatgaagtggtgtgataccgtttgacaattgactgtgataagttaaagatgtatactgtaaaccttaaatcacctgttaaaatcacacaacacagaaatcattaattgtattaaatgattttgccttgg

SEQ ID NO: 944 - DNA, 1064 bp, Homo sapiens
ctccgtctcaaaaaaaaaaaaaaaagaagattttgaattgtaaggcaacccacattgttaaacttcgttttattttatttttatttgaagtttttatttgtaaaaatatagaaacagggtttcaatatgtcacccaggctgatcttgacctcctgagctcaagtgatcctcctgcctcagcctcccaaagtgtcacgattacaggtgtgaggcactttgcctggccaattaaactttaaatcaacattataagaaggctcttctgtagtatcaaagtatccatattgtgtcaacaagttattaataacttcagattcccttgtcatccttctatttgtatgatatgatgagactcattgtgctaaattgtcagtcctcttaaagccagttggtatttacctgagacgttctatgaggattttatgccatatgtataattgagaactgcagtagagagtataaaatagatatataatataaatcaaattatgtttatcataaaatagatcttgtcagatgaatgaggatttctagaagaaagcctttgaaattgtgtctttgtacttatgctgttctaatgtttcttatttctatattcattgcagatgcacagtaatcaaaagggcttacttccagagccaaatccagtacaaattatgaaaagtttaaacaaccctgccatgttgcaagttcttctacagccccagttatgtggacgagctgttaaaccaggtatggaccatgtatgtatactgattaattaaagaatgctagcatgaagttaattttttcacatgtgaaatatggaaaaatacattgatttgtgaaaaatatatttaaattagtataaaatatttaatttttctaggacctgttaatgaattttaacaataatctgaggtgatatattttgactatttttgacatatacaacctgcttatgtggtattttttactattaataaatgctaaatatcaaaccttctgtttagctcttagttgacatgaatttatagaccaaggtaaaggttaacacactacattgttataacctatattaacaa

SEQ ID NO: 945 - DNA, 1050 bp, Homo sapiens
ttagcattatgaggaaatgaatgcctatacagtggtctccccttatctatgttcttgtgttccacagtttagttacctgcagtctgaaaatattaagtggaaaattccaaaaataaactacttataggttttaaactgcatgctatcctgagtagtgtgatgaaatgttttgccattctgcttctcctgccttggctatgaattacccctctgtccagtgtacctactctgtatacattacccacccattaatcacttagtagccttcttggttatcacatcacctgtcatggtattgtagtgcttatgttcgagtaacccttattttccttaataatggccccaaagcgcaagagtagtgatgctggcagtttggatatgccaaagagaagctgcaaagtgcatcctttcagtgaaaaggttaaaacatttccaacttaatagggaaaaacaaactgtgtgctgaaattgctaagatctacagtaagaatgtattttctatccatgaaattatgaagaaggaaaatgaagtttgaacatagcgtatataaattttggtactatttatggtttcaggcatccactggggttcttggaacatatcgctcgctgataagggggaactaatgtattcaacatttaagtttacagcaaatatgtatagagcaaatatattaaatacatttattatgtttcagtcccaactggtctaacaccagctcacctactgcaattcaattctagcactaactacctggagttagcacagaccccacaagttaagagctcaatcttccatatggctgcccccactttagacctagacacaagttcgggggattctccaggccatgtgcacttctgaccaactaactacaaatttgggagttcccacagtgccctcaggttcaatagttcaatagaatgactcacagaacttaggaaagcactatgcttatgaatacagttttattataaagagcacaggcaagggaagatacacttagggaaaagtcttggagggtcttgaatgcagagcttctgtgtcct

SEQ ID NO: 946 - DNA, 1001 bp, Homo sapiens
attatttcatgactgcatggccccctcttgtgtattattaaaataattaattagctttgtctgataagttggagagtgaaatatgtttagaagcagttacttttactcagatcgactggagaattgaacttcaaaatgaattgggttatacaacatgtagcttttcaaaattaaactgacaacgttttgtcattttcacagagctcagttatgggtaatacttctaatttattccttcagaatctttctcatataccactggcacaacaacaattaatgaagtttgagaatattcatactaataatgtaagtatggtatcattttttcttttaaaatcagttcatttcttttctagaatcaggctgtggatcaggttgtttatgaattttcacgtgtgtagctttttttaggttatatcttatggccatgggtcttacctttttttcttcttttgtagaaacccggcttacttggagagcccccagctgtggtacttcagactgcactagggatagggtcagtgcttccattgaaaaaggagttgggacatcatcatggagaagcacataaaagtaaatgatgtgtatttactgagaagtcagtaaacagtcaggtttgagatttaaagatagtttacctatgttctaattttatttacagggaggtcaaatttgagttttatttagtcatttaaaattttgagaaccctcttggcttttcgattttcaatattggtaagttactgatggacttgcttccatgccaagataagacttcccctattggatatgctttaatattttatgcaggttcacagcagtacaaggtaaagacacagatccatttgagactgacatgctgcccactgggctgacagcacatatggatccatgtaattattgctgggataagaaaccattcacttttattttttaaaatctagtatttataaatttaaagtttgattatttatttgtattatttaaaaaaatttaacctc

SEQ ID NO: 947 - DNA, 1101 bp, Homo sapiens
aaatatatatttggtagctaattaaagtattttaatatttaaaggcagaaccaattttatccggaaaatatcaaaaccagctattaaactctggtctgttcaaactaatctggtctctcttttaattctggaagattttaccgaatcattttattggctaaaataccactgatatttataaatgttgtaataagtaggtagactaaagtacatctaatttttattatatttgtaccctaaaatacactgtggtttgtaagtggtataaaacttaggcttaagcagtttgtaaggaaaaaaaatctatgtagtttcttgtattcaagtgtcaaaataataatactgaatttgtaagaggttttagtgttacctagccatagcaagaggtatgactagaatgccctgcaattgtatattgagaaagctaatgcagtcctttttttttttttttttttttttgagaccaagtcttgctctgttgcccaggctggaatgcagcgacacaacctcggctcactgcaacctctgcctcctgggttcaagtggctcccctgcctcagccttccaagtagctgggattacatgcacacaccgccatacctggctgatttttgtatttttagtagagatggggtttcaccatgttggccagactggtctcgaactcctgagctcaggtgatcttcccgcctcggcttcccaatgtgctggtattacaggtgtgagccactgcacctggccgtcaattctttatagaatgaattttaaaaatttatctgcagtgttcattgcttgggttattgagggaaattacacaaataaaacttgtatatgaatacttcatgtctctttgcaatctttaattcactgaaagcctcagagtctttagaagaactgtggattttaggtgattcacataatgggcaaatgagtctatctacaagaggacagccaaaatgggggcaggttctggaaaataagtcctgtgaagaagaattcaggagaaatggatatatggaacctggaaagggacaaccaaacatatacattgttaaagctatttaaagagtagtcatacagtattgtgtgtacctccagtgg

SEQ ID NO: 948 - DNA, 1063 bp, Homo sapiens
tttgagaattttattcagggagacagggatgataaccagtttctgtttattgtggtaaaatatacataacatacaatttaccattttaaccattttaagtgatgtggcattaagtacattcacattgttgtgcagcatcattactctccatctccaaaactttttcatcatctcatactgaaacctgtacctgttaaataataactctccattttcttctcccactagcccaggtaaccaccgtttctacttttgtctttatgaatttgactattctaggtacctaggtgacacaatatttgtccttctgtgtgtagcttagttcacttagcataatgttttctagattcatccatgttgtagcatgtatccaaatttccttcttttctaaggccgaataatattccattgtacgtatataccatgttttaattcagccatccatggacatgtgggttgtttctaccttttgtttattgtaaataatgctgctgtgaacattggtatctgagtccctgctttcaattctttggggtatgtacccagaaatggaattgctggatcataccataatgcatgtttaatttttgttggaactgtcatccttttttccacagcagctgcaccattttacattcctgctagcagtgcacagggattctaattttccaacatccttgccaacgcttgttttctgttttagctgtctgtaacaaaaataccatagactgggtggtttaaacaacaaacatttatttctcacagtttgagaggctgggaattctaagagaaggtgcaaggtgccagcaaatccagtgtgtgatgaggatactgttcctgctttacagatgaccatctttccattccattttcacatggtaaaaggctggagcaagacctttcatgtctcttcttataagagcactaatcccactcttgagggctctactttaatgacctcattacctcccaaaggccccaccttctaagaccatcatattgaggcttagcatttcaacatatgaattctggggagacttaaacattcagttcgtagtgatag

SEQ ID NO: 949 - DNA, 1050 bp, Homo sapiens
aaagtatgataacaaatgaaaaatttactacagcacagcagtagatttgtgcaggcagaagaatcaacaaacttagaatgtaggtcaattgaaattatccagtctgagaaactgaaagaaaagagaatgaagaaaaatgaaccatagcaatgtaggcaaggatgtggagaaatgggaatcctcatacagtgctgggggttggtgggatgtaaaagggtgcagctgctttggaagagtgtggcagttcatcaaatgttaaacatagaattaccagatggccccaggatttgactcctaggtgtatccaagagaattgaaaacttgtgtctgtacacaaatgtgtacatgcattggcacagcagcattattcataatagccaaaaaggaaaacaacccaaatgtccatctagtgatgaatgaataaacaaaatgtggtaatatccacgtgatggaatattattcactagaaaggaatggagtactgatccatgctacaacattggtgaaccttgtgaacattatgctaaatgaaataagccagacaaaaagtccacatatgatattccatttatatgaaatatccagaataggcaaatccatagagaatgtaagtagatagtggttattgggggctggaggaaggaggagttggggagtatgattaacaggatttttttggggaggggagagtgataaaaatactctagaattcaattgtggtgatagttgttcgtaagttggtgaaccttgtgaatcaacaaattttggactctttagaaattaagcttcaactgtactaaacagagaatagcattttcatttagtgttttagagatcctaaaagtagttagttatgagcaaacagatcagatcagtttttcaagatctaggtctaattagaaatcagttttaaatggactaccccttccatttctctagtcagttgtaataattaattagaattgccattgagctgtgaattttctcaaaaactgcatgtcttgaatatttgaactatgattgggaaaacttaaatcagaaataaattat

SEQ ID NO: 950 - DNA, 1028 bp, Homo sapiens
cagaagaagagggagcaaagtggagaataggagatgatgtcacagtggggtcggggaggcagagggcacagacaatttaggaccttttaggcccttgtaaggactttggcttttactctaagatagaaagccactgggatgctttgagtagagggataattgactgtatttatagtttaacatgcctagctgctgtgttaaataatgaatgtagaacatagcagggtcagttagggagctgctgtggtacaatccaagtaaaaatgctgacttggacaagcctggaagcaacagaggcagtgacatgtggctggactggagacatttttggaagctggagtcagtggggtatacgagggtaagagaggagccaagtccccaagagttttggcctagaaaaatgaatttgttattgattgagatgggtaagactgtgtgggtggagcaagttttatgggtacgttttagacataagatccctaagtgaagatgttcctttattggtgttcattatacaagtctggaggtgaggggagagttatgggcctctagaggtacatatttgagaaccatcgcattcctgtaaatcgctataattgtgaattgcatgaaattggatgagatcaccaaggaagtgagggtaagtaaagacaccaggggttagtcactgtgcgtcttaagatttctctttcgattttgttttcttggtgaaatagaaagcaaagcatcagctgagagtgaagatgagggtgtactgttggagcttcgagaaaagagaaggcttgcaatagtcacttaggggagtggagatcagtgggcagggtagggtggggatatagtaggattgcccaggggcatgagggtgaggggcctccgttgaagttatgcccattctgataaggaagtattagacttggattgtagttccaaagtacagaatggaaccactgggtgcaaactattcatagagtggtttcagccaaccctaaaaaagaccctgctaaagatgaagtcctctaaaatgacta

SEQ ID NO: 951 - DNA, 1050 bp, Homo sapiens
gcttaaccgcgcctggggaggaggccgaggctccaggggcggccggtgggaggtgcccacggctcctctccaccgctcctcctgtcgcgaggaatagcccgagccacccggccgagggaacgagaactaggcagggaaaacccggagcttccgtctcacgctgccctccttaaggcagagccgtccccgtaccccttagccctggccccctcccccgagtccctagagagccgcgcgccccctcccgcgggagcccagaggcggagcgccgcccacctgtggcagtcgggcggggccgcgcgccggggaacctgtggcgccggggggctcgcagcctcgcgcctctccagcccctccacgcagcctcgggcctcggggcagagccctgggtggctttgaaaggcctgtctgttcgttgtcgccttctaaggtaaactctccccagcaactcccccccctcccgaagccgccgggcctggccgtcaggagactcggaggagactcgttctgataaattacattttgtaatgcagctttcctggaaatggcttcttgagctgcctcccttggcatgagatgcctcctttggctggcgtggtgaacttggggatatatagatcgcctgatttcttagtctgacggggttgagtgcgtccctttccccctctcctcccactccacgttcacaccagttccgaaagaattggcgttaaaaggcgagaggtagcggttgtgctgctgcgaggctcttaacccttctgggatggagatgctggtaattagcaactcctttatgaaaagttgttcttcccagcaggggtcctttactgtcgatgtacttctcaaggatgtccgggctggttattgcccatcatggactaattatccggagatctgcatttcagaagcacagactggcttgaaaaggaaggtggaggacagtaccagaaaacaaaaggaaagcttaaaagcaaggaattaagaagtatctccagaattgtattccttatctcttaagcagattgaaaaagcggacttttacaggaaact

SEQ ID NO: 952 - DNA, 1036 bp, Homo sapiens
gggagagcggcctgagggggaaggctggctctcatcctaatggttttgtgtttaggttgggcttcttcatggtaggggcatggagtcagtgaaggaagacagtgagaagagatgagcccattccataattctctgtacctgactaggagacttgtttccttctatgagcccattccataattctctgtaccttacttggtgacttgtttccttctggaatgaagggcttcacactgtccatcctgggactggactcatagccctttccatgtttaaagagagtgtgatgggaagtagcttatttctgcactttcttaggggctttgaaaattttccatttgctcttttcccttgttctctctttctctctctctctcttttttttttttaactttcctgtgttctaaattttagttttcattctctttcaaatgccttcatttcctccccagtgatcctccctggagtgagaaatgactatgaaatgtttagattttcttttttctgttgggaatcaagcagctttttgcatgagccaattaaaaaaaaaactttatcaaagaaagaagaaaaataaaggacagcaatttgttttgaaagtggcttgtttctagtgaactttcgggttatcggattatttttccctctcagaaggtctgagaatcttataggcttactgcctggtaaataaaacattcctttccacggtatttatttttctgtctgttacctgctgtttgcttttagctgatttcctggtgggaaacacaaccacccttctgtatgtaccctttataatggaaggtttgaaggagacgatgaagcacaacaaaaacccaggaaatagaaccgtgtaggaatttgaattggaaagtagctccggccatctgctccagcctggatttgggcacactcttgtctacatggctttcctcctcctgcagcctggtgaaaagctgctctttcaggaaagggccattctgatgtcattgcttcttggaagtcttccctcacctgctctggcagaattcatctc

SEQ ID NO: 953 - DNA, 1030 bp, Homo sapiens
accactatctaatttcagaacattttcatttctccagaaagaaaccctatacccattagcagtcactccccatttcccccttgccccagccctaggcagttactactctagttctgtttgtatggatttgcctattctggatagttgtatgttaatatatgtgactttttgtgtctggctgcttagcatgttttcaaggtttatctatattgtagtgtgtatcagtactttattcatttttattgccaaataatttattgaatgggtataccacattttgtttacccattcattccttaatggacacttgggctgtttcctgctatgggacatttgtatgtaagtttttgtatggatgtaaatgttcatttctcttgggtatatacctaaggatagcaatacaggttcatttggtaactcgacgtttaatagtttgtggaagtgcctgttatccaaagcagctgcatcattttaccttcccactagcaatgaatgaaggttcgtttcttctcatcgtcaacttttaccttctgataaaagaaaaacttcagccaagtttaattgagcaatgaatgattcacgaatcgggcagccctcagaatcacagcaaattcacagagactccagtacagccacatggtggaagaagatttatagacaaaaaaagagaaatgactacagaaatcggaagtgagatacagaatggctggattggttacagctcggcatttgccttatttgaacacagtttgaacactcagcagtgtatgagtggttgaagtatggccactggtattggccaagactcagctattgttatagtcacatactcctaaattaggtttttagtcttatctacctaagccaggttgcagtttgtccacaagtgtaacctcccgatgggctcaccttgcctgctgcctagacagagcggatttatcaagacaggaattgcaatggagaaagagtaatccacgtagagctggctgtacgggagactggcgttttattattactcaaatcaatctcc

SEQ ID NO: 954 - DNA, 1057 bp, Homo sapiens
atcagttttggccaggcgtggtggctcacgcctgtaatcccagcactttgggaggcggaggcgggcggatcacgaggtcaggagattgagaccacggtgaaaccccgtctactaaaaatacaaaaaaagaaaattacccaggtgcggtggcgggcgcctgtagtcccagctactcgggaggctgaggcaggagaatggcgtgaacccgggagacggagcttgcagtgagccgagatcgcgccactgcaccccagtctgggtgacagagcgagactccgtctcacacacacacacacacacacaaaaaaaatcagttttaaggtattagaggatgtcgttctttcttgtcttctgttaaatggtgctttgaatgtcatgtttcaaacactgctggagctcagatcccagaaaatgaaaaatgtgtgcacttagcttatgcgtagaggagcctagccaaaccaaacagcacgtttgaaactttgcttttcctttatggctgagattgtgaaagacagccacagatggtggctgagctctagctggaactgctgttagtcggcgcgagatgttctaagtgacgggagccaggaactcactgtggtgtttctagaagttaaattatgatgataggatcttcctgtaatactggttctgttccttgcctttagttatatcttggaaatctgtcacatggttagtgactagtgaaaggccaaaaaaatttgcagaatcagctatttaaagctttgttcttgatagttcaagtgttacgcaaggcaaagcagccctctgttaagggtttcaggctaggtgtctccttgttagggtgtcattcctgttgtaattattggtttgtcttgtcttcttcctttttttttttttttttttttgagacaaggtcttgctttgccatccaggctggagtgcagtggcacgatcatggcttactgctgcctccacctgtcactcaagagatcttccaacctcagcctcccgagtagctcggactacaggcacatgccaccatgcttggctaatttttttttttttttttttg

SEQ ID NO: 955 - DNA, 1032 bp, Homo sapiens
acatatgtctatagaaaaaagccaacagtatcttctgaatcacatcttttaggaaatgccaagggtaattttttttcttctgttgcccttgtgagtctagggtatctttcaagaataaagtgtataatagatttgtttagaaggttactgaagaattctgctttcataattaaaaaaacagctttttcttcctgtgtgtatgtgtttatgtgtaggagggcagtagtttatcttagtcatttatctttaaatatttagccgtgaaaaatcatagccacataacccttctatctcaggttgttactaaggcagtgatgtatattctggtatcttgaatggaaagtttaaagcaattgtggtgatttctaaagaatgaagaatagttgtaaaatttgtggagctctactagggtgctgtggccatctatgcctgccaaatgtggattgcacaattaaaatgtttggttcctcactgggattgttcttcttgacataaccatgatttgcccctctcattgtagctctgttcattcagtaagcattattatatctaatgggtcctgaatatttctaaagtgaataaagtgcaagtatgactaactttgcactaggctggtgacagtgaagaagaatgtgtggaaaagaaggattagaggtagactaagcttgtcagggagctcctgacataggagggttcagagacatatattcagccacacatggtacaggtgaggtgttccaagaggtaagtggaatgatttttgcaagtaaggagtggcatttttggtcaaaatgattgcatgaaaaaagatgggtgtgtgtttagattagtcttagcgctacatttttggaaactctatccatgccccaagacaatgtaaatatgcctgacagttttttttttttcatcatccaaaattctgatttgaggagacagttgggtgtggtagcttatgcttgtaatcccagcagtttgggagacagaggcaggaggatcacttgagcccaggagtttgagaccagcctgggcaac

SEQ ID NO: 956 - DNA, 1028 bp, Homo sapiens
atttatggaggtagatattcttggttaaagctcatttttaaaaaataatttcaacttttagattcagaggatacatgtgcaggtttgtgacatggatttattatgtggtgctaaggtttgggatgcaaatgatcccatcacccagatagtgtaaagctccttttagaatggtatatgcagatttaattctgtcactgaaaatgtttcaagaactaattggaactgggcaatagcttgcatttcacttgttttgttctttgcatttaggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatgtaagaatatacaaagtgctttcacaacctgacaagaaaaagacaaacaatttccattgaaaagtggagaaaaggatatgagtagaccattcaaaaaagaacaaatctacatgaccaaaaaacattttttaaatgttcaaatgtagttgtcagggaagggacatttaagtatttaaataggatatcactttggatctattggactggcaaaatcaaaatataaaaatttttaattttatatttattactgataaatatatgtatacaatgtatataattatatttattttatttaaaaaataaaactaaaagtctattgctggtgggatctggggaaaataatactccctttttttgttagctgaagtattactagcctctttttaaagcaacataacaatgtacattcagaattttaagtaaataatttaattcaggctacttttaagagaatagctgtggaaatggaagcattagcaggttaggtcatgtataggttgatgcttgtttcaatgttgctgtagtgggcaaaaaacaaaaccaaaaaaatctcaaaaaagcaaatgaatgtccatctgtagtggaatg

SEQ ID NO: 957 - DNA, 1636 bp, Homo sapiens
gtcttaaaataaataaataaataaaataaaacctgtattaatcagaactagcagttaaggtatattttttgttttacattgagaaagaagcaacacataggaaaagctaaaataaaggatttaacaaatccaacaccagcttaccttttgagtaatataatttaggtgaggacacagtcacttcagttttttttcccttctgtatgttcctacagtgtatgtcattatttgatctagtaaaataacctgaataagagaaatttcatagaagctccagaatagaattggaaagctggcagagatggtactgaaccgtattctcctagattagtatttttcctaagtaagccaagttgtttttttgagattttgttttccgcattaagaactcaggctttattttagaagacaaggtagttttagggatatttagagaaccaagatgacaaggtttgttgttaggagaggttgcatgcaattttaggctgaattgaaagtaccatttatcaacagcactggaacatgtttgaaaagatctgaactgttaataaagatttaatgtcagctcccaggaaataaggttaacatactgttaagtgtgctatttctttttctactactcttaaaattaccactgtcaccaaggcctaattcatcatgtggtaggagttaaagatgaatacatggttttgcacagaaaagtttttaacctatgaaatggcccaactgttgtctatattaattggtttatttggtatttgtagggtattgatgacgtcactggtgaaccgttagtccagcaggaggatgataaacccgaagcagttgctgccaggctaagacagtacaaagacgtggcaaagccagtcattgaattatacaagtgagtgtgcttcaatattttcatgacaaaggacagactggaaaggtgtggagcctgctgggaggaacacggggctgaggcagagtagtgtttctttaagacagataaacactagcgatccaaaaccttcccagaagtcagatgaaatgctggagctgtacatgaaagataaggttcaatacttttatcctgaaactgttagaacataaggacccaaacctgatcatctctgtctgctttggatgtaaaacaacattgagatttattttcattttcttaaaaatttaagtgactgagatagtggtcccacatatgttgatactcccacatataaatatatggtttggatagaagattagaagacacttggtgtgtcccttcttgaagtgtctgtaaggagtttaacaaaaaaaggctaaaaccgtaaaccagagattaaaaattcaaatggctgcaggggctagggcaggtattggaaatgagtctcaaacatggtgggggatgtgtcaagctagacagttgagtgacaggtcttgggctgttccggccagttatcattctagggcacgcaggccaatgattcccatttttcaggaatagcagaaatctggttttctgtgtgtatgtgtgtgagggggaatctcagttttcatattggcaacatatttaaattttttaaataacatgcaagtcaaacaaaactttatgctgagtgcattcaaaacagcagtttatactctgttacaatcactt

SEQ ID NO: 958 - DNA, 1039 bp, Homo sapiens
cctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaattcatttgtttgtatagctttttatacttgataatataaagtttcacaaatactttcattgatgcgtctctgcaaccactacattaccaacaatgttgtctccaatttgcagaaaagcaagatcttgaaccaagaattattatccccagtcctgttttcttttctgctacaccatattgccttattcgtatacccttaaattccttatttgtccagcactttattgtttacaattttaatgtacattctttgtttttttccccctaaccactagacaaccagggatttttctttttcttgaaatagataatgtgagcagattctctccctgttttacacattaggaaactggatcagattatatgactcttaaggttgtagcat

SEQ ID NO: 959 - DNA, 1095 bp, Homo sapiens
attctcatccatttcatctttgcatcccccacgaggctaagtgcagggcttggtactgtgtagatactgcttatgaatgtgtcttgtcttgtcctttttgtctgtttccatcatctgaggatccttcctctggggggttgacatgccttatttctaaaatggccgaccggatgcagggcagagccagattgcaccaggaccctgccatcgatatagtccccctcacccacccccggtgttttgaggattaaataaattaatgaattaaacgagttagtagttataaagtgttagcacctattaagcattataaaaataaatttgaaaatgaccagcaataattatctttcaaatatttatttattgcattggaaacaagcttttctattggtggttgttagggagactctgcagcttgtcattgtcatcttgccggcttttaagtatgtgttcctactttttaaaagtcagtgcaccaacaaaattctttccatactgtcatcaagaactattgctgaggccgggcgcagtggctcacccctgtaatcccagcactttgggaggccaggcggacggatcacttaaggtcaggagttcgagcccagcctggccaaggtggtgaaaccccgtctctactaaaaatacaaaaattagctgggcgtggtggcatacacctgtagttccagctacctgggaggctgaggcaggagaatcgcttgaacccaagaggcagaggctgcagtgagctgagattgcaccactgcactccagcctgggccacagagtgagattctgtctcagacaaacaaacaaaaagaactattgctgaaacttaatagggccgaaggctgaccactttttatcatgagcttgaatgagatcgatgattgcaacaagtattccttgagtgataattacatgcatagtgttattccagatgttgtgtgaatgcttacaaaagaggaatagatgaatattgccactgtagtaacttggattagaataagtgttctagttttataatttttattttaatttttaaaatctttaaagttccgggatacacatgtaggatgttcaggtttgttacatagg

SEQ ID NO: 960 - DNA, 1049 bp, Homo sapiens
tttggtctagggagccttcttgattaaaaagggcctggaatagttagaaagaatgaataagacctagtacttgatagcacaacaaggtgactagagtcaataataatttaattgtacatgttaaaataactgaaagagtataattggattgtttgtaacacaaaggataaatgcttgaggggatggatactccatattccatgatgtgattattatacattgcatgcctgtatcaacatttctcatatacctcataaatatatacacctactatgtacccacaaaaattaaaaataaaaaaattttaaaaagggccggagtgagggtggttggtgattggctattcctttatgccaaagacttcatattcttcttcatatgtaattctcacaataatcctacaaactagttattaatttctgtattttatgaggaaactgaagcttaggggaataaacttgacccagttacaaggtaatactactcatcttacagcatttatggagcccttacttgatgtgtcaggctttgtgttatgaaccttaaacctattaacttgtttgagcctcaccaagctgtggaaggtgggtaccattattacctccatcctgcagatcaggaaatggaaacttaagagaggcgcagcaacttgtctcagcttatattccaggggctggtacatggcagggcccatgtttgaatccattctctttatttattttttgaggcagggtcttggtctgtcacccagggtctttcttgctctattgcccatggctcactgcagccttgacctaccagactcaagcatcctcccatctcagcctcccaagtagctggaccacaggctcatgccaccatgcccagctaactaaaaaaaaaaattttcatagagacagggtctcactatgttgaccaggctggttttgaactcctggcctcaagcgatcctaccaccttggcctcctaaagtgctgggattacaggcgtcagccacctctcccagtcctcttctgctttagagctcttgccctactattcaaatccac

SEQ ID NO: 961 - DNA, 1044 bp, Homo sapiens
tatgccttttcagtcctaaactccactttttgtctctgcagcccttgaaactgtctaaaattctgcaggcttctctgtgtcttaacagctgccccttgcctggcttttcagcttcttaccccatgctaagaattggcatataccctaaataggaaaatgggcttgcagaaagtcaggctcacctcagtgagcctcccctctctccaagatctggttcctcaaatcgtggctgattagtagctttcctattacttcacacagatgtttaaaaattttatctggcttttctaatttccctcatcagaaccagtctgctacaacctactctattaaagctggaagttaaacacgtctgtttttttttgtttgttttaagtggattatgttaaaaaataaaaatcacaggccaaaaaccaaggtaacaatgtcattttaaacatgtaaatttaataaaggatatatgttgatttttagttactctttcttgccttattaaaagcttgtcagtaccttttttcatatgtactctgaaattcttacaaatatatgttgctttgttccagagaatatgtgtactaaaagactataatttttctgagtctggttctccattcaaatgttttaatacttttgtgattttatgatttgtaattgtcgactctcacctcccaattcaacatgatcctaaaatgtacaaaataatttgaatgattgagtttcaaaaagttttagaaaacttgatcttgtaacttttattccaaagctttgttgagggggagaagtacaggcttctgcctttaagggtactgcttcacttttggggcaaaaaagcaagggttttcaaagggggacttgacatgaatggcatgcaggggagggggtgagccagtgggggtctcaatgacttgctttggtgctttatctaccaggtggttgagctggtgccctcgcgggcagaactaggtggtaaggtggccagagtcttgagatactctccaagtgggagtgagtttcatcatgggcatactttaggttataatttgt

SEQ ID NO: 962 - DNA, 1977 bp, Homo sapiens
tgccttttttttactcagcataatttccctgagttgcatccaagtcgttggatgtacaacatgcaccaacagtccattcctttttactgctgagtagtattccctaaaatggatatagcataatttgttaaaatatttatccattgaaagacatttgggtggtttccaattcttagctactaggaatagagctgctgtgaacatctgtgtacaagttcctgtgtgaaagtaagtcttcatttctttgggataaatgcccaatagtgcgattgctggattgtatggtaagtccattttcaattttgaaagcactgccaaactattttccagaggggatataccattttaaattccaaccattattgtatgagtgatccagtttctccatatccttgccagcaattggtatagtcactatttttctttttagcatttgtggtgggtgtgtagtgatacattgactttttgccccttctcctaccaaacaaatatgttaagttttgaactcagcttcccaactctcagtggcctggtctgtgatttccataggcctctatacttctgacctcctcctacctccatgaccttgacctgacttctctttcttctctccccagcctgggtcccggggtcccctttttacctcagaatcgctttatctcaatcctgccatcttcccaatgcctggagaaagtcacaaaagtgctctccactgctgccaggcctctgatgttacagctcctgggcagtcctttcctttacctcagtgatgtcaccctcccacttctgacaggctctgctccatacagtgaggtcttctctcagagaggaccttaccacctctcaacaagagtgagactgttcagtctgaagcccctcagcatctcctttctccatctctgcctttctgtttcttgcagaagccaactcctcatgtgtgcttatgttcccagagagcctccagctccccagggtagggatttatcagaggagtctattttcagacttcccttcgtctgttctccttttcctcagagtgtccttaatggaacacccacacctctcctctagtactgagtctgttgaatcaggatctctggaggtttgcagggcggagagtctctgtttttatcagtctcctcaaggcctccagtggggagtcagattcagagacggctgcctcagggaccctctgggcccctcttcttcacactacccctcagtagtgttttccccaaattttggagaaccaaattattttgttctggactcactgttttttgtttttttttttgagacggagtttcactttttttgcccaggctggagtgcaatggtgcgatctcggctcactgcaacctctgcctcccaggttcaagcaattctcctgcctcagcctcccaagtagctggaattacaggcacccaccaccacgcctggctcattttgtattttcagtagagatggggtttcaccacgttggccaggctggtctcgaactcctgacctcaggtgatccgcccacctcagcctcccaaagtgctgagattacaggcatgagccactgcgcctggctgactcactggttttaactctgtggttttccatctggttcctgcatttctgcccagctcctttaaatttatattaataattgtaattatcaggttgctttggttttgtagtcttattggctcctgctttgcagtgtcatcagtttcatctttacaaactctgatgctctaactttcttgcataaacagcagcaattgctcttctttccttgcacagaggtaggagtgttctcaatatgaccaccatctggtttcccagcctaggttttcacaaatctcctatacatgatttatgtggcccctgaaatgcctggcgtacaattgctcagaccatgttctttttggattttgttattgggcctcatcttattgcccctgccttagaagtacacctcccaattca

SEQ ID NO: 963 - DNA, 1054 bp, Homo sapiens
agaagatgcttggtatgatttctattttatttatttatttattttatttatttatttttttgagacgaagtcttgcactgttgcctgggctagagtgcaatggtgtgatctcagttcactgcaacctccacctcccaggttcaagtgattctcctgcctcagcctcctgagtagctgggattactggtgcctggcaccatgcccagctaattttttgtgtttttagtagagtttcactgtgttggccaggctggtcttgaactcctgacctcgtgatctgcctgcctaggcctcccaaagtgttgggattacaggcgtgagccaccacacctggccaatttctgtgtttttgaatttgtacagactcgttttgtggactatggtctattctagaaaatgttccatgtgctaatgaaaagaatataaattctgcagcagttgggtaaaatattcagtaaatgtcaataaggcctattagatcttgaacctgggttttaaaagatgaattggagtttaccaagagaagaaaatacattgcagacagaaaggagcttgtacaaatgtacattttatgattcctctgacagcaaaatgtatcttcccagttattctgtatttttagtcagtaagtcatttccgttccttgaaaacaaacacgtcaatggggaatatatatgtgggtaaagactagaccagaaacagtcctgaatcatgttgggtaaaaggggcaaggcatcataaagtttaaattgacagaggccaatgctagatcaccctggactgtttgggagctatgccaaacatttcaaatactttgtttaataaaccatacttgtctctcctaaaggtatatgaaagtgggtaacctggaaggtctcctgacatttgccccacagtcatcttgtagaaaaaagttacaaattaacaaaaaagaatgggctttcttggcagccccagacagagaaactcaatgtgtttgcttttagacgtcagctctaccaagagcacagataatttcctagtcgtattttgattatttattatctgattacca

SEQ ID NO: 964 - DNA, 1050 bp, Homo sapiens
gcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagacca

SEQ ID NO: 965 - DNA, 1014 bp, Homo sapiens
aggcaaggaagggtgcttccctacagccttcagagggagtgtggtggcgctgctgacaccttgatttcagaagtccagcctccagaactgtcagaagataaatttctgttgttctcagccatccagtttgtggtactttgtaacggcagccctaggaagctgatgcaggtgggattgattcccctgctccagagaaaggactgttttcacagaagaggcgatgcttgaactgaatctgaagggatcaatgtggcttcccttggcaaggcatggagtgaaggtggagtatatcccaagtggggaggacagcacgtgacatggcgcagggcttatgaaacaacatgccttcttctcttcaggtacttaagctacattagtaagaccagaacttagtggtgagggttgaagctggctggacaggcagttaggagtgagtcaggcgatggtgagcctccgtgccagaacaacttgtaggctgtggaagcaaccgcaaagggatggcagcggtgatatatatagttgaaagatcactgtctgctgtgtagaggatggattggaagagtcacagaggcaggaataagaggttaagggcctgcaccagggctgtagcagagagtttaagaagtctgggagattgagtcaccttgacctactgattcattggaaggtggaatgcaatcatggtgtcagtcctctaagataggacctttaaagtgtagggatagtggtttggttttacacgtgttacacatgttgaatttgaggttcttgttggcggtcaaggcagagaagtccagactggaggtggaagtacaggcctagttctttaggacctactctgggctggagcatcagttgcggccgggcccttgtggtagtaggagctttgggttgaacataagttttcagcaggagtgcgtggagtgaaaagagagatggggttggatttttggtcaactccaactttaagagattcagaggatgtgattcctgaaaaaagaggaaaaaaaagac

SEQ ID NO: 966 - DNA, 1091 bp, Homo sapiens
cccttgctgatataaaagtttttatgtattcttggtttgatcactcctaatttgtctgcatgcaaggagaaccagacttaaggtaggatccactcatttactgactgattgcttattgaatgccttctctgtgctggacagtaggagtaagatgaggagcactgtggactttgtccctgccctcatacatttatgataaggggttgtggggtcagggcatggaaaaaacaaaaggcaaatctttaagacaaactgattggaaacgactgctattggttaaatacacccacatgttgagataatttgtactttcccaaaacattatcttgataacattatagtcccagaaagcgttagggaatgtagtaatgaaactttggcaggtcttgtgcctctacaatgtttgtgttgctcatgacctttgtacatgaatgcttttgcccatgtggccagtcaaaaaatgacctggttgacctgtttttccaaaagacctttgaccaaatctttgatggacaaacagagaatcatgttttcaagaaggatctacttgcaagcaaagttctatagtgtagtcagggaaggctctatgaagtaatgaactcttctggcaaagatctgaaggatgagtagaaaatagtctggtcatgagctaggggaagtgatttacaggcaggagtaacatgtggaatacagaataatttgactttaataaatttcaaatggtaaaaattttccaaagttcaaaatagaaacataacatcccgtgatattagaaaatctcattactttactttagtctggccagaaatgtgtcaagaggaagacttcaaagaggtagatttcatctctctggcctgtaaacaaaatgcccaaaacacttccccaaggcttaaagtcagtttgtaattactcttttcatcacctcagaagaatttccaaactttagtaacgtagtaaaattttttttggcctttgtgaataaatactatgaaatttggttcaaaagataaagcaaagagcaactgaggtcttcaaaacatcatgtatctagaaggtattaccaaacatccgttttttttaaaaaagcataa

SEQ ID NO: 967 - DNA, 1111 bp, Homo sapiens
agcatcacacctagtgtctagccatccctactttgtccctacactttttgaattgcttaccaacaacttagagagggagctagagattgttgctggccattgctccttgttttttctcttatttcaggtacttttttgtattttgtcgattcttcccggacgctgccagttttttgcccatctctgttctatttttactgcaactccacaccagttctggttctttggttttcctacttgttctcttagcatttgataattgattctccacaatagattttgaaataacttcttggatttttttctaaattaggtattacagggtaaggtcttgcttttgctccatattccagaatccaatcttgcctggggccaaacccatgccaggctttccctcttttttctcccaaggggatggggtggtcagtcaattatctttatagatatttttttcattaaaattaaaaaattcttaattgtggcaaaagacccataacataaaatttaccatcttaaccatatagttcaatagtgttaagtatattcacattgttgtacaaccaatctgcagaacttttttcatcttgagatctttctttacatttttaagcagtcatttatttacttgttttctcttgtatatcggaccaaaattttcttgaggacaaggctgtgttactgacttgtgtatcttttagtcaaactacctggtataatcaattaataattgtttcatgaatttgaattgaccctggcttccctgatgttctaatctaatgtgcactccacaggaaccctattctgtcaacagacctggattctgatatcaatgaaatagtgcacatcttgaaaacatttccactaatgtaaacaagaaagatgaaagtcaacagagtaagaagttggcacaaggagttgattccgtctgctttggaggttttgctttttggcttaactgttacatggtgctattgtttttgttctgggaggtgggacagtgctgctttatttattttaagaaggcagcaagccaggaacacataattgaaaggaaatttctgtactggcgtattattttttcaactaagatggcaataaataacttgcaact

SEQ ID NO: 968 - DNA, 1027 bp, Homo sapiens
acacaaaagtgtctacagtgagtatgtactgtgaagggttagtgtacttcatactttctttttgattagaagaaaatgtcgggttgttttagcagacagagaatgttacagtagcttttgttgctacttctaatgttttatcagtagcattttcaagattatttgaaacttagttatcactagtaaggacaggtttaagaatatttctgcctcttttcggtggcttggattcaaaataataaaacaatcttttctcacccacatgtactttgtatgcagtttgggagagtgaaatggatttgaagtactcttttatgagtacattttaacttattttcagtgactttttgcctttgggctggaaatgtcgtaagttactcaggcatttatcttccctcatattctctggtgaagtagagatagtcatctccgttgaaacagatgctcagagatgtaagtaaattgcttgttgagtgaacagggaatcgtagaactcaaatataccctggttgctaagtcatttggaaaacaactgaaactggatggatccaacagctcacggtccacagccaactcattcatggcttgggagtgtcatcatgggtggcagaggctctgttcctcctttgtaatgtggggacttactctctcagcaatttactgagaaaaaagtaatctcttcacacttagatcactattataggaacaaatggtgtgtatttgtgaagtgcaatatttctgggaggtcttggaaataaatactaaaagtatccagaaaaaaaaaaaaaagaactctcttggcagatattgtactgcatttttcatactgagagccaaacacacccacttaaagagtatgtcctgtggagttaaaaatgaagaaaaaggcttatagtctgctctaattcttaagactttatgtgatttacaaattccagttttaattaaattagaaagttgcaaatgttcacctactggccacactcagtatgtacaaccttttggagttgctcttcaaatacgatct

SEQ ID NO: 969 - DNA, 1084 bp, Homo sapiens
cttcactactggtagcattgtcacggttattactctgctccttgaaacagtcccttactgacttccaggacaccatgcattcttgattttcctccttcttcactggctgctcctttctgtctcctgtgctagcctctcctcttttcttagaggttttaaccttggaataccttaaggtttagctcttttttctccatgctttttgatgatttcatgcaatctctctatgtgtgtgtgttgatgattccgaaagtgatagctcaagccttgactgctccctctggacttcagatctttatattccagctgtctactgagcatttccatttggatgtctagtaggcatctccagttcaaattctccacatggaatcttcatctttcccaaacctgcactatctgcagtcttcctcatctccatctttcaagttagttaggccccaaaccttggagtcatcttcgattcctcctattctctcatacctcgtttgtaatgtgttggggaattctctgtgctctatcttcaaaacaaatccagaatataatgacttctcattacttccatggctctgttacaggaaaggggtcccaatccagaccccaagagagggttcttggatctcatgcaagaaagaattcagggcaattaggtagagtaaagtgaaaacaagtttatttggaaagtgaaggaataaaagaatggctactccatagagcagccccaaggtctgctggttgcccatttttatggctatttcttgatgatatgctgaacacggggtggattattcatgcctcccctttttagaccatattgggtaacttcctgacattgccatggcatttgtaaactttcatggcgctggtgggagtgtagtagtggggacaaccagacgtcactctcgtcatcatcttgattttggtgggttttggccatcttttttactgcaacctgttttatcagcaagatctttatgacctgtatcttgtcctgacctcctatctcatcctgtgacttagaatgtcttaactgtttgggaatgcagcccagtaggtctcagcctcattttacccagcccctact

SEQ ID NO: 970 - DNA, 2710 bp, Homo sapiens
tgcttcggctcgcacacggtgcgtgcacccactggcctgcgcccactgtctggcactccctagtgagatgaacccggtacctcagatggaaatgcagaaatcacccgtcttctgcgttgctcatgctgggagctgtagaccggagctgttcctattcggccatcttggctcctccgtgaatccgtttcttaatgttttacactattctttgtggtaaagtgtggtttccattttaaattacatctctcagaataataggcagctctgaaaggggttgtagagaccatctaacagtctgatttgtagatgaggaacctgaggtctagagtgttgaaaacccaagtcccacagctgattaccggaagagcttagcctggcacccaacactcctgatgcctaattcaggtaggttttcatccaaagtccaagccacatatattaaaattatactactatttggatttatgacatagtagtacaaataatcatatttgtgatactccaacttgagtagaactcataggaaatcttgtctctgaagtcggacttcatgtgggtatattaagccaccagacttttaattattctaactctccaatattacctcatctgcaaataaacaataggtttccaaaggtctactggtaaaatttctcctctttattggaaataaataggcagttgttacctatgcaataattatttggccttacaatatcatagtaaagataaagactttagaaaacagggaaattttaagacctgagcatgaaagaaattgaagacggtgatattaatgatgttaaattagctgttacatattttatcaacattgtgagcacttgcatttagttaaaatttcagtcttatcccgtgatacctgtcctggtttgttatggcataaaggaacattcagtttaaattttttcgacttgtatttttaatgatgtaagataggatgcgtacaggaataaatctgtagcctaattttacgtgagatatttctcagatattgatctagagtatcacatgtaaatttagagacttatctataatccctttccttttatgttttccacagacaacttatatatatgtgtttttgtttttgtgtgtgttctgattttagatttaccttttccaggtgtacttctctgaagtaagatgatttgtcaaaaattctgtgtggttttgttacattggggtaagttatttgctcatttgctgttttaatgcccttaaacatggtagagattttgcctttagagatgctgttttatttattagctaacagaatttcctatttctagttaggaattctcatacatgcttatgattaaaaatgcaaaccatagtataggtgtatcagtgtgaaaacgaaaacccttcccaacctcctaaagacaacctgatggtgtatccttccagaatcctctctctctctcacacacacacacacacagactcacacacacagactcacacacacacatacacagacacactcatatctatagctgcaaaaatagcactggtctgtacatgttgttctggatgtttatttttccatttaacaggtttccaatttatcatgatggctttttacctttatcagtatttaccgggatacttattagtttaatggttgcatgacaatgcactgtatgaatatatataaaattattagtctatttgaccaattcctgattgatagacatttctttttctgtaacaaataatactgcattgaaacttcatgtgtctttgtatatttggaaaaatatttctgtagattaattcttttttttttttttttttttgagacgcagtcttgctctgccgccagactggagtgcagtggcatgatctcagcccactgcaacctctgcctcctggattcaagcaattctcctgcctcagcctctcgagtagctgggactacaggcacgcgccaccatgcccagataatttttgtatttttagtagagacggggtttcactgcgttggccagatggtctcaatctcttgacctcgtgatctgcccgcctcggcctcccaaagtgctgggattacaggcgtgagccaccgtgcccagccgatacattgccaataacttttgagcatactgttctcacgtgtttcttaccacattctggtgacattctgatttccttaaaccaaatcatctaagttagattgtgttccaagtttttgaaattaaagttagagtatctttaacaaaacttatgtgatttggcaattgtttatctagctttctttaacaaaacttatgttgtggcaactttatctggcagctgttacctgtgtgtcaactgattctgagcatctccttggctaccccaatctaaaggggctcttctaagcttccctataggtcttccttgtggtacatacttctctttcattgcagccatctgtatatttccagaaaataacctagatagctccaccattacagatttccaaaaaattatgccacaagggactatcaaagagaaataactcattctctttttatattctctaattttattagatatatttaagggaactgttcattctcttttataattctctattaattttcgttagactctagtgttttacattgactttctggaaggtttctggtttgatcaagtttttgaatcaaaagaattcctgggatattgttacctgataagatat

SEQ ID NO: 971 - DNA, 1048 bp, Homo sapiens
tttgcttcgaactgtggctctagtaatagacttggaccttgagtgaatcaggaatagaattgttttggaaatggtccatggggtccaggccccttgagcacattctttttttttttaatatagtttaagttctgggatacacgtgcagaaagtgcaggtttgttacataggtatgcgtgtgccatggtggtttgctgcacccatcaacccgtcatctacattaggtatttctcctaatgctatccctcctctagcctcccacccccctacaggccccagtgtgtgatgttcccctccctgtgtccatgtgttctcattgttcaactcccacttatgagtgagaacgtagtgtttgtttttcggttcctgtgttagtctgctgagaatgatggttttcagctttatccatgtccttgcaaaggacatgaacttatccttttttatggctgcatagtattccatgatgtgtatgtgccacattttccttatccagtccatcactgaggggtatgtgggttggttccaagtctttgctattatgaatagtggatgagcacattcttaagtggctgagtcacttcaccgaagttgaaatgaacaaaaaccaaaactgcacaggtcacagatgtaaaaatgtacccataacagaaatattgaactgtgacacttcccataatagacttagcataactaatgggccattttcaatttctgcagcactggcagtggccttccaggactcaggctgtggcatctttcctcctgccacagcccctgtctgagccacaggagctgcccagggggtgaggagtggtgggctacactttgaacaaaaggagacagtcttattctctctcccaaatgggatgatgctatgtcacagttgtcattatgttttctgtgcaacatgtacagtattgctctctgggcagtattaattgctcctcacattcaatcactgtttcacctgaatgaatattgtggaagctaaatataaaattgtaaatttaataattccaggaatccttatataaaataatagggggaa

SEQ ID NO: 972 - DNA, 1038 bp, Homo sapiens
tctacatagaaacttgcacatgaatgtttaagcagctttagttatattcaccccaaactagaggcaactaagatatccttcaaaaatgaaacgattctgtatacttctgaaatggtgggtatatagcactatgcatttgccaaaactcctcgaacttcatagcacaaagagtgaatcttaatgcatgtagattaaaaagaaaatcatttaggaggttgaaggatcccaggattgactgtaaactgtgacaaaggaatctacctgtattacaagtgtatgaagcaacttcactgaaggtggtgggagaaaaggccactttggaacttgagtggagttgttggaaatgtgtggaatcttaagactaaaggcaaaagaaactgtacataagcactgtactctagttgatacagttctcacagggctatgggctaacaattatggtactgctctacatgtactctggaaggggacaagcaagtaaatggatggtggatggtgggacccagatttctcactgttggattgggaggttacacacaagcacaggatgatccatgtggcaatgaattagagttggggatataggtatgaacttatatctagcttaatatagatatagctagattctggtttaggatacatgtacattttcttgatttgtaaggtaagagggcctaaaagtaatgacatccagtagtaagacatgtgcccagacttgtttctaattaccatcgttcaataatagaaacaagggctattggaagaaatggctaattttagggttggggcagaaaatatacgagattagcctggaggatcttgtagtaccagaaagtaaggaagcttaacattctcttacttgatggttaccaaaaaagtattcattaaaactgacatgtttttttttcaaataaaatgcaacatttgcatgactttgaaacatttctttcttgcggtggctgctaaaatcttactttcaacctatccagatgattccaagttttgcagggatacatgtatatgtgtttatttttctct

SEQ ID NO: 973 - DNA, 1017 bp, Homo sapiens
ttttttatttaatgtggttattttttgaagagactttcaattccatgtctcctgtcaattctaagaaattatattatttctttgataatttcctctcctcttgtttctttgtttctctttctagaatctgtatgttggatgatggaccctctgcgtagatcttccacatctcttaccttttatctcatattttcggtttctttgttttgtgtgtgtgtgtgtgtgtgttatattctgagaccttgccataccctcttcttccagtgcttctgttggatttttatatactattatttttgtaaatttccaagtattctttctcagagtattctgttctggttttatgcatattttcttaaatgttgctagaaataccaattcgaggatttttgttcttttattttaaaaattcttttttcttctattccctgaattctgtgttccttctaggtcgtgtgttcctgttgtttatcttggcctctcttttattatctcagactttcctcctaatatctggtaatcctttgttttcctttcatgtttaggaatgaaacagtagacaggctgactgggagcccagtgtatataggcagggattgttgccctgggtgagtaggcagggttctggccagatgaggaaagatgtgctctcagctagcaatattccatggctgctgtcttcctccccagacagttccttagttgcttttgagaacaaaccctcagtctggttgtgaagggtagttcttacatggaggctcttccatgttcagcagaggagtagaagagccctattccatatacagaacttccattaggccccagtttccagccacagttctcttgtcttcatgtgtttttacgtgccatttcttcacgcactgtctccgctgtatacggcagggctaattttctttctcctgagctgcagctggatatattctggtcttcagctttctttgctcaccttctttgatctatactcttccaattgttttctatcttttagcaatgaat

SEQ ID NO: 974 - DNA, 1022 bp, Homo sapiens
gttgacttatgttctttattattaacttaacacacttccatttctgccagtatgacataatgaagcaaaattttttaacataattgagccttaaaatgtgtcttttcttttagccagaaacgtttgagcatctttttatcaagcatacagcatcagtgacatgtggtcctcttcttttggagcctgaaacaatttcagaagatatcagtgttgatacatcatggaaaaataaagatgagatgatgccaacaactgtggtctctctactttcaacaacagatcttgaaaagggttctgtttgtattagtgaccagttcaacagtgttaacttctctgaggctgagggtactgaggtaacctatgaggacgaaagccagagacaaccctttgttaaatacgccacgctgatcagcaactctaaaccaagtgaaactggtgaagaacaagggcttataaatagttcagtcaccaagtgcttctctagcaaaaattctccgttgaaggattctttctctaatagctcatgggagatagaggcccaggcattttttatattatcagatcagcatcccaacataatttcaccacacctcacattctcagaaggattggatgaacttttgaaattggagggaaatttccctgaagaaaataatgataaaaagtctatctattatttaggggtcacctcaatcaaaaagagagagagtggtgtgcttttgactgacaagtcaagggtatcgtgcccattcccagccccctgtttattcacggacatcagagttctccaggacagttgctcacactttgtagaaaataatatcaacttaggaacttctagtaagaagacttttgcatcttacatgcctcaattccaaacttgttctactcagactcataagatcatggaaaacaagatgtgtgacctaactgtgtaatttcactgaagaaaccttcagatttgtgttataatgggtaatataaagtgtaatagattatagttgtgggtgggagagagaaaa

SEQ ID NO: 975 - DNA, 1061 bp, Homo sapiens
agaactgggatattgttgttacatgtatttgtataaacattaggagatgatttccatggcttttttttttttttttttaggaagtcttgctctgttgcccagctggagtgcagtgatgtgatctcggctcactgcaacccctgcttcccaggttcaagcgattctcctgcctcagcctccccagtagctgggattacgggcacaccaccatgcccagcttttatttatttatttatttattttggatttttagtagagatggggttttgccctgttggccaggctggtcttgaactcctgacctcaagtgatccgccctcattggcctcccaaagttctgggattacaggtgtgagagctgccgcgcctagcccttcatgaggttttatagtgaatgaattatttttctataaagtttatcaatatttattttggaaagctgctgaaaatgtctttttcaaaattaattatgcttaagatgtatggcattaaattcaattttatgaggctttctgacatatttactaaaaaaacctggaactgagactgaatttggaagacatttaattttgtagtgagatatctatattgtagatattgtacttttaaaacctgtcattaagtgtttggcatgtggttaatactttctctttagtcacaactggtattttaataaatgttataaacgtaagtgccaagatatgcatcactaactgttctatgaaatttgtctacttctcctttatgttcccaaagtcacagagaaagcagtgtactttatgacagtatatttatctttttatcattatgaattataagcagtgttaattttgagaaataaaagtccaaaaagaattattatgagtttaagttactttaggattatatctgttgtatggtaaataaaataatgatattatttcagctaacatttgaaaatataaagaagtaatccttgtggtttatacaaacagttaatacaaaatgtttatccattgttagcctgtcgttgtgtcttcaaaattccgaaagacatatgcttagcatttgtaaggggtttg

SEQ ID NO: 976 - DNA, 1037 bp, Homo sapiens
cttttcactgagcatagctgacctcaaacttctactctgccgtcacgtatctcttttgaatattcatattcaaatacccttattggctgcctatctatcttgcccctagggacaaaatgttctatgagccctttccataaattctgtgggtcatgccttgctgactcattctgaacttgctgtggattatagccttctgtccaccgctcttctattgggtacatgctgccacctagcctctgctcttctcagatcctatcatctccattgctattagggaacccactaccataacaatatctcacatcattattcccaggggtccttctgaccttattgccttgggcatgtcttatgggcctccctaaggaatatggtcggtacagggttttctgtctcatagaacggacccattgcttgcatgttgcttctgtgagccttttaagcccttcctccatcatttgctacagcaattctggcatctctattttgtttactgtaggcctttccttttctcaggctttcaaagttaattgtatcagctgattacagcaatcactggggctcttgccagggcattaaatcctgtgtcactggaaagtgccactatattgcaaaacactccctaacacagctgtatagcctatcttctcttgatttaaccccctgaggaaccacttccagttcctgatggtaacatgttatccatgtcttgatgtttttaggcatataatttcttttctgctttacctgtcccaacacttttgatcaggttatgctgagattttactctaattatgaaccaagagaggaagtggagcaagtcctgagaaggtaaagaaatgttatctaagatacctgcctcacttgatacctttgtataacttcaaacgtgtgtgtgtgtgtgtagctctgtcttccaataagagataattggtcacattttcaggtgcataggactcaggataacccaagatttgagattcttaactgtgtcgatacagatatccccatccaagcatcagggccccactccc

SEQ ID NO: 977 - DNA, 1030 bp, Homo sapiens
aagaggcatagggagaaggcagccatctataagccacggagaaaggcctgcaacatattcttccctcacaaccctcagaggagccgattctgctgacaccttgattttggaagtctagcttccagaacagtgagacaatacatttctgttatttaaaccacccactcatttgtactttgttatggaagccctaataacgtaatatatactattgtgtatgtcagaggttcagactgtattatcaaaaaggatctaatttatattgtataaggatagttgaacgagtatagttatttaggatggaagagaaaagtattaaagaaaatatctttgcagggctatatatgacccaggaatcctacatttgggtattttccatagaggaatgacagcttatattcacacaaaaacctgtacacggatgtttacagaagctctatttataattgagctcaaaactagaaacagcccaattgtccttcagtgggcaaataagtaaacaaactggtagagacttacaatggaatgctatttggcaataaaaattaatgaactattaataaatgtacatcttagctaaacttcaaggacattgtgctgaataaaaacttgatcttagcagtttaaacgctatatgattccatttatatgatatgattgaaaagacaaatcagtgatggagaacagatcacagattgccagggattagtggtggcaggaaggatgtgactataaaggtgtagcagagaaagttttctgagggtgacacaactattctatatcctgaacatattggtaattgcaagaatatctatgtgtgtcaactttcatagaaccctacaccaaaaaaggtgaattttatttcgtgataaattaaaaagtaaaacaaaagagacaaaaatagtaaccagggaagctttcaaaaaatatatgttcttgttcaagaccagcatggccaacatggcgaaatcccatctctaataaaaatagaaaaattagccaggcgtggtggtgggcgcatgtagtccca

SEQ ID NO: 978 - DNA, 1038 bp, Homo sapiens
tatcttgcagactttaagacaggattagaaataacatcttgtgaagtatttaataattggtagacaattcacagtggctattattttggtgtatactttatggtactcattgttatgtagttgtatataggcataaatggttaatgctattcataactgacaatgtattctgatcctttttggtggacaactgagagaaaagtctgtggtttcagattctgcccctttaggaatggataattgagaggaaggagccgggattcttcattcctctccctccattagcatccaaactggaaccttcatgatggaggataggatggattctcctgttagagaagatagttgcaccatctgaacactggttactcaggattctatgtttatcttttaactttttcaatgaggacgactattgtattggcagaaagagtgctttttgatatggtttatgtatatgcccaactcctaatgcacaaacctgttagtagagcacattcaggatactcaagccctgactactgttgaataaagaaacaataaccctattttatttagaggaaccacctcaaagtctcttgcagtaatgctcaattctcttcccttcctaactcaccaggaagaagggggctggaggcacaaatacatgtttcttcccactcccaaagagaaaggctgtgcagtgggagtaggctagatgttacaattctttgctccattaggggattaaaatgacaggtgacacttctcttttataagctaggcacctaggaaaaaaaggttgcttgttttgggtttgctttataataagaagaatatgctgaagcacagggtgctagaaaataaaagatgggtaagaggtttgatgaaagactgggaataaaagtagttgcatttctagaacagcatgaaaatgtaatcctacaatgtttgagattgccatggatgaagttttaaagaagtgactttgctcaggaaattaagtttttgatcaaggagagtaaaggttaagaaagtatttgcaatttggtatcaggt

SEQ ID NO: 979 - DNA, 1033 bp, Homo sapiens
ccagtcattctagcctgaagtatcatcttgttgtctacgtttctggggctgagaagatattttgctccacacctgccagcatgccctttccagccctgaggtgcaccagtgagtgtgtgtcccttctccagctttcctggggtaaaagtaccacctttggatcaaggcttgctggctgcggctcagaggatctgcgcagaggaagcagtgtgtcctcaggagatcctgaaggaggggaggggggactcttcctacttggaactctttgtttattggttaatgaaagggcaaaaataagtccctttctaaaattttagtttagagtttaagttggaagggaaaaaaaaagaaaagaacacatttgaggattaactatttattgacttttctctgaagttctcaattgaaggttaaactcagggattttccaggctggggtaaaactcaaccaactgcttccccatgaggagggctttgctgtgtaacttctccaaatcacactgggactccatgtagaaggactttcacaaggcttgagcctactttggagcattagcagacactctgttccctgtattttgtggtaattgacggctatgcaagatgtagatccaacatttatggggtagtttttcaacagctttcaccatagagaacatggcaaacttcaatagtcaccaaaatatactaactagagtcaccaagataaagcaggcaattaactccaagaagagaaaaagagtaccccctgagaaactacaaattgccattaattttcattttgagtgtcaatatgctgtagtattctaatcccattcatgcctagagtgctggaattagacattgactgtcttgcaaatttattaaaaataatcttattcagcatagtagttagtaaggctctgagaccaggcactctgtagacacgggtgaggattccaatccctcaggcttccgctcctcctttatggtgttgtgtgcaggaagcaatgaaagttgaatagagctaaccctaacaaaagggctaaccttc

SEQ ID NO: 980 - DNA, 1091 bp, Homo sapiens
cagtggacccctttcagtgaatatcgggtaagcagcaatgtgctacataggtaatgtggtttcttctttcatggtgttgctcaggatggtttgagctttgaggtgtgtagtcatatactaaggcaagatattactgaaggaaaatagcttatacagagaaatttaagttaaaaaacttaaatttaaaatttctgtgtttttaaaaaataaattttattgccgagggaactaaaaaatctaatatgtaaaagaaattatgttaacttttttgttttaaaaattaaagatggttgcgttattgtaagataaaggaaaaaaatattttgattcactaatcatttcctaatattttctaatgtatgttttagttttcttaaatattttatcagttggagaatggaatgttttgtgggaacgcatggattgttcaactgcaagaaggaaagaactggaattttgtttttatttggtttttagtgtttatttaatgacctggtatctttaaacaatttatcttctatattcttcagttacttgtagatagtttcatgtatagtgaattggggaagagttagaggaactttcgtgatctgtgtcctacaaaaaaatctaagacaggtgaagaagtgaaaagtacaattgatttatagttttcctggcctcaatacttgaataattatgacgatttttgagaccagtggttttaaacaattagacaaaggagaaatgcttggttggcttttactttgagctctcagtagattcattctttatgaagccaatataaaagcatgtgattaaataatccagatgctgaattattgtgcttttgatcaaataaatctgaggatttaaggatagcttgtgaagtaacagtaagtgcaaagcaacagtatatatctatttgttaaatctgagggggaaaacaggttattgaagaagtatgtctccagagaaaaatgtaggtattatgcttctgggcttttaaaaaaaaaaattgatgcttcctacaagagcatgaccctgaccatgtttttccagaaaaatatttaattcttgaatagaaagtgctttagatgagaataggatat

SEQ ID NO: 981 - DNA, 1402 bp, Homo sapiens
cttttttccacacgaaaagcctgttcttatttgatatgaccatttattatttacaattttttcatatttataacattataaacacttttaaagctataaacattttccttccatttttctgttgtaactattaaaaagcaatacataatagttgctgtgcgtagctttttcttggtacttttgacttacatccagcatcaaataaaaatatatacattaatattaataagatccacttaatttggtttaccaaactttttgaaatattccttaccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggtaaataacatgtagagctagggtatgaattggttatgacttttttgtggaaagggaagatctgaaattttgattctctgattaggagagaaattgtgttatatattaatgactgaaaaattttgtgtgatcataggtgggatatttaaagtttgaaatgaaaggatttaaaaacaataactttattatgtgcaataacagaattcacatagttactttggtaaaacatagactgttaaatgattctgctataaaggtctggtcaaaaatggactataaaaggattctacacggcctcatatatcctttgtccttccccagttaccatatcttttacttattctccttcagagccaaaaattcttgaagtatcattttccattcactacataaagtgctctagattatctccactacataaagtgctctagattatctccacctcttcctatcaaggtgaccagtgaactttccttgttacatccatttttatattcacttttctctcactaccttactttttctcagcagtattcaatatagtttaacattcccttcttttacttgaattctggagtacaccactgtctggttttctttatctttttgtttctattcagtatcttttgcagactcttcttccgttactcaaggtttacatgttggcagtttgtgattctcagtttggaccttctttttttctctcctgtctctgtctggatcagtgctcctcaaaatgtagtatgagggtcagttgcatcagaatcaaccctgtacttattttaaaaagcagattttttggacctctcccccggcatactgaatcagaatctctggaggtggtgttcagatccacatcttcattaagtaagttggcattatatgtacaccaaatttgaaaatcactaagctgtgtgatttaatttattcccttggtgtgtatatccttagtattctttagtttatatttctagcatta

SEQ ID NO: 982 - DNA, 1024 bp, Homo sapiens
actccaacctataatatgttagtgtttgataactttaccctattgtcttgaaattagggcagacttaacttgagatatagtatatagtgtttatcctttttgatacagggtcttactctgtcaccttcccaggctcatgtgatccacctgcctcacctcccacgtagctgggactgtaggcgtgcaccactatgcccggctaattttttatttttttgtagagatggggtcttgctctgttgcccaggctggtcttgaactcctgtgtgcaagcagtcctcccacttcggcctcccaaagtgctgggatgataggcgtgagccactgagtctggtcggtttatgtttttaaaaagtccatttctcccaccttcagccagccttcctttagcttatgcagacatgattgcccttccttttgttacagtgtaagacaactcatttcttaaaatacagtctgcaaatatagtgtgtattcctgttttttttttttaagttaattttttagagacagggtctcgttctgtcgctctggctggagtgcagtggtgcagtcatagctcaagcatccttaacttcctgcgttcatgcctttctctcgcctcagcctcttgagtagctaggactgcaagtgcatgccaccgtgcctggctacattcctgtatttttattcatcatgtactatgcccactttccttatttctcacagtttatcagccctcttatttcacattgtaacaggatgctgtatacttaacctgacgttagattttgaagaaggcagtatatatgcatatgtacagaagggcagtgtaaagcagtgagttagactgcctgggttcgtaatccagttctactacttatttcagtgtgggacttaggataggttacttaacattgttaaacttcagatgttattacaagaataatatatctaaagcgcttaacataatatttggcacataataaacacaaaataaatcttagttaatgtcattcataagattctcaaaaaagtctctgac

SEQ ID NO: 983 - DNA, 1039 bp, Homo sapiens
tttttttattaggcaccatgcagattatatattcttcattggttagcactcctaattcaaacagttaaataaacatgatttgttagttataataacattccaggcatgctcctttggacttgtatctgttttgattacaaaatctcctgagctacccttaactttttcctaaattcatgtaagttatcatttatactaaccacagtgtattttaaccttttgtttactcatctttgtagcattactggtaagtaggtcgatccttgccccataggcacttagtaaacatttggtgcctaagtgaataggtgggtgaattatttccgaattagggtttccttatatggccttgtctaccccaaagatcccaaaaatataagaactttcgtctgcagagaacagaggctgagcagagaatagaaatcaatagcagtatatccagattcattttatcatggtagttttattgtatttataatttaggatataactaggattgtaccagcagattagaaaaggaatgatgtttattaaggaagattttctaaatattttcctttgggctgtactttaaacaaaagtatctattttgggaaacaagggaagatagaagaaggttttgaagtgtgtgtgggtgaggggacaagataattcatgtgaaaataatacggccgggcgcggtggctcacacctgtaatcccagcactttgggaggccgaggcgggtggatcatgaggtcaggagatcgagaaccatcctggctaacacggtgaaactctgtctactaaaaaatacaaaaacctagccaggtatggtggcacatgcctgtagtcccagctactctggaggctgaggcaggagaattgcttgaacctgggaggcggaggttgcagtgagccaagatcgcgccactgcactccagcctgggcaacagagcaagacttcgtctccaaaaaaaaaaaaaaaaaaaaaaaaaaaaaatcattgcctggtacataggatatgcttaattagctgttaatttcttttcataataaaa

SEQ ID NO: 984 - DNA, 1031 bp, Homo sapiens
ataacattattgacagggaatctgaggttataatccctgtaagatatccgttgttaccacagtgacttcattggtgtgaagctcaaaaacgaaacaaaaacctgttttattttgcctgtatatacttttcattaggctttttaaaattcctttggctatccctaagaatctgtgtatatcaagttggaattctcacctcggattatcttatgtacatggtaagaccagtgcctaccatgaacctatcttttttacctttttaatcattgtttttttctgatttgtttaaaattataggaatctcaagaagccacaaagaagggattttcattgatataaaatgaattctttttagtcctagggatactatggccaccaagtttatgcatatcctactttgtacatatttaaaggtagttgatttatcaggatcgaattcatatttgtttttctttggagttctctatatataacattcactaaagttatttgccctcaaaaaggatgaaaacactggatgtttgaaaaacttttaagaaattgtagcattgaactgtttatagtccttgtcacatattcaagccttttatttttctaggctttatatgaattggttaaatgcaattttgatacagaagaagcattgagaagattaagatttaatgtaaaagcagctagaggtaagtatagtttttattcattttcatgatttggcagaaattttaaaattaagcttttcagtttacctaggtatagcctaaacttaataatactgatttttctgagtttgataaatatttacaaaataccaagtattactaaacaaatcgttacggggagtgggattaagattgtcccttcctcctttgtgggaaaatacagtcatgtaagtaaaaatgtaaaaatttatactgccttatgcattcaaggcatatttataaatattttcttatttgatcttgataattgccctatgaactaggtagtatgacagataatacctttacttaaaggtaaaaattgatgagcct

SEQ ID NO: 985 - DNA, 1051 bp, Homo sapiens
ctctgaggaaactggtgataggagagtaccagtgaagagctgacttcttcctgacagaaactggaagagaaacactgtgaaagccttgatcctcttctgacctttggtctcacattggtcctgctggagtgtatatgcttagttcatttcatgacccctctctgttccctcactacttctaggaataaaccaaacaaacaaaacttagggcccagtaactatgtcctggtccaagaaggtttattgacttgatgtctaatgtttgtcacgtccattctgaagtagaataagatgctgagactctgaccttgggactaaccgtataggctcaagggaggcagacagttggtactactattgtttttcctgtttgttcttaacatattaacaccaaatcattttcttttcctttttaagaaactatttgatgagaacatgctgttaggctaggaaagtgttcataagttacttataaattacttgtagctcaaaagccactcaacattacgtacagtcaaaactgccagctttttcaaaggaaggaaggaacttttcatcccaatgttatattacttttttatatggggctttaattagtactttgaaatcttacagttatttttgacctaatcacagtcgtcagctagctttttggacttgttcctacagaattgttctcttcaatatattatgatgcataatccccatgtgcattcatgatttgagtgcattgagttggtcaaaatagaatattttcttctatcagaatacagtatttgaggctcatcctttatgccgaatatttttcaagcaattaaattgtaattattcagtgatgcaccctatattttacttcttatcaccaaaatttgcattccattttacagtcaactctaaaatgaacttttgttttcttttattagaataattttgcttttacttttctcacctactatagaatttgtatttactttttaagtaatttgtatttacttaagtaaataatttagcactttcaagtatatgcttggatagtgcggcattagttttt

SEQ ID NO: 986 - DNA, 1031 bp, Homo sapiens
cctcccaagtggctgggacaggtgtgcgccaccacgccctaatttttatttttttgtagacagggttttgctgtgttgccagggctagtctcaaactcctgggttcaagcaatccgcctgccccagcctcccaaagtgttgggattacaggtgtgaccaccacacctggccacaaaattcttgtagctagtgctagtaggttagaataaaacaactcacttaggattgcagcagatgggagttgtagtagaacctttgaaaacaatgataccagttttggcaaagggatctattttcgtgtatatgtatagttagttaggaaaagtaatgaaggtcatatgccaaaagtaacggttgtttttgagtggtggacttagagtggccagacccccttattaaagaagtctcatagcacttgtcccaggtgccatttggttttgcatgactatttccccctccgacagtaagcctcctgaaggggagggtcgagtctgttttcctcaccatcatacacccacatccaagcacagtgcctcttcccttactcactgaacatattagcatataggttatagcatagcctataatcatttgtctctcctgcttagggcctaactctggctactctttccagtgattgttctattctgcctttggggatacatcctgagttgccctttgtaccgctgccattcttcacttccatctgagtagtagtataaacgtgttttcatccagttactgcatcactggtagagggtaccattttacttgctttttgggggagctccgactctaggatttttgaaaacttttctttcttcaaagggttgcctggttaaattatggaaaacagcatctcccattgcttgtgtaatcctatacctacacattctcccactctaaagcctgttgatttgggggaggctggggagaagagaagaaacaattacatagatgtcagtgaccacattgctagcctgagtcccagttgccctctgggttccacagagagtcacagtcccattttt

SEQ ID NO: 987 - DNA, 1051 bp, Homo sapiens
tgttgcccaggctggagtgcaatggcgcgatctcgactcgctgcaacctctgcctcccaggttcaagcgattctcctgcatcagcctcctgagtagctgggattacaggaaactgtcacctcacccagctaatttttgtatttttagtagagatggggtttcaccacattggccaggctggtcttgaacttctgacctcaggtgatctgctcgcctcagactcctgaagtgctgggattacaggtgtgagccaccgtgcccagccgctgttgttgatttctaatttcattccactgtagtcaaagaatatattttctgttatatctatccctttaaatttattgaggtttttatggtctagtatatggtctatcctggaaaatattccatgcgtactgaagagagtgtatattctgctctctttggaagtgttctatcagtgtctgttagatgtagttcgtttacagtgttgtttgagttttctattttcttgttgatctctgtctagtttttctgttcattatttaaagtggagtattgaaattttcaaccattgttgaaatatctatttctccctttatttctgcaatttttacttcacgtattttggtgctctgttactaggtgcatatatgtttataattattttgtatttccgatggatccaatcttttatcactgaaaaaggtccctttttttctctaataatattttttaacatctgtcttgtctgatattagtatagtcacttcagctttattatggttgatggttgcataacgtcctttttcatccttttgctttcaacctatttgtgtatttgattctaaactgtttcctgtgaacaatagatagttaaaacatttttttaaatccagtctgacagtctcttccctttgaatggattgttttatctatttacattgatatgattggatttacatctgccattttactttttttatgtgtttttttttgcactaaatgaatattttttaatgtagcatttaaatttctttaatgatttgttttaccctgaaacctccgcctc

SEQ ID NO: 988 - DNA, 1050 bp, Homo sapiens
atgaaacagaatagagagcccagaaataaggctgcatatctacaactatctgatgttcaacaagctgacaaaaacaagcaatggggaaagaactccctatttaataaatggtgcttggatcactggctagccatatgcagaagattaaaactagaatctttccttataccatatgcaaaaatcaactcaagatggattaaagacaattttaaaatctaaaactataaaaatcctggaagacaacataggcaataccattctggacatagggatgggcaaagatttcatgatgaagatgccaaaagcaactccaacaaaaccaaaattgaccaatgggaccaaattaaacaaaagagcttctgcacagcaaaagaaactatcaacagagtgaacagacaacctacaaaatgggaaaacattttttgcaaactatgcatctgacaaaggtctaatatccagcttctagaaagaacttaaatatataagagaaaaacaaacaaccccactaaaaagtgggcaaaggacatgaatagacacttttcaaagaagatatacttgtggccaataagcatatgaaaaaaagctcatcactgatcattagagaaatgcaaatcaaaaccacaatgagataccatcttacaccagttagaatggctattattaaaaagtcaaaacataacagatgctggcaaggttgtggagaaaaaggaacgtttatacactgttggtgggagtgtaaattagttcaaccattgtggaaaacaagatagtatggtgcttcctcaaagacctaaaggcagaactaccatttggctcagcaatctcattactgggtatatgcccaaaggaatataattgttctctcataaagacatatatgtacatgtatgttcactgcagcactattcacaatagcacagacatggaatctatctaaatgccaatcaacggtatactggataaaatgtagcacacatataccatataatactatgcagccataaaacagaatgagattatgtcctttgcaggaacatggatggagatgga

SEQ ID NO: 989 - DNA, 1061 bp, Homo sapiens
gtgacttggttccaaaaggtagaaagcagaacatgcagtcttcctaacacttagatccagaatgccagtctagctgcatttaaaggaagtcagaagactaggccaatctcaagcagagaggaaatagactccatttcttgatggagagagtgacagacatggacaaggatggaaagaagtgttgacagccgtatttagagaccatctatctctgtcctctgccacaacaattcacatctcccttcacctgaaaatacattcatatctccttcaaaagtgacgtcccattatggaaccagctccaagtccaggattctgtcacttcagtcaagcccagatatggataaagatactcagggtctaaaggataaacttgggtagagtttgcaacataaaatataaggccttgcttggcatgtgactgggtagcaggcagagacctgaatggtaagtgaggtgattgctagtggaggaaaatggacactggggaaattgctatggaaaagtggagaaagggtagatcatgtcgtgtattggcagaaaaatttgtgagactgttgcctaaagttactgggaagacagataaaagtatctaaagaactctggatctggctgggtaagtttctaggcaaatttttgaaaatggctttttaagctgcctatgagaaagtaatgcaaaagacagatgaactaaagaagaaaattttcaattttcaagcagaattgagaagaaatgtttttaacccaggtattgctgggatggaaaaggacactatttatcattcttaatttttcagatcaacaaaaggcttccaaagtaagaagtagcttcagagaaaaggtgaaactgaggctctgacaataatgtgtggcctcagcattaagaacaaagtaatggtatagaatgttaaaaactgaaagattgaaggacagtgcttggtagaaaaatgcaaccaggcaaaagccttctagggattttaaagatattatcttggggcatcctgaatctcaacttaaagtggaaagaggcctgccttaaagagatttgtgattgtggcatt

SEQ ID NO: 990 - DNA, 1031 bp, Homo sapiens
ggatgcaggacgtgtttcggattcgacgtggaaagagggagggaagcacattagcattaaggtaatcatggcaccctggctcgtggactattagattggctaccagtggtctctaatcttactgtttgcagagtcaagaatgggggcgggggttgggggactgtatagattgccttttaaaatagtgtgacttcataataacggagatggctgaaagattgcttccttacactacttctcggccatcagggctgaataaaggacccgcctccgccctctactccggctcttctctggctgtctcttccccatcaagtcataaagcgagcgggttgggcgagagggcacagctcgaggcagagaagagacggggtcactttcacaactcccaggaatcggcttcagaaaggaaccatctgcgactcccacgttcctttcgaagttctccttcaaaaggaattacaaaaaaaaaaaaaaaaaaaaaagcgatgggggtggggatcggtaagacacaggggtcctccccctgctcttttcaattactttcccaatactctttcaacacatcgaatttacctgcagtggtaactgggtcagcaggtaaatagatttgtatctgtatatgtcgaaatgtggctctcctggtggatgaaaagcaattttttgtgagcatattctaacctaggcgaaatttctaagcacaatagagatttttatagcgtgggcgagaagagtgcattccagcgaaagcaggacacgtgatccctccaacgggtgagatacagtattaggaactcgattttctttgttccagcctgagcctatgagatgttcagcatcctggttgcttaagtcctcctatagaaggaaaataataataataataataataaagttgatcggaggcgaaatagagggaaaataagcacaggtagacatgcgtgaacggtttgaaagcttcgcctctgcctttttttaccgcccacccttcacccccaccccttgctccagccagccccctattttaaaat

SEQ ID NO: 991 - DNA, 1033 bp, Homo sapiens
cagggatgaagcattgaaatgtctattaacattgacatgatgtgtttaaatattttaacaatggagcagttgtttacattgtttaaataattcatttataggcttcttaaagatgcagtttcttcagttgtgccaggatatttttgctgtacacgaagttcagtaaggttgaaagcatacttaacacaaggggataggtatgcccaaggtagtatcataacaaatggcttaagttaaaaacagtggaactctaggatacttgtgtgtgtggcggggtgggtcagatgagggagatatttaaatgttgtagtactcaagaggtaaagtagtatgagaacaagtgagaagctattgatttcaattatagaaaagaggtagctgaccttaaaacaaaacaatagcataaatactatcattatcatcatgaaattttcataggtaaaaagaaatggtattgtgaaaagcagaaaaacagagctaacagaggaaaatatgggacaaacaattggaaaagagctgctagacaagtcactgagaaactacaggattttatgttattatattgaaaaagataagaatactctggtgtagtggcaaaatactttatagatgcttggctgtattgtcaatttattcaatactggaaggaaaggtaagaaatgaactttattaagatagtgcctaagtattatgaagacatttgttgcactaaaaaggtaggtaatggacacaaagctaaaatatgccagctgaacttaaagaattaatatgtcacagatggcgtaactaaaacaattaaaaattgcaaataatagacttataaatactaactacttaagtgttctgcatcaaaagtattcatcattgcagttcttaccaccagtaggcaccttacagaatcatgttggatggaaatataccttggaccacatattttgagcactcataaaattaaatagttactatccggtgttcttctgatcagtgtaattcaagacatgaaaaaaatttcttccctatatcaagtgtgatt

SEQ ID NO: 992 - DNA, 1076 bp, Homo sapiens
tacatttagatttatagaaaaattgcaaagatattacagggtgttcccatataaccctacacccaatttcctctttattatcatgtattagtataatacatttgtcacaattaatgaactattattgagatattattaactaaagtccatattttattcagacttccttagtttttacctagcatccttttttatgtcccagagaatcatccaggatatccgggataccacattgcccttagtcatcttgttgccataggctcctcttggctctgacaggttttcaatgttgcttatttgtaatgaccttgacagttgagatgtgtagtgcacaggtgtttttttagaatagtccttaactgggattgtgttatttttgttctcataattagactaggcttttgagaggaaggcaagagagataaagtaccatctatatcagtatggactcattgatgttgactttatattttgagttataatccaatactactttgtctattgtatagcacaccttgttctagctttcactattcactgctcttcatttggctcctatgcccctttgactttccccatgcttttttcttataataactttcttgcttcatggacagtacaagatactccaggcttatcttgtatttattttctgctccaattttagaattagccatttctccaaggatctctggtttcttttttttttttttttttttttttttttgagacagagtttctcttttgtcactcaggctggagtgcaatcgcacgctctcggctcactccaacctctgcctcccgggttcaagctattcccctgcctcaacctcctgagtagctggaattacaggcaggcacctgccactatgcccggctaatttttgtacttttagtagagacggggtttcgccatgctggccaggctggtcttgaacttctgacctcaggtgatccgcctgcctcagcctcccaaagtgctgggattacaggcatgagccaccgtgcctcgcccctggttctttttattaaagaattgtattaaaaaccaagatcaggacactaggtgtactatt

SEQ ID NO: 993 - DNA, 1063 bp, Homo sapiens
acttcttctttttggcttttgggttacatgctttaaaaatcactccttttgaggaaattgtgtacattgactgcctgcacttctttttttcatttttttttattgaaccttaatagaagtacatattttcagagtacctgtgataattttatacatccatataatgtgtacagatcaaatcagggtaattggaatgtctatcaccttaaatatcttttctttatgtctgcacttttcgaaaccctattataccttaattcactgcaatgtggatttctgtcttcactggtcgacttaacttgcccttaccaaggctgcaaatgaccaaagtaagcacattttctatgaaatttttttttctgctgttttacatgataccatatcctacccattttggtccttgctttctgactactactcagtctttacacgccttgaactcaaatcatctcattgttgatattcttcagagttttgccataggacagcatctctcctcattttttaaaactctgacttgtagctacaaggtttatctcaaggtgtgatgtcatcttgatgattgtggatgggggtgatgttctagttttgtttgacatcattatggccagggccccagggaggccaaggtcctcccccgacagtcgcttctttcccctctccgtaaagccccatgagagcttttttggcaagagttgccaaaaagtaaagagaaaatgccattttgttatcaaaggtgggctggtgtgagataaccctcaatgcagagctctgttcaattagataatagtgaagtgtttaggcttcttctaccacttttcctaaaagcccgatctctacctttggatcttactacactctagctggctgcttgataaactcaaactcataatcatcctgctcagtgtgttcagagtctgttttcaactctcttgccagagtatacatcttaatcttaaatctgatcatgtctgtttcctactcatatcactccaaagcctcccttgttgacttaaggtttaaataaaaacctttatcatgtcttacaagactttctgattta

SEQ ID NO: 994 - DNA, 1480 bp, Homo sapiens
gatcataaaagatataaatatttatatctgactggatttaatttgctaatattttattcatgatgtttcaactttgtttatgaatgaaattagactctaattttcttctctcatattgcccttgttgtgttctttggtataaaagttacagtgacttcgtattagttgggaaactctctcttcacttccttcgccttcacccttctctctttctctctctctctctcttcccctcccccgctcccccgcacacagagtttatataaggtgggttaactaaacacctagattcagtgcggggatttagggtggcatttgtttcattttgaggaggtaggttttaaactactgaataaatgtctttaatagctctaaataaatttaggtggttttctaattcttctttgagtttgtttcacgtcaatgtctcacactgtttttatattttccataaaaagtattattgtctttacatattcatattaaaaataattttgtcctaagtcttggggttaattctacataaatatttgagcattgcagagttggaaaaaagagtagcaatacaagactgctagttagaagacctgatctcttatcacatcccacaacccacttatcacaactaaacatggaggctttggcaagatatttaatcttaccagttctatttctacctaaaattttggaaaattgactggatttttggggaattaaatgaggtaatttatttaaaagtcaaatagtattcctcagggttatgaaatacacgttaatcttcttttcctttcttttctttcatgactatttgtaagcatctattctgttaaatagctttaccttatgtaatccatctccctgtaactaatatattttacttaattacacagaatcattttaatatgtcaactgttgattttctaaaggacaaagaatgttttttaaagataagcagagacttgatgaagcaaagctgaatttcttaagcctagtgcagtaaaagaaaatgccaccttgagataatcttagtattagtccagaatagaaaggtgacacatttttagggtttaagagcctcgcctgagattttaaggccagttttgcaaagagagagaaagggtgggattggagggcacaatgaagtgagtcttgatgagcaatatgttagtgtcaagaaaagaaattttgggttagtttacagaattatctttcagaagcaaatatttcttagagaatagccaagtttattttgtttgttctcaattttaatataaagatgggaaagtatgcactgtctcaatgttgcttaatttaaatacaagaaagtaatccagctctcagtagcgtttaacactatgtcaaaaattatattcattttagtactaaatattaatcattcatttggtcatttctaaccctgtgcctgaatacagactattattgtctgggaataattaattcagatctgtacttctgtttg

SEQ ID NO: 995 - DNA, 1037 bp, Homo sapiens
aattgtctcaaaataccaaaaatgggaaaggcatacagctgatttttttatcattctgacagtaaataatttgccagaagtccttccgacttctttcttgttttcctttgtgttttactggacagttgtcagaaattattaataagagaatttggaaattaaaaccttcattttcatgactattcatttcatatgatattagagactcttctattttttacaagttacagtggtagaaaaatatcttagtccttttgggttgttataacaaaatgccatagactgagtgacttataaacaatcagcgtttatttcttacagttctggaggctgagaagttcaagatcaaagtgccagcagattcagtgtctaatgaggtccccttcttcatcggcagctgtgctctcactgtaacctcacatggtagaaggagcaagagagtctctggggtcgtttttatatggacattaatcccatttttgagagttctgctgtcatgaattcaatatctcccaaaggccccttctcctaatactttactttggaggttaaaatttcaacatataaattttggagatgaaaacattccattcactgcaagtaggactcaaggctagcaaagacacagaagtcaaggaagcagtggttaaaaccacatgttctggagttgaattgtctagtttaaaatctagcactatcttctatgactgtttaaaattgagcacattccttcatttttcattgcttctttttcctcatctgtgaaaaaaatggatataattgtactcatctcttaatattgtctaagtgttgggaataaagcagcaaacaaaactgataaaacttgtgcctttcaggagaatcgcttgaacccagcaggcggaggttgcagtgaaccaagatcacaccactgcactccagactgggcgacagaacgagactccatctcaaaaaacacatgaaaacctatgtctttgtgaatgagttatttggggctattcatatggaatataaatgtgacagcagtttgagagatg

SEQ ID NO: 996 - DNA, 1053 bp, Homo sapiens
aataaatccttttcaactgttactataaataattagacatttatttggttcatatatttagtttttttaaagtgtgataagcttatactattacaaatacagttacccttgaacaacataagggtttggggcaccaatcctcccaagcaatcacaaaaccaaatataacttttgactccacaaaagcttaactactaatacccgctgtttactggacaattaatatatatacatgttttatatatatatgtatattacagagtatattagacactgtattcttatgatatggccagaaaaaagacaatgttatttaaaaaatcgtaaagaagagaaaaatatatatactgttcattaagtcaaagtggatcatcataaaggtcttcatccttgtcttcacattgagtagggggaggaggaggaagagaagaggttgctctttccatcttggaggtggcaaaggtggaagaaaatccacgtttaagtgggcccgtacaattcaaacctgtgttgttcaagggtcaactgtactaactccaaacaacttccaagttcatatcctactgaaagtatatcagtcattctgttaggaagccaaagagaaattttaaataatataatattgtccatgaagaataacctaaaattgaaaaccaattgttacaggttagaggtggcatttatatgggcagaaattgaaaatctaaagaatgaaattgatgacaagattcttcagattctgtataggtacgaaatgccaacatacactcaaggtgcctaaacgtttttaatatgattagaggaagttattggaactctggggtgagccagaaatagtcaacacaggaaagagagattggaggcaagaagggaacttgtcaaaccgtgtttgtctctcaaggccatgatggccagagagagactacaaccagcttcacactccaggctcctgtccagacctgtgctgctctggggagccccacatgacccagcagcttggtttctgtgccctgagtgttccgataccaggaaatcaagttttgatgctgccat

SEQ ID NO: 997 - DNA, 1030 bp, Homo sapiens
gttcaaatttaacttatcatcctgtatttttatttgctaaatctagcaaccctaggccaatctggtcattttaaatctttttccatttctatgcaacaaattttgtaagataggtagtaaaaacatggttaatttatcaagcaagtatttatttaatatccattctactacacagtacttgaagctttagggaggttacaagagaaataaatctcgatctctgcccttccggatctgacaacctaattacagagaaaaactgaagcattagaggcaagtgctcggtgatgtataatcggagccaaagagccaagtaccattgtagagcgtatgtatagagaagagctccatttttggagaagtaagggaagaacttgaccaaaaagcacagatggaaaatttaagatgcatcaagagttgaagggagcagagttgtgaagagtctggaactgcaggtgcatggatgtggatgggggcaatatgtagggagactgggggaggactcaggttatgaaagttcttgaaagtcacatagtattgtttggcttaatgcattgataagataattccattgaaaagtcttatacatcaaggaactcactaggatcctaagtaggcttggaagagaaattttaagatattttgtctgtttggttagttaaaataattgactaacaataattaaaaataatataagtacaccaaagacttaatatattttaccagtgcattatagttaaggagaatttattatcctttatcattgacctgccttatatatttcaaagaaattttacataatctttaaaggtttctgtgagtttcaaggttgaattttttttactttcataaaacagccatgtaagctagtttcccttaaagtatctgatatattgaaatatgatctaatgatctgatattgaggtatgatccaaacagtacatagatgtatttgtgcattataggaaaaaaataggaaatacaaaaatgaaaggaataatgcatcagagttcattatatgtgtttcaag

SEQ ID NO: 998 - DNA, 1077 bp, Homo sapiens
agctaatgggataaacagactttgattttagggcagtgaagactctctgcatgatggataatgatactatatatataaataaatgtatatatatataaaagaacaagctgtgtgtgatatatatttactctgctatgtataatatttatatataaatatatattataaaatgtatatatacatatatttatatatatggtgtacatttgtccaaatccgtcaaatatatattataatccatccatgatggatacatgtcattatacatttgtccaaacccatcaaatgtacactgagagtgaaccctaatgtaaactgtggactttgggtgactataatgtgtagatgtagtttatcagttgaaacaatgtaccactcaggccgggaatgtgaatattagggaaagctatgcatgtgttcgggtggggagtatatgagaaatctctgtgctttcctctcaattttgctgtaaacctaaaactgctttaaaaaaaaaaaaaaaaaaaaaaaagactgcgcactggccagaatatgcctgccacttagttgttacgaggaagggacaaactcaaaaacaaagaacccactaagtaggaaatctgacaaaaatttccaggcctaatgtcatgactggcctcaggccaagaactctctgatgaatgaaattggagtctcagaagacagcagcaaagacggtttctgagaggctactgaaaggaccctctctcgagaaaccacatctccaaacccctaggagtgggaagtggtcctgccaagcacggttcctagaggggcccaggggtccgctgtggcctcggtaggaatgagagatttctcagcgctggttggaaatactgcagaacatccaggcggggtggcacatgcctgtagtcccagctactcaggagactgaggcaggaggatttcttgaccccaggagttctaggctgtagtgtattatgctgatcgggtggcaacactaagtttggcatcaatatggtgaccttcctggagcggggaccactcggttttctaaggaggggtgaaccaactcaggtcggaaacggagcaggtcaa

SEQ ID NO: 999 - DNA, 1047 bp, Homo sapiens
cattgatctatatctctgttttggtaccagtaccatgctgttttggttactgtagccttgtagtatagtttgaagtcaggtagtgtgatgcctccagctttgttcttttggcttaggattgccttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcttcttttatttcattgagcagtggtttgtagttctccttgaagaggtccttcacatcccttgtaagttggattcctaggtattttattctctttgaagcaattgtgaatgggagttcactcatgatttggctctctgtttgtatgttgttggtgtataagaatgcttgtgatttttgtacattgattttgtatcctgagactttgctgaagttgcttatcaccttaaggcgattttgggctgagacaatggggttttctagatatacaatcatgtcgtctgcaaacagggacaatttgacttcctcttttcctaattgaatagcctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcataggtagctcttattattttgaaatacgtcccatcaatacctaatttattgagaatttttagcatgaagggtttttgaattttgtcaaaggctttttctgcatctattgagataatcatgtggtttttgtctttggctctgtttatatgctggattacatttattgatttgtgtatattgaaccagccttgcatcacagggatgaagcccacttgatcatggtgggtaagctttttgatgtgctgctggatt

SEQ ID NO: 1000 - DNA, 1118 bp, Homo sapiens
gtagactggagctgttcctattcggccttcttggctccaccctgttgtaagttctttgagaaattgccaaactgctttccacaatgactaatctaagttatttccccatcaacagtgtttaagtgttcccttttctccacaacctcaccatcatctgtgattttctgacttttagtaatagccattctgactggtgtgagatggtatcttatctgactggttgttttgatttgcatgcttcctccctcttaaatcatggagggaaatcttcctcacaatctcctccagcagagtcctcttcctgtcccagtggccagaactaggtcataagttcatgtcctagttgcaaaagaaatttggatgatgactatatgacatttctcatctctgatgcagggcaggttctgctggcaagtaagaaaggtagttgcatgggaaatagccatggctactttggcagattacttttaaaggtccttagcctctaaagtttaaattctctgacagcttagtcacggagttatgcctatttgatacacccgtcagggtatcaacaatctaaggccaaactctgtaaaagcacggttagacctctgcagatagaaaatatttgaaaaaaaaaaaactacaataattttaaaaatacaagtaagaaaacaacacagtataacaaatctttacaaagcatttacattgtatcatgtatttacattgtattaggtatttaaagcatacaggaggatgtgtgtaggttaggtgcaactactatgccattttgcagaaactagagtatcagtggattttttatatccatgaaggtcatggaaccaattcccccaaggatactgagcaacgattgtacataaatattaatactcagaaagcccaatataacaagtaataactttttcaataaaatatagccagaaaacaatgagcctgacacattgtgtgtccttgtatatgcacacatgcatatgtatgtgttaaaggggtcttttagaaaagaaactttgtggtggtggtggtccttgcccagttatctacaagagttttaaaacagcttaacttggcttaactattttttcagtaacattcaacatctcttcataagcata

SEQ ID NO: 1001 - DNA, 1056 bp, Homo sapiens
ttttttccttcatttcaactttggtgaatctgacaattatgtttcttggagttgctcttcttggggagtatctttgtggcgttctctgtatttcctgaatctgaatgttggcctgccttgctagattggggaagttctcctggataatatcctgcagagtgttttccaacttggttccattctccccgtcactttcaggtacaccagtcagacatagatttggtcttttcacatagtcccatatttcttggaggctttgttcatttctttttattcctttttctgtaaacttcccttctcacttcatttcattcatttcatcttccatcactgataccctttcttccagttgattgcatcggctcttgaggcttctgcattcttcacgtagttctcgagccttggctttcagctccatcagctcctttaaggacttctctgtattggttattctagttatacattcatctaaatttttttcaaaatttttaacttctttgcctttggtttgaatttcctcctgtcgttcggagtagtttgatcatctgaagccttcttctctcaactcatcaaagtcatacgccgtccagctttgttccattgctggtgaggaactgcattcctttggaggaggagaggcgctctgctttttagaggttccagtttttctgctctgttttttccccatctttgtggttttatctacttttggtctttgatgatggtgatgtacagatgggtttttgctgtggatattttttctctttgttttccttctaccagacaggaccctcagctgcaggtctgttggagtttgctagaggtccacacgagaccctgtttgcctgggtatcagcagcggtggctgcacaacagcggattttcgtgaaccgtgaatgctgctgtctgatcgttcctctggaagttttgtctcagaggagtacccggccgtgtgaggtgtcagtctgcccctactgtggggtgcctcccagttaggctgctcgggggtcaggagtcagggacccacttgaggaggcagtctgcccgttctcagat

SEQ ID NO: 1002 - DNA, 1038 bp, Homo sapiens
gtgggagagaaccctgtaagacattttaaggatttaggattttattctgagtaaaatgggaagctctttggaagggtttgagcaagtagaacctcgatctaactcacatcaaattatgttactttatattacattaggtcatattaattaattacattatcaagaccactttactatgttgagaatagacgggtcaggcagtgtcaaggtagagtcagggaaaacagttagaaagttattgcagtaatctaggcaggaaatattagcatgctggattagggtagtagcaatggaggtggtaagaaaccaatttctgggtaaatctttaaactatagctagaagaagatatggtaggatctgaattttgtaaattgaggacacctatcaaaaactaatacaaaattagaaatacataattagatacaaaaaagaatgttattcagaataaaaaaaagaaactacaaattttaaattacaaataaaaatcataaaatataattttgaaagctgacaaaatgccacaaacatcataaaatcgtggaaaataacataatagcacacatctataatgcttccttcccccttacattttggtttcatgctctttgacagcctttccatgtgacaaacatcgtgtagtattttctttggagattatagaaaaacaatccagtctttcctctaacatgatttttaatattgatagtttggaaatgcttacaattttcattgatatgccttgcagaattttaggactgttgtcaaatttgggaaaacatttgcctccatacattctaaaccttctttttcctccaccacctacgtacttatagtgccaggaaccaaagaacaggtttatgtctcaatacatgctctggccctgcaccttcatgtcctgatggtcaggtgagtgggcacagtgggcagtaggaggatttccagaagccatttctaaataaaatggctagctagcacaagttaagtacacacagaaattattgcaaatcatataaacacattccacaaaacccgtatga

SEQ ID NO: 1003 - DNA, 1050 bp, Homo sapiens
ataaattaataataataaataaaagatagttagaaatatagatttgaaacttagtaaatgtgactgagctagataaatatttgagaatcactgatgaaattgaccctatgaaaatggataaaaacagaaaataaaatgtacagaatcagaagaaaaaggggttctggaaaataacataacaaatacataaaagttttacaaagtttaagatgttatataatataactaattattatcactgtttctgaacaattgaaccaaactactagatctaatttaacttccacaaaatcaaggaatttgtccccctggttcaccagtatattctagaacttatagaatattgtcaaacatatgatatgtttttagtaaatatttattccttgcccaaatgcatttattgaatgccttagacatatgtatttattatatgggtggattaggagtcatgacatttccccatgagagttctaacaattctcttccacagccacactgttgaatttgtaaagccagatcgttaactctgaaaaaaaagtcttccttaaatttatagcccaattaatactacagaaatcggtcattacttaaatgttcaaacagttggctttgcagggtaattattattttttccattccaagtacacatttttgtcttatgttaataagacaaatacaaatttaagaaaatgtttacagttaatgtggagaaaatgaaaaagaagcatacatctatagtaagattcccaatgaactagaactgcattcttcatgttcaggcacctccagtgtcttcacagcatgactagaatattgttaacagtgacaatcttctagttagtgccaacaaaatagagaaaaccctagtggtgcgtggtcctcctacatgctgtgggagccctcctttggagaacaaaacaacctccattaatcagtcaacagaaattttttgaactcctactgtttgccaggcattgcactacattccagagggcttataaagaaatgtgaagcctgcccatgccttcaggaaaagtatgtttgtaggag

SEQ ID NO: 1004 - DNA, 1047 bp, Homo sapiens
catctattgttcactgatttatttaaaaatcatgtaccaataaagctctatgaatcagaaactatgctaatgtcagggttacaaagataatacattcaatgaccttgaatatatttgtttgagaagctcgcacatagcaggataaacagatctggatttcactactcatagaagagcctgatttgtgctatagtcaaggtatgtacaaatcctgaggcaacacgagacacttaccaatccctgtgcaaagattgaagaatcagaatatatgccagctaaaagtttatacctcttcttcaatatatttatttattaaaaattacatagcatttaccacgggctaagcattctctctgtgttgtacaaatgttgattcattgaatccctacaacaatcctatgaagtaagttctactaccatccccattttatagatgaggaaactaaaatacaaaaaaagtaactggcccaagataacacagccagtaccccagggagctgtaattcaaaccagcgccagaggctgctgttgactgtaaagctcccaaaggctctctatggaaccaatagaaggtacaaatgagaattttacttttcacaattgttacattcccaaaatccactgtgcaaatcaactcacatgccaaatttctcaataagtttgttatttaagtggaaaggcagggatgaaatcttccataaaacatataatgctgcctaatttgtctgtctcgagagtagatgtttcatatgtactgctagctttatatagattccttactttattttgtatacttgcacttggtaatttgttatacgctgtgtgggaataccctacacctccctgccagaaatagccatggctttctggatgttggcgctggcaaagaattgcttttcagttaccccaaaatacttggctttgaatggttcatcttgagtgtggtctccagcctatgtctgtcagtttcacagaataattaaaacatttaatatcattagccatggggaaaagaagcacattcatttttttcttagttcatgtatc

SEQ ID NO: 1005 - DNA, 1045 bp, Homo sapiens
cttagtgagtataatcatcatgacccactatcaccagcccctcagtcactgatttttcccctcagagtgctactcagtgaatttcttccctgatgtattcccttgcatatcagataaataaaatctgctttgttttttgagctgtggtgttctgtatttaatttattgatacccaagataatacagttagtaagttacaaagctgggacacaaatccattctgacttcaacccatatgcttaatttctgtgttcaattgttaaataaataatggaagcaaattgcattcaagctaactagttttaacataaaaaaggatgctgaccaggcacagtggctcacgcctgtaatcccagcactttgggaggctgaggaaggtagattacttgaggtcaggagtttgagaccagcctggccaacatggcaaaaccccatctctactaaaaatacaaaaattagctgggcgtggtggcaggagcctatatcccagctacttgggaggctgagacaggagcatcacttgaacccaggaagtgggggttgcagtgagctgagtttgtgccactgcactccagcctggatgacagagcaagactacatctcaacaaaagaaaaaaaaaggattctaattctacaaccttactccacctaactcaaattcatttttccctttacattggtagaatcttcacccctgggggttccttcctattataataatagcaatataataggaatagtaagaacagtttaataataatttcaacaataccaacgccaactgcaatgtatctggtgcttactctgtgccaggcccttttttcccagctatctcaaaccaggcattgaagtgtcttgttgccttgtgataatttcaatgtacatctatacaattcctttctgtagatctgaagtaaagccggctaagtatggactggtagggattgtgacaaactggaggcacactgaagaattatgcccatttgaaggcagcagctattaatccatttccattacttgtcatggaagaatacagaccccgtat

SEQ ID NO: 1006 - DNA, 1059 bp, Homo sapiens
tacatttttaattatcatcagaattgatttagattttctcaacatcacattttcatgttggcatggcaacatcttgaatctctcatttactttttataacattgtatgtgtactttttctatcatggctactaacagctctcactcttagtgactaattacctttataattgcatatgtgttctattaataaagctagattgtgtgttatgtttgtctctgtcctctcctttccacattttctaaactttatttcttaaatcagcacatgagcacttactggcaaggcctaccaatatcgttacggagaacccaaaatggattcccaaatccaaaataacaattttgttaaagatttgggttttaaaaaaaatgtctctagatagttgattagtgctgtctaacaaccaaagagacatctttttgaacttgtgaattcctagaaaaaataatgctaaactgaaaacataccttcagaacatttcagttcttttacggattttgtatgttaaatccagaaccaatggatgatgcattctataccggacttctgattcatctttatatttcattgaattaccaaaaattgcatgcttcttcctgaaattctgtattcaaagaatgcaagaagaaagtgcatttaatatactctggtatatgtgtcaatgaaaacgtaaaatatagtaaatacttacagttatttagaagccctgtttgtgtgttatgtgttcaagtttgtttataatcagagtaggttcattatactttagagtgttttttctctgtatttacatttggtttatttatgtattaatgaaacaatgtgtgtttcaaaatctcaaactactcagttttgactaatttgaatatttccaatgccattggctattggacaaattagagcacaaacgaacttctaaataaatcatcatggaagtatgatgaatagaatatattgtaatcttacactaaatcacacttttctggttcattacatgtacattaaattcagcaccattttacctttaatttacatgaaatttaaaaaggaaccattgac

SEQ ID NO: 1007 - DNA, 1034 bp, Homo sapiens
tattggaatatgaaacattatcactttggtaacaaattttcctgcaaagctgaatatgcacatactcgacattccatcaattctcctcttaaggtattaaactagaaaaattatcatacatgtcattcagggtacttgaaatgtttccaataccagaaaactgggaaaagccaaatgtttaccaccaggagagtatgtaaataaattctgttaattacacaaaggaatatttcaaagcaataaaaattagtaaactataattacaataatgtgtattaactttagaaacataatttgaatggaagaaaaagtttctggaaatggcatacatatgtaataccatgtttacaaatcccaaaacaagcaaaactcaaaatatattatttaagcataagtacataagaaacctattgttataagtaaatggtaaatgtagtattcagaattgtggttatctctaaaggtaaagtaggggatggaatcagggagaaagtggatattattgctggaactgttctaattctgaaattgaattatggttctttacactctactttttttttttttttttttttttttttttttgagacggagtcttgctctgtcgcctaggctggagcgcagtggcgcgatctctgctcacttgctcactgcaatctccacctcccaggttcacgccattctcctgcctcagcctcccgagtagctgggactacaggggcctgccaccatgcctggccaatttttagtagagacagggtttcaccgtgttagccaggatggtgtagatctcctgacctcctgatccacccgcctcagcctcccaaagtgctgggtttacaggcatgaaccaccgctcccggcctacactctactttctaagctcatgagtgttcattttataattgtgctttgtaacctacatatgtattacatacttacactctttgttacttaagtgatttttctcttgatgaccacttcaatacttcaaaaatgcattaaatatcaaattttattttatccaaaatatt

SEQ ID NO: 1008 - DNA, 1070 bp, Homo sapiens
gagtaggaaaaaaaatatgagtcactttaaggttgccaagtataaagaatacaatttgagcacgggggcagtactttttttcctaaagaactatttattaaaaatatcatatttgggagtcatttcttttaataagataacaataaaaagtgttaaaagaattggtagaggtcagttttaagaagtgttaagtgcttgctatttcccagggcattgtgttgggtgttaataatataagatgatagcattaaaagagctttgtaatttattgatggaaacatggatgtcagcaaagaaatgtgaagtgccatagcttactaaacctgctaaagtacttgacagtgaggcacacctgcagccccatctattggggaagctggagtgggaggctgggtaacatagtaagacccctcccatttctttaaggagaaattgcttaaacattctttttactactgcgggtgcaacattgttaaattttatagcagcagtgtttcacatctaaaaaccactgtattctttaagaaacattcaacagtaagcctgtataacaaggtggcttaacttgcttgtggatatcctgttaattttgctttgaacttgggttagggtctgtgtttagcctgagaggtccttgtagggaagcttgtatcagaagttctaatgggtttgagttctcaggccatatatagcatcatgttagtgtttgagttgtgataaaaattatggggttttttgttaggcctaaattaaaagaaattatttttcttttcaacaatgaatctgaaattcttagtataaccaaatctgatgcatttacaattttatgtacacattggtgtgtttcattttttagaaactgtgaagcctcattcagatagtattaaaatacaggattttccttttcattaatgagtcctatgatgtaagtgttatattgatgttaaaatgaagtagttttgtaccctgggtgcataaaattgtcagagagaattaaaggagaaagaactcaaacttcatcagagatcttgatttaattcatgtgaagagtgtggattacccccaacccc

SEQ ID NO: 1009 - DNA, 1170 bp, Homo sapiens
taactacctatgtgggcatcctaagatgaccatctacctcagtagatgtagagtgagcattagtagcatgttaaatctaagctattaacatttttaaacccttgttatactgcagtccgtaatttttgcttgcagattttttttaattctaaaaattagaaattaggtctgttattataaggtatttaccttttgttttcttttaaaacatttttaagttgtttaaaaccatgtcccttattgtaactccctgagatacatctacttagttaatttaatgttaagttttatgaaaaagccctgaaggtaaatgattcactccatgtatgcttacagagccttcaaataaatgcatgatgttatttctgttttaaataaatgagtaggttgattttattttcttaaagcttcctcacattgataatctggaaaaaaaaaaaacacattgaatttcagtataccaagggttgcagtgattttggttttcgtgaaagttcaagatttcctgtagcttaggtgccaaatgggcactgggtgttttattttatgccagattttcttgttcattcttgctatatttctagaatatctctaaataataaattcttctctctgttatttgtgtgtgtgatttttatagtggagaaggcaaatgcaaaacccttccagatgcctgaaaaacagtgggtcctctgcagctacaggggattctagacattaactaaaggccagcaagcactcaagtgccccaagtgttttcctggtgtaaccatttgttaactacattttctctctttttacattttaggctgttaaagtaatttgacagaaaaaaatgagcaggttttttggatctaaaaagccactgtgacaagaaattttaataccattttgtaaaattttctaaggcgtattttataattagtttgttcccaatgtactgctacttgatttgcattttggtaactataaattttactcgaatcactgaaatatgataaaactgctggattttaagttaataatttaatatgctgaccaggatttaaatgctttcccctttccttaataaactggtcagtggaagtggaatcttaatattgttcattttagatgctatctgaaatctttgaaaacaaatgtgagcatttacaccataccttgtaaaag

SEQ ID NO: 1010 - DNA, 1023 bp, Homo sapiens
tagaacagtagacatagtctacggtaaggaatagtcttaattggtaaaactaagatagctgaatttggaaggaactcttaatagtaatggatttggggattttttaggttccttggttaatgtttgtttcttttgtctgtttctttttctttcatttctacacattcatgcagtatttcatggttctatcaaagcagcagtaaaaaaaatactcttgacgcatgaaaattaactggtgaggggcctcattgctatttttaaattgtagttttatttttaaatagtctttttttaatcagaggatcagatgcatgacttttttttttttaatggatgcagatcttctatcaggtgtctcacaataaattcaagaggattttagtttgccagaaatgttgcaaatgcactaatttgagtaagatgttgatactgaatatatcctcttgagacataattttgcatgcaaaattatcccataatctttgtaggtttgttaatattgatgcattactgccctatatctaaatgatcttctcccccttcccctccataactcttggtatctaaattgatgacagctctgacacaagcaagataacagtgctgtgtagtatacatttgtttatattatcggcacttctcagtataggtggaaggaaccattacctttatttaacagtggtttttcttttttgttgttgtgttttacagttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaatatttgttttaggacccttagat

SEQ ID NO: 1011 - DNA, 1808 bp, Homo sapiens
tttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaaaagtagtgtgtattgtgctatttttttttactctagaaacttaaccatttgtagagaaaaaggaaacaaattttcacacattgaagttcattctgacataaaattaatgataaataatcatagaaatcaagctttgtattttagcgaacataagtactttcaacaaactcaggtggtgtatcagggagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggtggtggactcctgcctactcctaacccacttacccaggtactagttctattgaattcttaaagggtggggaaaaaaacagaattgtgcataaagctaaacatatttgaactttgtaagtactcataagattctagttcagatagcattatcacatgtctatatcaaaatcacaaatagtatagaagatctcttagacttttgtattttaagaacattctgaaaaatcataaaatatctgttctgtcacttttaccattggctctcaaaataacccatgagtagttttggaacagtctcctgaggcatgaacacttctctgaacacactgttaaaaatatattcatttggaccaggaaagaaaactgaagttaaaatttcacaagtgagcccttcatttttttttccttcccctttatcttttcctgttatttggggggttttgaattacataggtggcttgaaaacaaaggcaattcttgatggagatgtttgatatgggaatgtgaaagaaaattggttgcaatagtgtttctaacactgacagtgctgtacgaagcttattttagaactaaaaggcactttaaatactgtgtattctaattactgagattgtaactggtcagtagtttcaaagattgtagtgaatgagcctcaactggaaatttataaaagcattctttctagtgtatcattttgcctgtctaaataattgactaattgactcttaactgtgaagtgcactatagaatgaaagattaggagttcctaagctttttaggtgtgacttttatcacttaactcctaggttatttcttttaacctataaaatgaggatctgagtaattttctttattctttgttctgttttgttttgtttttttttgtttgttttttgttttgtttgtttttgtttttttgagatggacagagtctcgccctgtcacccaggccggagtgcaatagcacagtctcggctcaccgcagtctccacctccctggttcaagcgattctgccccagcctcccgaatagctaggactacaggcatgccacca

SEQ ID NO: 1012 - DNA, 1031 bp, Homo sapiens
taagaaaagcgacagacgaaatagatgatttatgctttaaaacccccaaaaattcagaggtggtaggaaagcattggaactagagcaacaaaatgaaaaataattgattcattgaattatacaagtttccaaatactgacttgtatttgttatctagtgtcaaaaagtgacatctggtaatatcaccttagatcagatcagtaaaatgcaagtactaggaatctggcatgctcacaacaatggagtcattttccaaaatttaattttctcagatttttatcattggcaacagattcatctattttccttatataatagacttcatttatttttcaaaaaattgtctgccaaatacccaagtctaattaatcatagtttctagattctcaaaggtgataatgaaaaagcagttagttcagctcataactcaacacaggtgtcttccttaatacagccattatacttcataagcatcagaagtgatttatgcatactttccatttcatcacacagaatattactcaagagactagatttaattctgctactatattaatagtactgaagggggatttaataaaattaactttactgcttcatcaaagacatctttataaaagtggcattatttttttcttttactgcaagtgcatacagaaatgccagtgaagaagatagtgagtgactcctagggcagttcaatagcccctaccttgatttgtgttgaagagtcagtatttttacccactatggcttttgtgacattggtgcaaacgtcaacacagtggaaaaggcaataatttgttattactttgaaaataattttgaccttatggaccccataaaagggtcttagagcatccacagttgtgcaaacgacaatataaaagccattgctctaggttattcaccaactatttcagccattcttcgattttcttaatttccaaactcaatcctaattggcctagttgcatcctagttcttctagtcagaaccctttaggattgacattcagaactaggatattc

SEQ ID NO: 1013 - DNA, 1096 bp, Homo sapiens
cagacttaaagtctgtgctgatgttaatgatgaagaggtataatgaggcatgttcgaccaccacttcccatcaggacctgaaacagtctctgcagttaaattttaaaagagccgtgaatgaggaggaagtccattcagatagacggttggaagggggatcttagaattttatttttggtttataccactagccatatttgggttcaggctactatcacttgaaactgtctcctaactgatctgtgactcccatttcccacctgtgcttgcacacacaaaacctcacatcactcaccccttggattgccagatgtatcaaataaaattacaggacacccagttaaatttaaagttcaaatatacaacaactttttagtataagtgtatcccaaataggacagggatatttgtaatacttgaggtattgtcccatgcaatatttgggatgtacttacacttaaaaaaaaaaaatattggtgttgaccaggcacagtggctcatgcctgtaataccagtactttgggaggccaaggtgggtggatcacgaggtcgggagatcgagaccatcctggctaacacagtgaaacctcgtctctactaaaaaatacaaaaaattagccgggcctggtggcgggcgcctgtagtctcagctactcgggaggctgaggcaagagaatggcatgaacctgggaggcggagcttgcagtgagctgagatggcgccactgcactccagcctgggcgacagagcaagactccatctcaaaaaaaaaaaaaaaaaaaaattgttgtttatctgaaattcacatttacctgggcacttctgtaaaccaaaaataaaattgtaaagccccccaatcatctgaatggacttcctccatggccagggagctcctaaaatttaacctgagaggctgggtgcagtggctcacatctgtaatcccagcgctttgggaggccgaggcgggcggatcacctgaggtcaggagttcaagaccagcctggacaacatggtgaaaccccgtttctactaaaaacacaaaaattagctgagcatggtggcaggcacctgtaaccccagccacttagaaggctga

SEQ ID NO: 1014 - DNA, 1496 bp, Homo sapiens
ttagtctttgctcttaaggccttcaactgattgcatgaaactcatccacattatagagattaatctcctttgctcgaagtctatttaaatattagtcacatctaaaacatacttttacagcaacatctagactggtgtttgaccaaacaactgggcatcatagctgacacataaaattaaccatcacaaccatgttctaggcactgttcctcactgcctgagaagacaccgttatgtttattagggtttttgagttttatccacagcttttggttatctgcaaccatgtctcccaccattaacatagttcacactgagatgaggattccctatttaacacttggtcccaacttcttcacagtccatctggttttgtagagggaacataactggacattctggtcaggttaggtgaggtcaggccttcaggacgctattttcactgagttgctttataaggcacattatgcaaaattccatcagctcttctgttcactacattcactgttgaaattctaagagtgagactgctgtctcacaccaaagccagtgggtactatcttcagtaggcacgcagcatcatgtttgtatttgatccagctagatgacatgtaagagaaaactttattgtggactctgtaaagtgtgacattcgtttgtgactcaatttgctcatgtatttgttcctgggagttcattacatagctaacttccagctgctttcaatttacatcataaaagaaatgcatcatattcttctcagtgtcctggtagtgcattttcctttagtttttcagtgaattctgttgtaagtaaaatggataagattgttcattattttggattattttgctgaagatgaccagctctgagatgtgaggagtaaataagaaagtaacagtagaatctggaatatcttttaaaaattaagacatcatttttaacagcagagtagccttaaatgacctgattccacagaggagccaggaaacagtatgaaactacaaatttattttgtagaaatatggaaaccttaatactattaagatgtaaatcttaatactattaagatgcaaatcttaatactattaagatgcaaatcttaatagtatttttataaagtgaaaacaatatgatcacttaattactcaagtggagctgaagaaaatttcagagaaaaaaaaataaagcttggaatgcactttagaaaaacacaaaagggaacacaaatgcttcataacaaatctcttaggaggccaatattgaaagaaataacaaaagatggtaaacatgattaaacaaaatgtcatcaaggagtaacaaaagtattactcaaaataaaacttctcttaggaattatccaaagaaaagtaattgtttaaaaaagaatttccacttctatacaacaaaagaaaccctgatttcatttatttcacaatacaatacacatttacttagaaaaaaatgagtgcaataaaaaatgaaattgcttttaa

SEQ ID NO: 1015 - DNA, 1049 bp, Homo sapiens
gtaatggcatgactgtataagggtggaaggaaattttggcggccattttttttcatactaagtactacacgtgactttaataagaaagatgcttgaagtgggtcttgaaaactgagaagttcattagtgaatagaggacaggaagtttaggagaagaagaggagccctttgaaagaacagcagtaacatgaagacagaaagcatcatatttggtctgcctgacaggacatacagaatgcctggaggcatttgggaaaaggaattagaaatgagcttgagaggcaggcaagattataaacagtcttgtatgttttaagaagtaatggcactttatcatccaggctgcagaatacccagaggggtttcattcaggggaatgactgctcttcactctcattgattcttctgtactttgtcagtttcgtatgttcttgatcaataagacttctctggcttcatttccttattcactccagctgacaatccatggtcattcagttaaacctctctctcactgacgctcttatttcccaacactctcacgaccttcttctcattccattattcctaatcctcgattctagaataacccaaccatctgtttgttctgatcctgaaaccaggcactgaataatcctggagcaaatcacataaccatattgattgtctgtctgccttacacatttatgatttctgacatctgttggactcttaatctttttctaggaaatctttacagatacttacctatttcctatgacgctttctttttaaaatttttacagctttttatactttgtacttaatgctgcactctttattctttgcagattaccttccctacttcacagaggaaatagttgttacagtcaggaaaattttcctttataacttcttcctggagttcatctattcttttcattctggatgatcctctatctttccttccagattcctatcattctggacttattctacttctcctgcaactctaaattgatttacagttcttatccatccttattttctttcctccttcaacatagtca

SEQ ID NO: 1016 - DNA, 1061 bp, Homo sapiens
attcatattaatatataattaacctaaacatcatgaataatttttagataatatacataaaaactaaaatatattagaattatattcattattctcatgattgagcaatttcttgtttaataaatgtatgtatctgtggctgaatattacttattgctagaatgagtcaaagcttagcatcaatctattctatttgattgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcagaggtgagttcaattcctgggtatccttgttaactttctgtcttgttgatctgtctaatgttgacagtggggtgttaaagtctcccattattattgtctgggagtctaagaaactcactcaaaaccactcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaggagaaagcaggaaagatccaaaattgacacccgaacatcacaattaaaagaactagaaaagcaagagcaaacacattcaaaagctagcagaaggcaagaaataactaaaatcagagcagaactgaaggaaatagagaccaaaaaaacccttcaaaaaattaatgaatccaggagctggttttttgaaaggatcaacaaaattgatagactgctagcaagactaataaagaagaaaatggagaagaatcaaatagatgcaataaaaaatgataaaggggatatcaccaccgatcccacacgaatacaaactaccatcagagaatactacaaacacctctatgca

SEQ ID NO: 1017 - DNA, 1049 bp, Homo sapiens
taaacattttttaaaatccagcatttctcaagtgtatttgactaatccattttttttcatgtaatacttactaacatcttttgtaactttacaaaatgctggtatacatgtatttctgcctaatgaggtaaactaaatgatttctcttgacagtattcctaattttatgattctaagaaacgttccgaattggacttgccattcaataaggccaatttaaaaaactgccttgggtaaactttcagtttcgaagttgttattctatgctttgttgctgctctatattagagagtgaggaactgtgtcaaaagtcattcttaatgaagccattttctaattttaagttatcttttgcttttcatatttacctatggtattctggaaacttgtgatttagaggaaaacttagcatacattactaaatacttggctgctgcagtgcctcatatatgtcaagttctaaaaatttataattttacaaatatctgtaaacaacagtattgtagcattaatagagaagaataattcattttgatttcactgggcatgtatcaacacatgacttaactatgaaaaataattgtatttagctcaagtgggaattgagggtaaagattttagctcttctgacctttgtgacaatattacaaatgaaatacacaatcaatgggggaaaaatcagaggctacttggcccaaattctgctagttatttattatttaatacccgaattttttgagggcagagagctaatttgaaatccttcaatatgtctctctcttagtccattttgtgctacaataacagaatacctgagactatataatttgtaaagaacagaaatttatttattatgcttctggaggctggggagtctaagatcaaggtgccaacaggtttggtgtctggtaaaggcctggttttcacttacaaggggacgtattgaacactgcatcctctggaggggaagaacagtgttcctcacatggcagaaaagcagaaaagcaaagagagacaatctactccaaaaaaaaccctttttaattatt

SEQ ID NO: 1018 - DNA, 1059 bp, Homo sapiens
tttcttctgcatctgatacttagcataaagtcacaggtcaggcagtaggaaaaggacagatgtgaaatggggagagctggcaaaaaccaaaactgtgaggaacaagctgcaatctgccttcctttcttattgagtcagcattggccttttctcatctccaagccaccaaccttgaagctgaggatgatctataggacatgctggctatcactcttgttacagaactgcaatagcacctgacccaagttgtggaaaaggtaatttaaaaatatcccatgggaggtggaggatttatggactcaggtgcttcctttgccaaaaagattggccagtagatggcaaaaaaaatgtgcatgagccacaagaaggcctaacctacattgaatttcagggagtacatatagtcactgttctcatcttcctttcaaatcacaagcaagtttctttggtggtcataacaaaccactaaaaacgtacagaaaagaaaattctagaaaacataattcaaatttgccaagctgactctttacgaagccatacacagaatttttgtgcattgtgtagcatagcaattaaaatttatttcttttttcatccggataaccccagatcaattattgaatttgccattctactacccactgattttcaatgccactttgtcatacattaaaattcattatatattttgttcttctgtgacacagtgtttattttgttccactactatttgttaacgtctgtgctagctttttataaaacatagtatttagtagcaaataatatagcatttgcaaactagcgaaatattgctgattccaaatctttgtattacttccagtggatatagcaaaggtggaccgtattgtaagttgtttgtaaaatgttctatatcttaaaaagatatataacataaaatacatcaaagaaaaaagtatatttattgtgagagaaaatatatgttgtaaacataaagttttatagctgcaaaaaatggcacagttttaattgctattctttgtccttatatctatggtaagataaatcccaccaccttac

SEQ ID NO: 1019 - DNA, 1031 bp, Homo sapiens
atcaatttataaaactgctattctgaaattgcaacaatcttgtacagtcaggactgataaaatggggtaatcagacattttatatgtccataaatgtaaaatcatctacttgaacattatatgcaatacattcacacaaaaaagcaaatactgtagccttatttgacaatattgaactcataaatactcatgatttcactctgtccgagggcctaaggactaggaatgctgctgtgatacagaaaaacatagtgaatacctcctctatttaaaaatgtcactcaagaaagtctcttctaacataaaggcaaatacatatagctactgagctatgactgtacttctgtcacattctatggtaaaaacaccagactccacaaatttggaatcatgacaacactttgaactaattatttggttcatccatagtttatacctcaatttacctacaaaccttacaaagaggaggtattttaactctaggaaagcggtcactgaataatatgcattcttgatctgtttctttctcccaaacaatggtactgatggttaacattttttgtggtagcaccactatttctagtaagtagattattatggagtgtgccactttaaagctgcaatacaaaataatattttatagtttattcaacaattccacaaagaatatttcttaaaagcaaataaataataaagttaaatgccatatttgttctaaaaactcttttttaatgtatcaatcaaaataatgtcatacatttattacagttagtagatttactagctttatgccttattattgccattttgtggaaagagtatacttatgtcccctcatttaagattcatttttctaattaaaattgatttatgatgtactttgggactaagttttacttgaagaaaaaaaatcacagtttttaagccatccctgctagggcaacatactagatatctcaaatatgtataaccactgcaaaatttcttgtatctaattttattatagggtctttgttgttacaacttgtaaa

SEQ ID NO: 1020 - DNA, 1031 bp, Homo sapiens
ataccctttgacataatggaaaaaaattcaacattatagtaatgttgatatacccctgaggaggatttagatattcatatttttcctgtattatgaagcttgtggttttatagttttacacttaggggataagttacgtattattttgcaaggttgaatttttggtcttttggtgtttttatttctttttcctatcgctgaaaggacaaaaagattattgaaagggaaataaaatatttagacgtatcagttataattcaatgaagacatgagtaagtaggacactgaaatttatcagaaaattgacttttttttaaagcaaatgccttgatgtaatatcaataaaactaataaatgttgtttcagattatctttgaaaattatgacagtctaaaataaagctaaaaattgagtccctcctctgaccttataacaaacatctgttttaaccttcagtggtatggtgagaataagatagctttgtactatgaatttggtcttttttttttagaattttttaatctctgatttttcatctctaaattggaaaacattttgcaattaaatggggttagtataagattcagataaagaatgtaaaaatgttagcacagtactacacatagagctaatattcatgtttttacctttcttttttcatcattcaaatcttccacaacttgctagttcaaccctccatgagtctttttcttttcattaggccaatacagaatgatggtactatcttctaatcattcttgtaagttaaaatctgtgccacatatatttaattattatagtcagatttctcatgaactatttataactcaaatgccataaacttattagtagaaagtgcataattctaggggaaagaaatacttggccaaaattcattaggcttatgatcactgatatgttttttaacctcagtttactcatcagtgaaatgagggttgtcatactgctccatgggtttttttattttttattttttttggtgataacattaaatgtgataacagtagtaa

SEQ ID NO: 1021 - DNA, 1061 bp, Homo sapiens
ttctctggaaataccaaaaaaaaaggaggggggaacaaatcttttgcctgaatgacctggggaaaaaatagacaatactgaaatcaccaatatcaagaatgaaaaaggggacattactaatataaccttattgagataaaaatatgtataagaaaatacaataagaaatagtatgccaatgaattaagatagcttagagaaaatggagaaattcctaaaacacacggactccccaaaatgactcaaaacttacaaaaaaaaaaaaactaaagatctaaagagacctacaactatcacaaggctagaattagtaattttaaaaactttccaagaagactccaggctcagatgacttcaatagtggagtttaatatttaaagaagaatttataccagtaatttagacattaatcctaaaaataataaaagggaaagaacacttcaaaactaattatattagtcacccaataacaaagcaagagaaaaatatcacaaggaaactacagacccataacttatgagtataagcataataattctcagcaaaagctagatactaaacttggcaatatatgtgagggatttatacatcatagccaaataggatttatcccaggattgcaaaactggttcagcatctgaaagtcaatgtaaatgactaagaaaatacttgatcatttttacggagagaaagtatttaacacaacctaatatcctttcataataaaaacactcaatagattaggaatagaagtagtcttcctcaatttgatgaagggaatctattaaaaccctacacttaacataatacttaatgactttcttaaagactgaatgcttctcctctaaaatcaggaataagacaagtttatctgccctcaccactttaattcaacatcatactagatgttccagccaggaccattatgcgagaaaaagaagtaaaaggcaggttgcaacgacggagcaaaactatctctgtgaaatggccataatcttgtatgtgggtagagaagccaaaggaatccactaattaataatagaacttataataaatgaatt

SEQ ID NO: 1022 - DNA, 1016 bp, Homo sapiens
aaccacaaatagatgtaattttaccccagttaaaatgtctattatcaaaaagacaaaaataaatgctggcaatgatatagaaaaaggatagctcttgtatacggttggtaggaatgtaaattagtagagcctttatggaaaacggtatgtacgtttctctaaaaactaaaaatataattatcatatgatccagcaatctcactactgtatgtttatcgaaaggaaatcaaatcagtgtattcacaatagctaaggtatggaatcaactaagagtctgtctatgcatgaatggataactaaaatgtggtagatatacacaatggaatattactcagacataataaagaatgaaattttaccatttgcagcaacatggatggaactagaagtcattatgttaagtgaaataagccaagcacagaaagaaaatatagtatgttctcactcatatgtgaaagatagaaaaattgatcccaaggaggtagagaatagaatgatacttaacagaggctgagactgctgagggtaggaaggtgaagtgaggtttgtcaatggctacacacatacagttagatagaaggaataatttctagtgttcaatagcacagtagaggcactatagttatcaacaatatattgtatgtttcaaaatagtaagtggagaaggtttgaaatcttcccaacactaagaagtaataaatgtttgaagtgatggaatcctaaatactgtgattggattattacacatggtattcatgtttcaaaatatcacatgcacctcataaataaatttttatgcatcaataaaaattgttttaaaaaatgtctttaactggcagtttttataaatgtaatattgtctattaggagggcctttgagttcttcaaagatgttcactttattacaatttgtaatcaaactatctattaatataaaacatttaccttgaaatgtattgctattttattttctttccagattttcttctttgataagaaatttgattgaaacattt

SEQ ID NO: 1023 - DNA, 1040 bp, Homo sapiens
aaaataatagcaaccatatatctagttaacttgagtcttctgtgcctctaaaattttgtttagagaaagcctatttctattgaggttgaggaacacaattctaatacttagtaaaattattaacattcattgcatttaactttgtcgtattttccttcctccaatactagtgtgccaaattctgtaacatagtagcatttttcatgctcccatttatctgtatatacagaaacttctgcttaggtttttttttatatataaagaaagtctagtcataccagtttggttgaagaatactaattctgtccctggaagagctgtctacgtgagccacaacaaaccaaacttgccacatcattcaaacttgccaatttggccgtagtttagtagatgacaactttgggtcaggttaatatttggggaaatggaataataaaagctgctgattttcctactgtattgctacttggaggattggaggtgtagagggaagatgcctgtaaatgagtcactgttatcacctacctgcacatcagcttgattgttgacacttatgtctaaagatgttcatcccaagagtattattgtgcatgcaagtaactgattgatactaacgagttaacattttattttgggctgcttggacaaaaagtcttatctttttgaagcctctggctgcagggatctcttagccgttgcacatataaatttcaaccattcacacagagcaattcatttctgattgctgtagactagtgcaatccatctgctagtgtcatttcctagctatctgtgccagaattacactccttcaattgtgcttcagtgcatttctgaaacaatctaaactaaaatgtctgtattctttggccactggcttatgatgtgttactgatatgcttgttgaatctccagcctctttaacactttttaaaatctttgttacaaccaacacatcatagctaagtaatctgcacatgtaaatgatttttttaaatttcttttcttaccagtatccactgttttctctctgtagcaca

SEQ ID NO: 1024 - DNA, 1028 bp, Homo sapiens
atgtatttgagttggcttttctttataaattattaaatttccttgagtacttcaaatgctctttttaaggaattattattttttgcatcatttgttttatatttttccataattttttaaattaatattttgttagaattgttttcagtttacaaaaaacatggatcagaaagtacagagttactatatactccccctacacacacacaatttttcttattaacatcttatatagtatatttgttaacatgaatgaaccaatattgataaatgatttttaactaaagtccatagtttacgttagtgttgtgtagttctatgatttttgccaaatggataatgtcatgtatccaccattagagtatcatacagaatatttctctactctaaagatttcctgtgcttcacctactcatctcttcctctcctctacccctgtaaccactgatctttttatggtttgtatagttttgccttttccaaaatgtcatatagttgaaatcacacaggatgtagccttatcagactggcttatttcacttagtgatatacatttaaagttcttccatgaattttcatggctcctttcttttcattgctgaataatcttccatattctggatataccacagtttgtctctccattcacttatgaaggaatatcttggttggttcaatttttgtgaatcacttttaaaatacgagactatacttgcatagccaaatcatgtattgccccaggaattaccacaggatagaactctttgataatctgaagtaatctttcttttgtttttattctacttatctcttttctcttgcatgaaattcaaaggtaaaaaaatttctgttaagtagcatctcactttaagcaaccttaaaatagtgcttcttaaatgatgctccaagtagcatctacattagaatcatcagagttgcttgttaaagttcagattcctgggctctactcttgatgtactgaatcagaatttctggggatggagcccaggtttctatttttttaaaca

SEQ ID NO: 1025 - DNA, 1063 bp, Homo sapiens
gccatgttatacctggagaaaatgaggctaatcaaattaaactggcttgaactagattaaacaatttgtatgatttacctaggattgcatccatctttatttgatttcaaaatgtatcatattcataatcttggttatgaatattatacaacctttttgaaaaaactatggaagtgatggctctccacatgtgacttcaaatgttttcaattaaattattttgtttcaatagtttttatcataataaattttaagactatgttttgctaatttcattgtcaagccaaatttgtatctgcttaatctataatatgaaatttaaaaccatgagaatactccagaaaagttataatttttctttttctttttctttttttttttattatactttaagttttagggtacatgtgcacaacatgcaggttagttacatatgtatacatgtgccatgttggtgtgctgcacccattaactcgtcatttaacattaggtatatctcctaatgctatccctccccctccccacaccccacaacaggcccccgtgtgtgatgttccccttcctgtgtccatgtactcaattcccacctgtgagtgaggacatgcggtgtttggttttttgtccttgcaatagtttgctgagaatgatggtttccagcttcaaccatgtccctacaaaggacatgaagtcatcattttttatggctgcatagtattccatggtgtatatgtgccacattttcttaatccagtctatcattgttggacatttgggttggtgcttagttccaagtctttgctattgtgaatagtgctgcaataaacatacatgtgcatgtgactttatagcagcatgttttataatcctttgggtatatacccagtaatgggatggctgagtcaaatggtatttctagttctagatccctgaggaatcatcacactgacttccacaatggttgaactagtttacagtcccaccaatggtgtaaaagtgttcctatttcttcacatcctctccagcacctgttgtttcctgactttttaatgactgccattctaac

SEQ ID NO: 1026 - DNA, 1063 bp, Homo sapiens; identical to SEQ ID NO: 1025

SEQ ID NO: 1027 - DNA, 1063 bp, Homo sapiens; identical to SEQ ID NO: 1025

SEQ ID NO: 1028 - DNA, 1063 bp, Homo sapiens; identical to SEQ ID NO: 1025

SEQ ID NO: 1029 - DNA, 1063 bp, Homo sapiens; identical to SEQ ID NO: 1025

SEQ ID NO: 1030 - DNA, 1032 bp, Homo sapiens
actatctctgtgttaccagctttactgatataaataaataatacattacttacctgcattgctttttgaaaatcttcatatctctgctgggttatttagtttcctaaggtaaagagtttagatgaattcataagtttttatcagccaggcacttttcattcccagtgaatttacaaatccaattctgtttttagcaaaaaagataatttatttaactggaaagggcgaatggagctagaatcaagtattgctggttcagatgttcaaatcttgtcttcagagtacccacttcatcttcatctttaggcactggttctctttgcagtgtgcctttattctcttctgctgcagataatctttgttgcagaaatggtagctgtcagcaacaccagtagaaaaagaactccttttcctgcaattcatgtgtccatcttagagaaggacttggaattgtcctgcttagattaggtgctctccctcttaggttaattatttttgctagtggaatgtgatgatatccttgatcagacataagcaagcacttggcacctctgatattgtgatagggagagtgatgtgtgacagggtaatgattgacagccccaccagaaatcaaatggtgtgaaggcaggacgatgttgcccggggatgctgggcagacagaaataataactgtcttgtataaattctagctcagacacaatattacatgtttcactaggtggtcagactacgccgcaggatacactgtaacatgggtgcagccaaggttaaaaggcaggcaagtgctacctagggaagagactagtacctgactcaaggtcactaacaaaaaacacgcatactaggctcaagtgttgtaacatttgcttatagcaggagggaagagactacacaagatctagccctttgcaatgtgtcagtccccatggctagcagattggttccacagctgatcagggcagagtgatggcatgtaccccactttgtgctgcagtagctcccagaccctgaacactgccccatagggtc

SEQ ID NO: 1031 - DNA, 1022 bp, Homo sapiens
ttattttaatttgcctttccctgatgactgagcattttttcatcaggtatttgtatattctcttttgtgaagagctgtacaagtctttttgtcttttggcctactggcttgtctttattatttatttaaatggatttgcttaatttcttcatgtaatctgcatataaagctttttgataattgtatgtgcttagaatattttctcctacttagttgcttggctttttctactctcttaatggaatgtttcattgagcacaagttcctaattttaatgtagtttatttcatcatttttccttcatgagccatgctttttttggtgacatgtgcaagaaattgtttatactcaaagataatgaagatatatcttctatgatatcatctagaaactttgttttacctttgctgtgtagatttacaattcatttggaactgaattttgtgtgtggtgtgaggtagaaagtgaagcttttttgttatgttgatgaaaatagaaaatgtccagcttctctgtagagacatatttgccataaatcaaatgtccgtatgttgtgtcaatttctgtaccttctgttctattttattggtctatttatttttgtgttgctacttaatcattctaatcatggtaggtctataatttttaatatatgataatgtgtttctattttgttgttattcaagtttgtattgcccattcttggccctttatgttttcataaaatttacctacttgtctatttctaccccaaaagggaaaacaattaagattttgatacaatctattacagcaaatatattgatcagttttaggaaattgccatcttaacagtattttcttccataccatgaactttagcatgtctttccatttgtttagatcatctttaaatcatctcatgatttagacttttctgtttagtaatcttgcacatcttctgttaagtttatctctaagtatttcttttgattcagttgtaagtggtattttctctataagtagaaatctggattggtagt

SEQ ID NO: 1032 - DNA, 1050 bp, Homo sapiens
aaaaaacaaacaaccccatcaaaaagtgggcaaaggatatgaacagacacctctcaaaagaagacatttatgcagccaaaagacacatgaaaaaatgcgcatcatcactggccatcagagaaatacaaatcaaaaccacaatgagataccacctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctatgaagacacatgcacacatatgtttattgtggcactattcacaatagcaaagacttggaaccaacccaaatgtccaacgatgatagactggattaagaaaatgtggcacatatacaccatggaatactatgcagacataaaaaaggatgagttcatgtcctttgtacggacacggatgaagctggaaaccatcattctcagcaaaatatcacaaggagaaaaaaaccaaacaccgcatgttctcactcataggtgggaattgaacaataagaacacatggacacaggaaggggaacatcgcacagcggggcctgttgtggggtggggcgaggggggagggatagctttaggagatatacctaatgttaagtgatgagttaatgtgtgcagcacaccaacatgtcacatgtatacatatgcaactaacctgcacattgtgctcatgtaccctaaaacttaaagtataataaaaaaaaaaaaagaatctgaaaatgcactcctcagagagtgtgtcagaaggcatacagcacgttctctgttcagatgtcctctggaggtcaggtgccacgcctgttcagtaccagaccttgtctactcaaaggaagctttttgcatctgcagggaagcccatacaaagctatagtgtagtattgtctttacatgaatcaaca

SEQ ID NO: 1033 - DNA, 1028 bp, Homo sapiens
cacttgccttctaccacccccttttatccattactgcttgtgtcttgtcactcctctgtttaagagctctaagaggctcccctgtttctaccagataaaattttaaatttgtaatgtgatataaaagattctcgtcgaccatttccttcctttctttccagactcatgtcttaccattcccttacatgcacagaatttacatactgtggaactctggtactttcagcattagaaacactgggtaactctgtttcttatcttagtgtcatagcatatgccattacttgtacctggaatgcatattcttcctctttttccctcctcgcaaagaagccattttcctttttgagacttaatttaaacatcctctgccctgggaaactagtttctcaagccccttgtctgactttcacacatagagttgcagtatagttatttatcttcactgttacattgtgaaaatctctaggactgaatgtcttttacctctggtttccccatatcctaatttacatcgtggtacatagtagatattcaatacatgtttgcatgaatgaatacatgtgaaattgaatttaatgaacttgtttaaagctatctaacattttcactttttattaaatatatgatttgttgatatacctatgcctaatttgaattatatattaagtgtttttaggccaggcactgtggctcatacctgtagtcccagcactttgggaggctgaggcagaggattgcctgagcccaggaggttgagaccagcctaggcaacacagtgagatgccatgtctacaaaaaatttaaaattagctgggcatggtgatgtgtgcttgcagtctcagctattatacacgggaggctgaggcgggaggatttcctgagtccaggaagccaagactgcattgagcctctgcattccagcctgggcaagagagtgagaccctgtctcttacaaacaaaacagaaaagtttttacatttgagtggtttctttgattttgtaagaacattttaattttagatatt

SEQ ID NO: 1034 - DNA, 1112 bp, Homo sapiens
gcctccttcagacgctgagcaatgcactgccgcatcctgttcattttctcctgatgttctgaatgcagacctttgccagctcctggctcagctagtggtgggacagcagtgggttttactgcagacacaggtttgctagaaggaggttgtgagggcgagggcactggtggcatcgagtgggtatgggtgctgcatggggaggaactgccgctgctataggttctgcttttggggctgcagcagcaggagcttcagccggcttggccttagcaggagcagcaccagttttcctgagtgtgaaaagcggagtgcctccttcgacttttcccccatcaggtacgaaaagagcttcaatcatgccatttgctggtgatggaacctgcaccaatgtcttgtcagtttcaatctcacaaaccacttcatcttctgcaactgtgtctccaacagctttctcccacctgacatctccctctgtgacaggttctgcaaacgctggggttttgactgtaaccaagtcatacttgcatacagttgtagttctgaagaagcgaacactgaagacactgttgttaatgacaaccttcctgctgttagggtaacctggtccctggcataaggagaccccaggcagggaatgtctccctagagggcagttccccttctggaaggcagagagcgagtggctgaacgcccgggacacagtgggaccgggacagcatcacggcggccgggtctccgttttatattattccttttcacaggcagctctatttgccctccttttcaagatagcatgccccttaaagaataaaattagttttgggaaagaaaaagtgccagtttcaacaggcatagactgtcttgttgtaataataatactataccaggaatttttacttgcaactcatattactaaaagaaagttaaatagcatactatagtccctccttatccttgcaggatacattccaggacccctaatggatgcctgaaacctcagaaataccaaaccctgtatatactatgtttttttcctacacatatatacttattataaagtttaatctataaagtgggcccagcaagagattaacaacaactaataaaataga

SEQ ID NO: 1035 - DNA, 1100 bp, Homo sapiens
tatgaacaaataggcgtgactgtattccaatcaggctttctttgcaaaacaggcattgcagactacagtttgttgatccctgttttaggtaattgcagaaagtcatgaaacagtgattaaagcaaaaattgatgctggctcaaaaaaaattccttaaaatatatcaattttcttattaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtaagtaatatgggttcataatctttataggatcttttatttattacattaaataagtatttttactttaaaattgtatgttcagtgtgtttctctttttaatatctgcttattttattaaggatataggaaaaatactgttacttttctttctttttttttttttttttttgagacagagtctcactctgtcaccaggatggagtgcagtggtgcaatctcagctcattgcaaccttcacgtcctgggttcaagagattctcctgccttagcctcatgagtagctgggactacaggtgcacaccactctgcccagctaatttttgtatttttagtagagatggggtttcatgatgttggccaggatggtctcgatctcttgacctcgtgatctgcctacctcggcctcccaaagtgctgggattacaggcgtgagccaccgcgcctgaccatattgttacttttcttaattttttaaataattcttcaagttttcttactatacattatagaaattattttagcaactgcaaaattactgtagttggtgctagatttagagaggcagtccaccctaaatatgatcatcctgttaatatgtactcattttctgtttttactcattaagaacatttcccctagtaagatttctcttgttaaacaaaagcaatgacttttttctagagtatgatactatgcctaacaaatgcctcttactacctttaattaacaaataatataaacttacgtgcctattccctgttccccaccagtttcttg

SEQ ID NO: 1036 - DNA, 1052 bp, Homo sapiens
cctggctaatttttgtatttttagtagagatggggtttcactatgttggccaggctggtctcgatctgcccgcctcagcctcccatagtgctgggattacaggcatgagccactgggcccggccttgtgctatgcattttaaatatattttctagccgggcgcggtggatcacgcctgtaatcccagcactttgggaggctgaggcgggcggatcatgaggtcaggagatcaagaccatcctggctaacacggtgaaaccccgtctctactaaaaatacaaaaattagccgagcatggtggtgggcgcctgtagtcccagctactcgggaggctgaggcaggaggatggcgtgaacccaggaggcagagcttgcagtgagccaagatcacgccactgcactccagcctgggcgacagagtgagactccgtctcaaaaaagaaaatatatatatattttctgattctctcagtaacccttttttgggtggtgttatctcttttaaggatcaagaaactgaagctcagaggtattaaatgatttgtccaaggccacacaatttataagtcacagatccaggatccttgcttttttttttttgcggggggtgggagacaaagtcttgctctgtcgtccaagctgaagtacagtggcatgatctgggctcactgaaacccccacctcctgtgttcaagtgattctcctgcctcagcctcccgagtcgctgggactacaggcacacaccaccacacccagcaaattttgatatttttagtagagatggggttcccttatgttggccaggctggtgttgaactcctggcctcaagtgatctgcctgcctcggcctcccaaagtgctaggattacaggcctgaaccactgcgcctggcctatgttatactcttaattcttgttacttcccatgtcctcttgagtatcagataattttagtactataaagagtcgtgtcttccatgaatttccagggtaattcttaactcttacccctttaaatattgatgctcccccattatctgtattctttcctgca

SEQ ID NO: 1037 - DNA, 4396 bp, Homo sapiens
tcttggagagggggtgtcaaagatttctttaaaatcgttagtgatgtggtctcgctttaagatttttaatgggatcagaagaaaattcggtacttaatcacttccggtaatcttcatgacctgttatagtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgtatgtataatttttttatgttggaaagtttattttaaagaagtgtgacagtcataagcagtgagacagtatttatgtcttaaaatggcatccaactccatgcagagaactgaggatgtgctgtgcctttgaacttcagttaagtgtgctttggacgtctgaggctgtgggcttattagaatctcagtttttacctatactgagagggcttgccagacaaagtagatgagggtttgaggtacaaaacgggtttctctttttgtagttaggggtaatactttcaaggtcaatgatgtgttggcatgtattatctgaatctattgctgatgtgtaataacactttagctctagaattactctgagaccttgaaaaagttttaccttaaatttttaaatttcgaggaaaactctgggacaatcttagcaaaaagtagtaaacaacttagttaagagtaaatgtttttccctgtagtatccaaactcagttgtcttagtctaccgatttgtgggatatatggtatgtattaattttttacttaagtgttaggttcccataaccttgaaaatactctattagcaatcatggagttaaggccatatggatggggctggactcgtttctgcctttatctgctatctatctttatgccctgaatttgggttagtagcaaactaagatgcaccacctgttaaaaaaacttctttttttccttttgagagctataacctcactttgttgcccagactggaggacagcggtgcgatctgggctcactgcagcctccatctcctgggtttaagtgagccacctgaatagctgggattacaggcacattccaccatgcccagctagtttttgtatttttcgtagagactgagttttgctatgttggccagagtggtctcaaactcctgacctcaagtgatctgcctgccccagctttccaaagtgctgggattacaggcaggagccaccacccagccacaaaacttcttaaaatataatgcattgttgagtgtgggaaaaatttgtttctggaatcctaatactaattttcatgtatcattgattagccactgttttatctgggcttaaacatctttggcatgtttagggcattttgatttttcatgtagttatataatttactaatagataataggttttgtacagagtccacattaaaatagatgtctgataaatatggtataggtactcggaaagaaatactctccctgaacttcactgatgaaaaaggtagatgtttttctgtctctggctcatgggagaaactaaagcactgtttgtattgtcagccatagattaactaatcctgtgcttctcagataattgtttttttctgataatagttgtgtctgaagatggcttctaacattgagcagcacagattttaaactcactactgatcagtgctgttaaggtcaggagaggtaaaaatagcagcatggctaatgagttacctttgtgtttaatctctttataacttgttaccagttcaaatgacagatttaagaaattgtgtattattttaggaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccaggtaaatactaatcaaaattgcaacgatcttgatagtatgttctcttacttcagagttggaaattgaaactgtatcaggatttggtcaaaaagttttgttacaagtgaagctgtcctacaaggtcaatgatgtaatggcatgtattagctgaatctaaagttgatgtgagttctaaaattacactgagaccttggagggtaaaatttttatcttcagtatgtgtaaatactgtaaaatagctaaatggagctatttgattttgatattagtgaacatctacctggtggtttaaagtctttctggtactactgggtgctgagatgggaagatcaggactttgtgtggatgtgagttagtatacttgagtatcttggaatgccaagttaaaatttatatgtagaaaattatactttaaagatttgagttttcttgatactatctaattttattcaataacaggagagtctgcatatttgagaaaaggttatatacacagagacaaaaggatgtgcttgacaacttaaaaagagttgagcataagatcattagaataaacctgaaagggacatttacctaatacttgtctttattgcagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggttttgctagtaaccagtttataagtttttcatcttttcaggtcccactaagcagctggtctaactggagttaatggtctgctggaacttccagcatgcactgtggtagttatatcagcatatacaggagcactggaacagagggggccagtctaaaagataaggtaggtggaatttttttccccaatatttggtggctttgtaaagttttttaaaaactacttgctggaaagggaaaaatatttaaaaaaaaaaactttacaaacttgctgaatatttgagtggagggagggaatagaattttatttgataaacgtagataatctctgctttagggatgaacacagtgcaggccagagagaccagctgcttcatgggatgtgaaaaatctacttttataaagtagggtaagtttatttcattattagaaatggactaatactttgggttctattagttttcttctctttggttttcttctctttctgggctttctttaagcagcttaagataatttgctgttacttttttgtggcagggtcttggctctgtccaggttggagtgcagtattttgggagacagttgctggggctggagagctctgttgcccaggctggagtgcagtggtgcaatcttggctcactgcaacctccacctcccaagctcaagcaattctcctgcctcagcttacagagtagctgagatgtgcaccacaacacctggctggtttttgtgtttttagtagagatggggtcccctggcctcatgtgatcctcctgcctcggccaccaaaagtgctgggatttcaggcctgagccacaatgcccagccccacctaattttttttaaaaagtt

SEQ ID NO: 1038 - DNA, 1054 bp, Homo sapiens
aaaaaaaaaacaacacatttttctttctttcctaagataaattatgaacctcttttcttgtgccagagaacactgaatatgtgaatggatggctgtgaaatactagccatgaagaaattttgacaataatatttcagtgcagaattgcatactagtaatagtatgcttggattttttcagatatgtggtattaatacatgtttggaattttaagtgtcagatcaagaagaaaaacttaagatataaagtggtgttttaataatttgagttttatcacttttaatgtcaagaaattattatacacataaactttatgtctgtaattttagatctattgttgcacaggatttctggcaattacaagtcagttgcatcaagtaaattctgatttacttggctggtggctttgtgaacgacaattaccctcaggcgggctcaatggaaggccggagaaggtattgtttgataagccatattctgctagctttagaaccttgagtgaatgctgctgctttgtcttgcctgtttctatattgtaaattggccatgagcttatttattacctttccctgttgtgaattttcagtaatatatcctactaaaagactccccttgacaaagtagacccccatgagttgaaatactcattgatcctaatgtccatttccagacagtcttgtacaggaatctccatgtttaaggacagttgattttggcaaattggattttttaaaaattagactacagaatttttgtttgcaatcttcttatttaaggaatacccagataatttggtttggagagaagattattaaattttcctccacataataggtctctcttatcaggtctgtaagggacaaatagtgaatactcatttgcaactatgtaattgtcctgtagagcaagtgcagccataagtggtaagaaatgaatgagtatggctgtgttccaattacaattattatggatggatatacttgtatttcctatgtcagatggaatcttgctctgttgcccaggctggagtgcagtgacgccatcttgattcact

SEQ ID NO: 1039 - DNA, 2044 bp, Homo sapiens
gccctctgaatgggacgtggtggtacagtagctgggattacagtcatacaccaccacgcccatccaattttgtatttttagtagagatggggtatcaccatgttcatcaggctgatcttgaactcctgacctcaggtgatctacccgcctcaacctcccaaagtgctgggattacaggcgtgagccactgtgctcggcctgtatttttatttttaaaccttagtatttctgaataacaacgggtagagaaacacccgcagtagctgtctacaatagagtgaaataaaaagcctgaggaactgtcaacagaaaaatgggtggccgtggggagcaccgggacctgcacttgcacacaatctagggcagcttctaatgagtctatgagttactcagggatctcattaaaatgagatcagccttgagtggggttttctttatagacttctgtcaccatattttgaagagcaagggtttagttgattttaagcaggtgtgtacccccctggacagtgcttgtagaaaaacagaactatacccatggatttcatgattatactgctagcttcttggttaaggggctgagttaggcattcattgcagatagaaacaaagcagatgcatgcttatcagtgagtactgagatatttagcatggttacctatgaattgaagtttggtctcttcttacccattaattgattatctttcattctaagcaagtatttcataccctgcatatcagtatatccctggatttcgtccttccacatggtttgacactttgaacatcagattacctaagagtgagacttaacccacttttaaattgttctcaaaattagggaaataaaagagaatgaaattgtggcaacttttttccctcctagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggcaagtaatatttctgacatatttctataaattatttcagcgtttgcattacttcatggttccatggatttccagggtggcattccgagtgttgctttgaaagcagtttttttttctatttattgtagagtgtatgaaggatatagaacaatcttacagaaatttcttgtcgcttgttgctaacaaaattagtatatggtaaaggtcaggtattcataatttgaagttaaagaagttttcattttgtgatctgtatataaattcttttttaaataggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaatgattgataggtttgaatatggttattctgaattggtcacagacttaggttaaatggcaatctaccatcttaaaatggggttgtgattcggactgtcctttttttttttttttttttttttttttttagcattttatatatcagaattacccaaagaa

SEQ ID NO: 1040 - DNA, 1026 bp, Homo sapiens
gcacattgtggggaatgagtggcttgggtaaaagtagtgctctttggatggattgataacaacagcaacaataggtgccatttattgaacagccagagtgctcaggctggcttctgtgctaagtaaacttttattacaaatgaagacactgaagttcagaaaacctaagtaaattgtccgatgtcctgtggtcagtaagtgatggaggtggggttcaccctgacttcgtgtggttgtaaagcaggggtgttcaaacttttggcttccttgggccacattggaagaagaattgtctgggccacacataaaatacactaacacgaatgacagctggtgagctaaaaaaaaaaaaaaaaaaaagcaaatcgcaaaagaaatctcataatgttttaagaatgtttacaaatttgtgttgggccacattcaaagctgtcctgcgctgcgggttggacaagctatagagcttgtcttttaccttcagtgccaatttagtaaatatttatagggattctgaatttatttcaccatcttctaccccagacaatatccagtctagacaacttcctaatctggtggcctgatggggaccacttttagctgtgtcgtttttatttgttcctttaagtttcctttgtgacagaagaactagaggaactagaggggctgcaaagactgaggagataagaaggctttaattctgtttaattctgaatagatctttgaccctgggcaagttatgtgaacctatgtgtcctttttgggggtgggagtgagggagagttggatttaccctgaacgcaagcttcagggcccttccaaggttctgggaagagacactagcattttggtatttataattttatattcattttatcaaggaatcccacaaatcgtatacatttcaggctccccaacatagatctgtcccttgggtggtgttggagaaccaaagagataatgcttgtgaatgcactttgcaaagcagagtgcactgcataggcatgaagtggaaatggcaaaaaacgt

SEQ ID NO: 1041 - DNA, 1580 bp, Homo sapiens
tttcttctactttcttttgtttaaattgactgattttaaaaaatgatttcttgaagtggttagtagattctcaaattttgtcgtaatgtatttacacaatagggttccccttaagtactgtttttgctgttttagatgaaatcattttattatcattcagttaagagcagtttctaatttctaccagggattttctagccatcttttcattattgatttttggcttcattgcattgtgaggaaagaacacgctttgaatgatttcagtgcttgaaatgtgttgagatgtgtttgatttcataacatctggcatatttttatacgtgtttgctatgtgcttgaaaataaagtatatcctctatttgttgagtgcaatgttctatatgtttatttggccaattttgctgtttatgttcttcagattttctgcattctcactgatttcttttgtctttttttgttttatatgtttctgagagagatatgttaaaattccataatatgactgtagacttgtctttttctcaattacaaaggatcttccatatacctagtaagactttctgccttacagtctatcttatctgatattaataaaaccacaccagctttctttcagttagtatttgcctggtgtgtttgtgtgtgtgtgtgtgtgtgtgtgtgtgtgtgcctatttgaatacttttagctcctgcatttctatagcattatttttagatgtgtctcttgtatacagcatatggttgagttggacagaatttgtcttttaattgcagcattgagttttcctacttttaatgtaataatacacgggtgggttgaaatttattattttattaatttgctatctttcttttagtcctgcttgttccttgttccagtttctcctctttttctcccttctgttgaattgaggatttgttgttgttgcttttaaccattccactttttatttgtctattaccttggaagttgtatattcttttattattattttggtgcttacactagagattatagtatgcatcttgactcaggtcttagaccactttaatggcatttatcactctcttgacttctgtgtcattgttatgtattttacttctatacctttcagatgcccaagacattattattattattgctttattcagtcataattcattttgattaatcatatatttattcttttctttgttcttcattttattttcttgtattatttatctttcatctgggagcactctctttttgcctgaagaacatcattcactatttcctttattgtaggtctgttggtaacaaattcttttgttttttgtttgaagtgctttattttactatcactcttagggatatttcctctgggcataaaattctaggctatctgttatgttctttcaatacttaaaagatattttatttacttctggctttctttatttctgttgataagttagataaaaatccaatttttgtttctttttcacccttatgctgatttttagtttttttttttttttctttgtggttttagcagttttattgtaattggcctgggtgaagttttcttttta

SEQ ID NO: 1042 - DNA, 1063 bp, Homo sapiens
acagttccacagggctggggaggccttacaatcgtggtggaaggtgaaaggcatgcctcacctgcggcagacaagagaagagagcttgggcaggcaaagtcccctttttaaaaccatcagatcttgtgagacttattcactatcatgaaaacaacacgggaaagacctacctccatgattcagttacctcccactgggtccctcccacaacacgtgggaattcaagatgagatttggtggggaaacagccaaatcatatcaaaagttttatctggcatatctagtgagtcattatcagaagcagtagtctctctgaagcttttctcatctatccaccttacatttttatgattaaaaattccaaaaattacagaagtggagggaatagtccaaatattcccccatcactcaaatgcaactcttatcaagattttgtcacaatttgcatggaaatattcacaacctataagaagagaaagttttaaagcaaggcaatatctcaactcacagccatccacttacctctaatggccagcatcagagacaaagacttctgccttggttactgctgtcctgagcttctagcacaggtgtgcccctagatgatttcagtgagctattgttaaatgaatgtgaattcactgaagaaccacagactgtgggagctggaggaagtcttggcttgtcgtaatgaaccacagattacagatggagatgctgacatcctgagattaggtcacagaggtgcatgggagagttaggccaaggtctcaactcagggctctctccacttttccacacttcctcctcattttgctagctcatttaattaccactttttcttcctttctgataacactgaagtttaagagcatttcattacaagtgtgatgatacaatgtggtattaagacatgacaaggcaagttttattggccattactatttgcctcaagtgagtggcaaagcctttgaccactcgaggcatatattaatagccctataaaatacatcctggattgctagtgctattaccgtctggctattacatttaaaaaaatatt

SEQ ID NO: 1043 - DNA, 1033 bp, Homo sapiens
cagagcagattagcgaaacaagcactcagctaagagtccagggcctggtttctagttctggttgtgaccctaatcagccgggcaagtcacttatgttctctgagcctcagatttctcgcctgtgcaatgatgatctttcagattctaactctaaaattctgtgcatgtctcttttccagtgactgaggaagttcaaagtagaataggatggggatgacacatgaataagctctgaatcctcacctgtctcgaggaggaataaattcaatcctaatgccaaaacgacagaatctctttacttcctcactgctttgccaaacgctcatttagatgtatctatcaatcactggtttattcatatggtgcctctcaccgtgaaatctaggttctggaacaatataattggcctaattttggttttctgactgcagaagtggatgcttcctctgcctgtctctactctcagctcttattgttttttttggtgaaagagattaatccaatgctccgtggaagtagatatcaagaactcttgagcagagagaagttttgcattctgcctgtttgacatttacaaggtatttcattaacactgtgggcgattcaatccccttttatttttggctgcccttgctgtgcctctgaaggaaggaaggccattcttttgccaggtaaggggcaggaaaatgtgtgactccaaagctacctggagcctgatgggggttaggttggtccttgctgcccctgctggtcacatggtccctgcttactctgcttgccttttgtcttcctctttgtggactcctattgatccttgtacttcctctggcagagtgtttatcagattatattgaaattgcctgtttacttctgcctctcccacagaacagtaaaaacctcaaagactggggctctttctttctttcttttctttctttctttttttttttttttgacaggttctctctctgttttccaagctggagtacagtggtgcaatcacagctccttggactcctgggtcaagggatcc

SEQ ID NO: 1044 - DNA, 1129 bp, Homo sapiens
gtcattcagggaacgttttagtgtcaagccattaaatcacacctcaaaaggttggaagtggcccacatatgagtccatataggtgggtctggaaaggtggggcgagcaggaatctctttccattatgatgatggggtttctaaagtaattattgctttaaaaaaaatctgcctctgccattttccagtcacactgttcttggagcgagatgcatcatcaatacttttcatactaaacgttctctcctattggatttacctggattctaggggtatttttttcacatttctctggagacaagtagtgctgataaagattttataaggtctctcttgctctcaagctcgttttccttaacttttcttgtcccagttaccagtttatttggtccccagaaaccttctaatcttcatctttaatgataaatttatcttttgtagttctcctgtcaaagcttttgtgtctagtggctcattttgcttaattgctggagttttctctggccttttgttatttggtcctgcgtattttcaaagattctgtagaattttcagactgttactctgatgtttacttggtagattgattgctaagttgcattgtcttcagaggaggtttttgaggttgtgtctattataatgtctgcttctacccggagtccattgcacttggagtgcttcttgaagcccctgagcttatgctgtgataaaagcgtgaatgttttactgtgtcaaagcactgtggctcataaggcttcataagctctggcttttatatcagagcatctcatatggttgtgcagattgcatcctggtcaagcatgccaggatgaggggccaagggtgtactgaatgccagcctgtgcttcatttgccaagccttgcatctgatgtaggactgtatcctcacaggggacaccttttcctaatacacacaaaggtatcatgtgggctagcagctgttctgctataacttagctaggtgtctttacaggagaaggtagtggaagaggtggtggtatttctcctcgggaactgagattagcttactcgacgggaatcttgaagtgtcccaagatgaagccattggtgccccactcccccaacagttgtttaaaagttattaaaga

SEQ ID NO: 1045 - DNA, 1045 bp, Homo sapiens
tagtgctgcaataagcatacgtgtgcatatgtctttatagtagaatgatttataaatcttttggtatatacccagtaatgggattgctgggtcaaatggtatttcttgttctagatcattgaggaaccatcacactgccttgcacaatggttgaactaatttacattcccaccaacagtgtaaaagtgttcatatttctccacatcctctccagaatctcttgtttcctgactttttagtgatcgccattctgactggtgtgagttggtatctcattgtggttttgatttgcatttctctaatgaccatgataatgagctttttttcatatgtttttgaccacatacatgtcttcttttgagaagtgtcttttcatatccttcgcccactttttgatggggttgtctgtttttttcttgtaaatttgtttaagttccttgtagattctggatattagccctttgtcagatgggtagattgcaaaaattttctcccattctgtatgttgcctgttcactctgacatagtttgttttgccaggcagaagctctttagtttaattagatcccatttgtcaactttggcttttgttgccattgcttttgatgatttagtcatgaagtctttgcccatgcctatgtcctgaatggtactgcctaggttttcttctaggttttttatggtttggggttttacatttaagtctttaattcatcttgagttaatttttgtataaggcataaggaagtggtcaagtttctgttttctgcctatggctagctagttttcccagtacatttattaaataggaaatcctttccccattgcttgtttgtgtcaagtttgttgaagatcagatggttgtagatgtgtggtgttatttctgaggtctctgttctattcctttggtctattcgatttggtaccagtaccatgctgttttggttactgtagccttatagtatagtttgaagtcaggtagcatgatgcctccagctttgctctttttgcttaggattgtcttggctatacaggctcctttttg

SEQ ID NO: 1046 - DNA, 1056 bp, Homo sapiens
tctgcttgtttattgttggtgtataggaatgctcgtgatttttgcacattgattttgtatcctgagaccttgctgaagttgcttatcagcgtaaggagtttttggggtgagatgatggggttttctaaatatacaatcatgtcatctgcaaacagagacaatttgtcttcctttcttcctatttgaatacactttatttctttttcttgcctaatttccctggccagaacttccaatactatattgaataggaatgatgagagagggcattcttgtcttgtgcccgttttgaaagagaatgcttccaggttttgtccattcagtatgatattggttatggatttgttataaatagcttttattgagatacgttccgtcaatacctagtttattgagagtttttaacatgaagtaatgttgaattttatcaatggcgttttctgcatctattgagataatcatgtggtttttgtcattggttctgtttatgtgatggaatacgtttattgattagcgcatgttgaaccatccttgtattccagggatgaagctgacttgatcacggtggataagttttttgacatgctactggatttgatttgccagtattttactgaggattttcacatcgatgttattcaggcatattggcctgaaattttctttttttgttgtgtctctgccagacacaggatgctggcctcataaaatgtattagggaggagtccctctttttcttttgtttggaatagcttcagaagcaatggtatcagctcctctttgtacctctgatagaattcctctgtggatccatctggtcctgggcttttttggttggtaggctattaattactgcctcaatttcagaacttgttattggtgtatttagagatttgacttcttcctggtttactcttgggagggtgtatgtgtccaggaatttatccatttcttctagattttctagtttatttgtatagaggtgtttataatattgtctgatggtagtttgcatttctgtgggatcagtgggatatcccctttatcatttttgat

SEQ ID NO: 1047 - DNA, 1065 bp, Homo sapiens
tggggtgccagagccagggggactgagactgccacaatgtgtgggacctttcctttctgagcacagcctggtggcagtcagcctttccctccagcccccacacaaaacaagtcggtcaagccatgcacgagtgatcttgatttgaagagagagaaagaaatttgatccccaagtctcagagctgaggtacttatgcactgaactccaagaggcatttcatttctaactagcttagaatttcccacagtttgacagcaacccaaataaagaaaatacttgaggaagcaaagtagatgtgctggaagttgagggcattacctgatggctgaatgaatttgacaggcttttctcctgttgttttgacacaattgtattttcctctacaccgctgatggagtgctctgcctaaccacgatgtacccaccttccgtggctcagctgagggccactttgtcaaatatctccatcttactcattcctcgccgtggccctctcccaccagggacctcccagatcactctgtcacccccaagactacacatttcggcactttatgccgccttgtcttaccctttttttcatgttttattgctgcatggcatttaatgttattactacagcaaaactgtatttccctagagggagggaatttgacttgttctggtctcaaactctaaactccggtcagttgtgaagaagcctggaaccaaatttgcagcccatctccaggaaagtgtatataattgtgtggtggatactgtgggtcatgaccctactcacggctctatctaattgtttcttctccctcttcccccttcctccttgttgtcagtcttttctaagtttctttcaatccttttagggattgtatggagtataaataaccttccatatgctaagccagaagttaccaacatgggtgtttcctgacgccaggcaagtaatgtaatataatgactcagccaagggaagagggcagggcttatctctgcacagctgcagtcacttgtggccatgctggaatgagggccctttgttgccaaattttcagatttttcaagagaa

SEQ ID NO: 1048 - DNA, 1081 bp, Homo sapiens
ctgaacaaagtcatttaaaatggcaccagttactgtttctcagggatcagctttattgtgatttttcttaaattagaggaatcgcctatatgttcaaactaattttttagattactagaaatattcttgtaacaatgtcttatggagaacccactgtataaaacccatagaagtgtacttccccagccagatgcagtggctcacacttgtaatcccagcactttgggaggccaaggcaggtggatcacttgaggtcaggagttccagaccagcctggccaacatggtgacatcccatctctactaaaaaaaaaaaaaaattcaaaaattagttgggcctggtggcacacacctgtaatcccagctacttgggaggctgaggcagaagaattgcttgagcccgggaggtggaggttgcagtaagctgagatcaagatcacgccactgcactccagcctgggcgacagagctagactgcctcaaaaagaaaaaaaaaagtggtactttcctccatgggttgcctcctgcccctgaacgcccccatccctcagtgacctctgagcttccacagtacccaagagtgctccggaacaatggtaagaccactgagctaggaactagctttgttttgtttgtttgtttgtttctatattattatttgttgatgttacagagtatagaaaattggctttttttctttaaaagaagaaactatgttttctttttttaaaacaactcacattgagctttgctatactactttgttacctgaattggtaatggttttctttttttctatgttataatagaatctttatatttaaataaacttaaatactttcaggcgctgtggtctagagctcactgaaagtgttatgtgtacatgagcaggaccctcaagagccaacctgtgttttttgtctcattaacttggaggaaggcatgaggggtcagggcctacaatatcacttggaaacaaggaatataaagaaaatctggcctgtttggtaaaactgtgcttctccatgtcttgcctcttttgatctcttgcctaagttttgttttgaaaggttaacactatt

SEQ ID NO: 1049 - DNA, 1044 bp, Homo sapiens
cattaggcaccataggtgcggtgccttggggccgtggcagttttagggctccacaaaaatgttttaatcttttttaaaatcaagaataaaaaatgaatctaataaaaataatgaatatttattaatgaattcagcatagattatataaacttgccttatgccaatgtagtcctaaaatatgttttcatatttttttctatagaggaaggtactcatgagggcagaagtgactagggccaaaaaagtcattgtgcagctctgacagattgaatgaccatgagagagacacagaatgacaacctcctgatagatagatgcagagagattggcagagaggaacagagacagaacagcgagaaacagatacaggaagatacatgcagagtgagaaacagggacagagagacagagggagatgaaaacagacacacatgcccacacacaaagagagaaacaggcagacacacacccccgcgccccctcccccatctggacccgccccaccaacatcctgacagatacaggaaggcagagagaatgagacagatggagacacaggaaagacatgcagaactagactgacagccataggctaagatgtcacagggaacattctactggaaggaggcagccatcagcttggtcttacttgtttcagcctcccaggatcaaatatgtctgaagagtaacaggcctttccatccactctttatttttagccacagaggaaacagtaagagagaagagggcagatgcttctgtttaccaggattttaattggctacctttggagcctgtgggcctaagctatgactattgtctagaagctttgggagaaaggtaaaaccacagtgtaaaatcacagtggaagcttggagctgaaatgattattgtatcttctctaaccttatacccagtaatgatgtgtttgtaaggccagtggtccaattttttctgcagagtgaacaaaccagtggctcccccactacctccatagagatgttttaacacagacacattctaaacagcaaactacatcggacg

SEQ ID NO: 1050 - DNA, 1053 bp, Homo sapiens
ttatctcctgaaggaccaaggaggctttgaagagaattactaagacacactcataccttttaaaaagtaactcttggtcaggcgcggtggctcatgcctataatcccagcactttgggaggctgaggtgggtggatcacctgaagtcaggagtttgagactagcctggccaacatggcaaaaaccccatctctactttaaaaaatacaaaagttagcagggtgtggtggcaggtgcctgtaatcccagctactcgagaggctgaggtagaagagtcacttgaacccaggaggtggaggttgcagtgagccgagatggtggcactgcactccagcctgggtgacagagcgagactccacctaaataaaataaaataaataaaataaaaaataattcttcaaaattcaatattttccaaacttattagaatctacaaggaactcaacaagaaaaaaaaacctcattaaaaagcaggcaaaagacatgaaaagacatttctcaaaagaagacatacaagtggccaagaaacatatgaaaaaatgctcaatatcactaattatgagagaaatgtaaactaaaaccacaatgaaatatcatttcataccagtcagaatgactgttaaaaagtcggaaaatgacaaatgttggaagatgtagataaaaagatatgcttatacactattggtgggaatgcaacttagttcaggcactatggaaagcaatttggagacttctcaaagaactaaaaatagcactaccatttgacccagcaatcccactattgggtatacagccaaaagaaaagaaattatatttaaaaaacacctgcattcatatatttatcacagcaccattcacaatagcaaagtcatgaaaacaacctaagtgttcatcaatagtggattggataaagaaaatgtggtacatatataccatggaatactacgcagccatagacaaaaaatgaaaccatgtactttgcagtaacatggatggagctggaggccattatcctaagtgaaatagttcagaaactgaaaatcaaatactgtgt

SEQ ID NO: 1051 - DNA, 1003 bp, Homo sapiens
agtggttgtggaaatcaagacttccaagcagtctactgagtgaaataaagttctctgggccagaggatgacttgacagaaggccagattctcagaaaaaattatactgtatagaaaaaaaatcccagtagacatgtatgctcaacagttctctagatgtagtggcttttaaacccccaaagggtgtgaaactcaaaggcaaaagtaggccttaaatgggaagcttcattaaaatgtatacagacttttaaattttatacaggctttaaagggtttatttatttatgcatcatgggatctatctctgtagttgacttacttctctcttacaattatttctcctctccttagatttttttttgacctatgcctccttcttcaagtttagttcaaaattaagacaagtaaggatagttacattcttgtctttaaaacatatgagccagcagcaatctctgttttttctctattcttggatgcttgactctttttaagacagagttggttgttttgaaaattttcatcctatactacgcccatctgtactactagatgtttaattgcttgggcaaatatttcaaaatacctttcactgtgtctgggatgttataagagctctacagatgtttgccgaattgaatttttgcttctctgtaaacagacttcttattagatatggtattactgacctacatggactcctctagttagctctttttctttctttcttttgttcttgtttgttctttctttctttcttttttttttttttgtttgtttgtttcaaggagtggaaagtttaataggcaagaaagaaggaaaaagctccccgtgcagagacagagggaggggtgctccgagcggagagagaaaaaccccatagctccttttcttagtgaagagtaggtcctctagatcagtacagtgcttttcaaactttaatgtacatcaagccacctgctgacccaaatgatttgaggcagggcctgagaattttcattttt

SEQ ID NO: 1052 - DNA, 1069 bp, Homo sapiens
tttatgttcactgtagcttggtcttgctgagccagcccttttggaggatacctgatttagtgtatataggtttttctctagagagacattgaattttttcagaaaacacctcatactcttgcttgggaacataacccttgcttccaggaggctgaggatctcaccattctgtgtatggatttggggctttcagctacaagttgaaaaccaattctccattgtgtccgttgctctctttatttcaagtactgagggaaaaaattttttgccttctctctgggagaggactacagttgcatgcctattctctaggtattgactttcaaccagtactctgttcctcttttaccccagcattttgttgtgctttttaagatatcctggactcttagtctgacttactacctctataaatgaaaattgcttgaattttcagagcctctttacccttatctgtagaatgtccaccttaggaattgaaagaattatttatgtaaaaatactttatggctggatgtggtggttcacacctataatccaagcactttgggaggctgaggcaggcagatcacttgaggtcaggagtttgagaccagcctggccaacatggcaaagcccgactctaccaaaaatacagaagttattctgcacctgtagtcccagctactccagaggctgaggcaggagaattgcttgaacccacgaggttgtggttgcagtgagtcaagatcatgacactgcactccagactgggcgacagagtgaaactctgtcccaaaaagaaaaacaaaaacaaaaacaaaaactttgtgaagtaactgtaaaccacagtacaattcagctatatgactgtgacttctttctatgccattagatgagaaactcatatatgacagctacactgctacagatttatatggtctcttttttcgtttttcttttctttctttcttatttatttatttttttgagtcggagtctcattctgttgcccaagttggagtgcagtggtgcaatctcggctcattgtggcctccgcctcctgggttcaagcaattctgcctcagtg

SEQ ID NO: 1053 - DNA, 1047 bp, Homo sapiens
atgccatcatcatttacatttttgttacctccttgtggatttgagggacgatatctaatagtacagaacatagcattgctccaggacctagcacaatgtcttgcctagtgtaggtgtttagtaaatattgaatgaattaaattcagaaccctgagggagaaaagtcacaaatttatcaagtaattcacaaagagacatatccctgacagctaatccagttaaaagtattaaggtaagctgaaaccagaatatgtttcaaatcatttctcttcttataagagttttgttactggctggaacagttgtttcttggtatgctgatcgaatgtgacttgagccagaaagattcacaatgaataacaccaggaggcttatgaatgatgtataaagccaaccagtctaatgacaggtaaggcagaggtgagcagttactttatttcagagcagccaaagtcttggcaatgtaatgcaaccacgggaatagtgagtggttgtgaccagtttgtagtaaacttctagaatgaaacaagctttaaatgttctgatggatatttgatcttttgtattaatggagccattgcttcagatgagcacaaatgaaaatggcccctcttgctcctctagtatttgcccaggggttacaaggatcagctaagtgctatggagggtattaatcactttttacttgcagtgaaactatatttgttttttggtaactagcaattctaatacagtaaaacttcaactactaaataaatatcattagtattatgactttaattgaagaccaaggtgtcaccatcttgaagaaaatggtgaaagtttactttctgttccctattgatacaccagggccaacactgatgacctgttaacaataatgatataatttttttttaatttttcctgaattttctttctaaaatctaggttcggcaacagaataatcaaaggatttattgctttgccattctgtgcctagcactgtgaatctctgtaactgacttgatagaaacatagatcataatatttttgggtggaaatgaa

SEQ ID NO: 1054 - DNA, 1035 bp, Homo sapiens
ccttggcatctgactctctgtggacccaggagtgaaatatcttcctggaagtggtgatccaggttagtcttgtctctctgactcatgtcccaagttgcttccatagagatacctgtggcatcttttccccctttactctgttttcctgaatttccctctatttttcactgactacaaagataaagaaaaagaagaaacaattttaaaacatataaagtactttgaaatatttatccttggataactggagactagatcacattcttatcttttcatccagcatttttttttttggtgaataccatattatgtgtttaaaaagacatatggagacctgactcacactctgaatcttccaattttccattgaccacattcttaatgccctgagaacacaaggtcaggcaaaggagcctctcagctgaggtcctggccccaggccctaaacaggtcttctgtgagccaggccacagagttccttttggttggggtcagtcttagcagaatgtagatcctggagcaaatttggtcaagcagcttcctttgctcccatcaccctaagcctgcactggggcctgacttctggcatctcaccaatccagtcatgagggatggctggctcagaaagagcaccttgtcaaggaagaagcagctcaagatcacgaaagcccaagcacatttgtccctgtgcccagaacagagctagactggtctgcctctccctgcattcttggggctcttcactctgtgtattctcagggcaagggttgtaccaagggagagcacactgtccagcctcctctcaccaattcattcagtcatttacccactcaatacagatttagtgagtatctgtcatatgccagacacagttctaagtactgaagacacagaagtctttgctcattttactccataacttgctctgaagaggtgcctccaaggatcttactctttcatgggctctgttctcgatcacttttgctcagtattgtgaaacctatgggcctgtgatcagaaaaaaaatgtctttaa

SEQ ID NO: 1055 - DNA, 1045 bp, Homo sapiens
ggtacttacttaacagatccttttttactgttaattttattattataaatgtggctgagaaaacagtatattcttcgtaatattgttgcaaatgaatcaggcagatatttaagggtaggatttcttgttctgttgggaagatacgtatgactgcctttgtcatctcaaacaaagttgcaaaaagtgtcatgacttagggtaactaatggtaagtaccatggtaatcaatccctaaattttctagtttaatttaaaaaaaattatttctaacttacttcactgtctgatgaaggccaggaaactctcctaggtaacttacctccaagttgtagaattcaggcccctttcatgtgtttaaatataacctttttttcttcccctccaactccccttcctaaagataaacttttaaatcaataggtatctcacagtactttgtgaaggaaggtaaaataaagtcaactcgaaaattgtatatttaattgattactgacctctataatttaaaagctgcttgatcttggacaaataattctttttcattgatgatcttggaacccagtgggaaagaactacagaacgaaatggtaaatcaaatatcgaagatgttttgttacttgaggaatcttctgttaggttggtatagcggaggaaaccttccaattgagttttgagtttaagtaacaagttttgctcatcaagctgggcaatctgggcaaaccaattaaccactctgggctttggtttcctcatttgaaacttagcatgttagccacactgattttgctaacatcacttccaaatcaaaattgcaattattctagtagaccatctctttagatctggattaaggatgaggcctacttggaggtgaaggaatcaagtagaaagatgtgaaatggtccctccctccatatggaaaaatctgcctgagatttagacagacactattcaaaactgtaagtccactgagcaccaactgcggtacaaaaagttaagttcccaggtctcatttacagagtagtagctgcttgttagttatcac

SEQ ID NO: 1056 - DNA, 1031 bp, Homo sapiens
caattttttgactccaatccttgtaaatgccaaaatgtctaatggtttctgtgtccccaacggtgcccccttgccatttgaaagcctactttcccagtctacccatgtcaagaatcagcacaatcttccagaaaaaaatgcagctgaagatcattattacacctgtccaatagccttcctttccaatgattttagcctctctaatacttattatctacaactatctattgcatacctttaaacagatgatttttgtgtttgttttgttttaaaaaaatcaacaggtaaatcaatctacttaaaactaatcttcatgcaacaaaaagcctgccaatctgttcttatttatatcaaactgaaatttctattagtttactgctctgctcttaggataaccagttccctagtcttaccatggcttttacaatcatattataatgtcttgtcagtagtaatttgagagggaagataggtgaacatgtcccttcaataagccatcttgaactagaacccccagggcattttgaaccttctgcctgtattacagttatctgattatatttgtctctactgctatgttatacatttcttaaaggtaaagactatatatgttatagttatctgattatatctgtctctactactatgatatacatttcttaaaggtaaagactttatgttattcatattcatgcttaccataatacttagcatatgtaatcatatatagtaggtattcatcatttatttattaaagaacttgtgaatagataactgcatgaagttcagagtcagtggctttcttggtatctttcacatgatgaatagtattgcttttaacaatccaaatattgtgtataatattatagaaatagaggcaaatatttcagttttttttttttttttacagaacgtggtatattctatgcccctaacaaaactcaagcaatattaaaaacaatttgcatctagcttctgggatttttgagagaattctttaaaaatgaaggactttaatcatctggtccctc

SEQ ID NO: 1057 - DNA, 1050 bp, Homo sapiens
ataacaataataaagttattttacattaaattatcatggtacagttacaaagtacttcacatatattgtcttaatttacccagtggagaaaactgtgctgtttagctattcaatatatgttttgtttgattttattatgaaaatatatgaagcaaaaagtctttctccatagaaaaatcaagtaaagcccatagaatagttattagcctagcatatatgagagtgctcagtgtaggttctttctcccttctgcccctctaaagctactttggctaataggcagtaaatgttcctaataccttcagcagtagagattagttatcatttcccccattatgtacaagaaggatccattaagcatcccaagtccagggaagggaaagggatgccaagaagtagacaagaggtacgagagtaccacatccccctttctcccacaaagacaatcatgccaagacagtaggctgtgttcttctgacctactagtttgctcctagttagaccgtagacttaatcttgcagcattggttcttgtggaaaacaggatgatctgttggaataaactgagtacctgagatacaacacaaagcaggtgaagcttgtgtcagcgcctctcccttgcatggacccagtgggagataaagagattatagaagaaaagaaactgaattaccaggtcttcaataatttgttgtgatctattttttcattctatttacttttaaacctactttgtatttgtaattttattttttcttaaagattctcacttccttcagtaatataggccacacaagctagatccacccttgaagagaacttaattcaaaagaatcccacagcaaatgactgcaaccttcacagccaggccagattcaggattcaatgctaaattagtggtggattcactggtgatgccaaattggtgatatcaaaagacaacaaaccaggctcaaatatgcaagttgaatgcagcattttttttttttttttttttttttttttgagatggagtctagctctgttgcccaggctggagtgcagtggctc

SEQ ID NO: 1058 - DNA, 1050 bp, Homo sapiens
gagaaggcacccagaaagcatttggagcccctgaccctggctctatcaccgcccactcctcttcacctcagacttcctggtcactccttcctactcactgagggccctgtggactggctcacatttccccactgcccaaattcctgctcttgctcagccgttctcccttgacaaactagctatcatatcaggtattgaccttttcaggacaagaaaaccagaataaatgccaagagacatcttgccttctctagcatagcatttggggacgcagaggagaggatgtgtgccttacataacttggaatggtggggagtgaaaaatcttacagagaagccaaagactattttatacaaatccacttttaaaaggggaattcttttccacatacaaagaaccagaaatactcattttgtcctccttttttttttgtttaatgtatatgcactcacagttgctaagaattaatactgaaaacatgattttttctaaataactccttgagaaggcacttaaagcctccatttgttatccaaatgtaacatgaggacaagaacagaagaattatttcataaagaaaataatcaatgaatcatttatcagttttcctaccctttgtatgacaaattgtaattagtatgatgtctttgttggcaagtgcttatcaaacaaaatgcagtacagaagcaaaggaagattctgtaaagaactgtgttgttttgaagacctaattgtgatgttatctctggaattttctgtgattacattgttaatttttaatctggtatccttaatagcaacaaggttattagcacctacctagagttctgaatgcccacattagataacacaatcttggcatggtgaacccttggaaataagcatttgcctaagatagaaaagagattcagaaagctctgatggccttggacagggcagaattttgagaaattgaatgtggcagaataaaaagaggttttatcaagcatctttctaaagtgctttcataaattttctctttggtaaagaatgtaccacacccgatcaaga

SEQ ID NO: 1059 - DNA, 1027 bp, Homo sapiens
acttttatgatcaaaaaattttctcctccagttgccattctgttctaaattttactttattttttgatgtaggaatgtttctttaaacatcaagattttagtttccagtagaaaactaatgaattattaaaggatgggaacttgaagcaatctttagtgcttaataaggagaaaccacaaggcttgaataaactgttccatatttctcttttaatgctccgtttaaaatctagacggtgtgtcataagccttttaaaaaaaaacgattgtgtttaccaatatagaatatgagatttttgtttctttttaggtatttttcttgcaattaggatatactttgatgttaccatggctatggcttcacgttccaaacaatgagttttttcttatgtttgattaaaccaaaataatgttagtataatttccctgtaaattattatttgttgacaatcagtgttaatgccactaaaaattgagtataaatatcaacaaagtacattggtaaatgattaacaggacaaatgaaaagaaaaatagaaattctaaatagaattgctatacttctccagaattcattcctcctagaataactccctcagggtgaatgaaaagtcaggtgggcaaagctgtgagctccacctccttcaactatacaaattttgatttggtaaaggaaattttgacctcattatttcaccctgctttgaaccaagtttttatgcacctactttattattgctctttgcatgtacattaaaacaaatattttattttgactttaacctagaatgagcactacagttataagcaattgacacaagataagtctaaaagaaccaaaaaaacatagagtaagattcgtgatagacaaaaagtgacttgctggcaatattaaacattgctaaactcaagcaacgaaaaattaggctaaatattgtcaacagtgtcaaaatgttctccattcataatctattattgatctacgataactaataaatctgtacactgtgattcatgtttttggaaa

SEQ ID NO: 1060 - DNA, 1032 bp, Homo sapiens
accaagcagcttgtaggttttcaatgccccaaggaatgtgtgcgccattcttcacactgttcttgctcctagatggctccccacatgctgaaaacccccaccttcttcccttaatgggtttcgatttagtcttcaaggcatgtctcaggcatgttcttttcccaaaagttttctgacactccctctgttaaaggacaaggtgcctttcctctgtcttttggaggaaatttaccagtgatcacactgagcatatatccgatagtctcatctcctcagctataaagtctttggttttagaacctgtattaattcatcttaacatcccctgtgcctaacagagtctaagtgctgagtaaatgggggctgaactaagctaaattccaaagatcaagccaagagttcttagttacttgaaaaacaaacaaacaaacaaacttctgacctttcttcattataatcttggcaaatcagaattcctttgccctaaaataactgtaatcaaggagttgacgctaaagtgatgatgagaactgtagtatcactacactaatgaatcttttagccttgtacaagaaataatagaaaaatccataaccagtttcacagagaactgctaataaaaatcagaaaacactataaatacggcattaaaaaaggtaaaaagctgggctgaagcttaaagatggaaatatttgcagaaaactaaggcagtgagaaatgatgtcctgtatcatgttttgatgtgttatattcatctttctggtgatgactttatttcacatgtaaattaggaaaaagggaaaggaaagcatatccatatcattcatgtccagggaaggaaagtgaagtatcttagaacagcttctcaagtcagctctacatagctgggcttttgaagtgctggtgaattttttttaatctcgccttctacaaagaaataacaaagcttagaaatttaaaaatccaggctactgtcaattctgtgactttccatgaatcagtctcgttattctttgacatcttaaaagaaaa

SEQ ID NO: 1061 - DNA, 1048 bp, Homo sapiens
ggaaactcaaagaaagggatgtatttttttttccagattgaatgggttagaggaggaaagacaagggtagaggtaactgaactgaatctccaaagaagtgtaggttgtagggcatagaatagggaatgaaaagccagaatgggccaaaaatatctgcatgaagccaaacagcacatcagttgacaagtttgttctttgacaagtgcgcagccacaaccaagggatagcaagtgtaaaatgcttagtagtaggtgaagacgaggaatgtgactaatctcacgaaccacctgtgataaagaaatctttgctttctgattttgttacaccaaaaaaaaaaatagaaaagccattagaaaacttgtaaacctggtatctaaactacaagcaaattgaaactgacccagctcactgttaagagtctctttgtgagggaaaccagagcattttcctgtaaagtcaacagggtttacagttgtaataggccattgattctgaatacacaaatctgaacaaaccacggatcaaatcagtctccctgaaagatggcagcttcaaaaggtaaaagccagatgcaacagagttaacctccatcaccactttaaagaggagcagagctgtgattgtctccactgaagaacaaaatgaagattgggtttaagccagtgttgtgctggtaaatatttgaacactgactgtttaaaaatgtgtgtgtgtcaaggacagaaaaccaaacaccgcacattctcactcataagtgggagttgagcaattagaacacatggacacagggagggaaacatcacacactggggcctgttttggatctgtagttattgggagggtcaggggagggatggcattaggagaaatacctaatgtagatgacaggttgttgggtgcagcaaaccaccgtggcacgtgtatacctatgtaacaaacctgcacatgtaccccagaacacaaagtataatagataatattttaatgaaatattaaaattaaactgccaagaatgtatatttaaaaaggtgtgtgtttaagcttatta

SEQ ID NO: 1062 - DNA, 1006 bp, Homo sapiens
agccattaggcaagagagagaaataatggacatccaaatctgaaaggaggaagccaaattgtccctggttgcagatgacatggtcatatttatagaaaactccaaagattgcaccaaaaaactgttagaactaataaataaatttagtaaatttacagaatacaaatcaacatataaaaattagtagtatttctataaaccaatagcaaactctctgaaaaagaaatcaagaaagcaatttcatttgcaatagctaaagaaaaaaacctaggaataaacttaactgaggaggtgaaagatccctatagtaaaaactataaaacatggatgaaagaaattgaataagacacaaaaaaaatggaaaggtaacatgtgattatggattggaagaattaatatttttaaaatgttcgtattacctaaagctagctgcagattcaatgcaatccctacgaaaataccaaagacattctttacagaaatggaaaaaaaaatcttaaattcatattgaaatgcagaagactctgaatactcaaagcaatctggagcaaaaaaataaataaataaagcaacaggtatcacactacctgattttaaaatacactacaaggctatagtaatcaaaacagcatggtactggcataaaaacagacatatagaataatgaaacagaatagagaacccagaaataaatctatgcatttacaaccaattgattttcacaaagatgccaataacatacattgggggaaagagcagcctcttcaataaatggtgctgggaaaagtgattatattcagaagaatgaaactagactcctacctctcacgatatgcaaaaatcaactcaaattaagactgtaatgtaagactgggcatggtagctcatgcctgtaattccagcattttgggaggccaaggcgggcagatcacctgagatcaagaattcgagaccagcctggccaacatggcaaaaccccgtctctactgaaaatacaaaaattatc

SEQ ID NO: 1063 - DNA, 1030 bp, Homo sapiens
taataccagatatcatttaatgagtgggggagttttattgtttcagtatttttacacttcaatagtgctttagagagacatgtcctcttgtgtttgacaaaacactgatttgcagttctggtatccctcctgagtaagtcttatttttgagataaacatcacatcagccccgagtgcaactaaaaatgagctgggccagggcagtggggactgcagtctgtcaaggctctgtatttaacaatgcctttctccagtggcctctgccctgtgcctcccacactgtcagctctaaaggatatttagtccttgcagcctcaaattctttaacccttctttggcctcttaagacaagccctgggtatcactgaaacctaaggcatgtccagaaacaagcacaaaagaagaatgtgaccactgctgcttaacctggccagagaaattcactaagtcttgcacctgaaaaaccgaaacaaaacttcctagcaaatcaggttcccacaatcaaaggatggaaaatctcactggaggttggaaaaatgatcagagcctcttcaaaacttcaggacatcaaaagacctcactgtactcttattagaaatcaagctggaaggaaacatcatagtccttcaagtgacacatgaacgaatggaaagccgaaacccactttctgcagcttcagaaattcatatttttattcattcaaccaacatttattgagtgtcttttatatttaaaacactttgtgggacagtgtgggacacaaagaaaaagaaagttattctgtctcccaatgaagtgacacacaaatggctgagtttggtgaagaaataactgcagtgagtagtggggtttgctgatagcagtggaggaggtggaagctcctctacagattagcttattgaaccctcacagctttatgagctcgggtctagcattaccattattttataggtgagggaactaagacacagggaagttgagaaattttcccaaagtcaacagttggtaagtgatgggatttgaacccaag

SEQ ID NO: 1064 - DNA, 1041 bp, Homo sapiens
taatattgatggtcttttgggttgctttcattttagggctactatgaatatagttgttatgaacattcctaaacatgaattttggtggactgtcttggtccatttggactgctataacaaagtgccatagactgagtggcttccaaacagcagaaatttatttctcacagttctgaaggtgagaaagtctgagattgggtgtcagcatcttcagattctgctaagagcacttttccacattgcagagtcatcttcgcattttatactcagctggcaaaaacatggcaagagagctctttgaggtctgctcagggattcttcaggcccagtccccattttaatttactccaacacactgattttcaaatgttaatacaaacttgcattagtagggaaaaaaaccacttagtcatgatgtagtatcatcctttctacttattatattttagcactgttttttaaaggatttttaaaaacgttttcacaagatagcatggtctgtaatttttcttgcttgtattaactttttcaggttttgatatcaaggttatgctagtgtcattaatggattagaaagtgtttcctctttttctattttctacaagagtttgtgtaatgttgttattatttcctccttgagtgtttgaaagaatcgaagccatttgaaactgtaattttctgtgtgaagatatttttaattatagattcagtatctttaataaatacagaaatagattttctacttccacttctgtcaattttggcgaattgtgttttaaaataaatttgtccatttcatctaaatgaaataaagttgtttgtaatattcttagtctctttttaatttctgcgggatagcttgtatatctttttctctttcctgttagtggttctccctgtctctctctctctctgtttaacttgacaggagtttcttgtaattgtttgtttgtttaacatatccttgaaatttttatattaattagtgttttcctcctcctgttattgggtttaatttgctgtacttgttctagcttcttc

SEQ ID NO: 1065 - DNA, 1073 bp, Homo sapiens
atttggatacaggtgtgcagtgtgaaataagcacatcatgaagaatgggatatccatcccctcaagcatttatccattgagttgcaaacaatccaattacactctttaagttattttaaaatgtacagttattattgactatagtctccctgttttgctatcaaatagtaggtcttattcattctttctaacattttttgtacccattaaccatctctgcctccaccccccgacacatccgcaaccccttattaccgacccttcctggcctctgataaccatccttttactgtctatctccatgacttcaattgttttgatttttagatcccacaaataagtgagaacatgtgatgtttgtctttctatgcctgtcttattttacttaacataatcacctccatccatgttgttgcgtatgacaggatctcattcttttttatggccaaacagtactccgttgtatatatgtaccatattttcttttcttttcttttttttttttgacatggagtttcattcttgttgcccaggctggaatgcaatggcacaatctcggctcaccgcagcgtctgtctcctgggttcaagcaattctcctgcctcagcctcctgaatagctcagtttacaggcatgcaccaccacgcccaactaattttgtatttttagtagacacggggtttctccatgttggtcaggctggtctcgaactccagacctcgggtgatccacccgcctctgcctcccaaagtgctgggattacaggcataagccaccatgcccggccttatgtaccacatttgctttatccattcatctgtggatgaacacttagtttgcttgcaaatcttagctattgtaaacagtcctgcaacaaacataggaatgcagatatctcttcgatatactgatttcctttcttttggctatatacccagcagtgggattgcagaatcatatgggagcttcatttttagttttttgaggaacctccaaactgttcttcctagtggttggactatttacattcccataaacagtgtacgaggattcccttttctccacatcctcgt

SEQ ID NO: 1066 - DNA, 1028 bp, Homo sapiens
ttcaacactcctctatcagaaatggacagatccaaccagaagaaaatcaataaggttgtagttgaactcaataataccaccaaacaccaccagtcaactggatataactggcatctatagactgctttatccaacaacaacagaatacacattcttctcaagctcacatggaatattcaccaagactacattctgggtcataaaacataccttaacaagtttaaaagaatataaatcatacagtgtctgctctcagaacacagtcaaattaaactagtattcaataacagaaagatagaaaatcctcaaatacctggtgattaaacagcacatttctaaataacacttgggtcaaataaaaaacctcaagagaaatgttaaaatattttgaactaaatgaaaatgaaaatttaacaaaatttgtgagatgcaccaaaagcagtgataatggggaaatttatacaattgaatggatatatttgtatatacattgaattcatatattagaacaaaagaaaaattaaaactaataaaagcctccactgtagaaaactagaaaaagaagaccaaattaagtccaaagtaagccaaagaaaaaaaactaataaaaattaaagcagaaatcaatgaaattataaataggaaatcaaaacagaaaactaacaaaaccaaaagctggatctttgaaaagatccataaaatcaatgagcctctagccaggctaaccaaggaaaaaatagagaaacacaaattattatcagaaatagaagatgggaaatcactacagatctcatggacattaaagggataataaagaaatattattaacaatgctatgcccacgaatttgatatgaaatggaccaattctttgaaagacacagccaaaactcatacaagaagaaacaaactatctgaataggtatatattattaaataaattgaatcaataactaataatctcccaaaacagaaagctctaggttcactggtgaattttaccaaacatttaaggaagaaatcatacca

SEQ ID NO: 1067 - DNA, 1082 bp, Homo sapiens
tatgtctccaaaagaccatttcaagtgttaggctgagggaaggggtttaaaaagaggagacttggtatgggaaacataagagtaacacaggatgcaggttcctatgtgttgttccaaggactatctcgaattattgtctgcctggagtacaggctggtgccattttatttgctgctgagttacagattatcagttttgaggtaatctccctgtagaggagaattcattccaccgctgggtctttttgcctgggttgttgtagcccctggaatttcttaacaagcatgcagttaggtaagtgtgcatggtgcaagggagtgtctggtgggaaagagaggggagcagagttcaaagaagatttcaaggccatattttaagacttaggacacaaagtttctacagtttgtttcaaggttacatcttaagactagagaaaaaggataaaaaaagttttaaaatgcatttcaaagctgaaatactcagttacactaatagttttgtactggtatctcactgtggtcttaatttgcatttcccaattggctaatgatgttgaacatcttcttgggtttgtgtgtgtttgccatctgtatatcatcttcaatgaaatgaaatgtctcttcatgtcctttgcccattttctaaattggattgtttgctttttttttttttttttttgagatggagtctcacccttgtagcccaggctggagtgcagtggcgcgatctcagctcactgcaacctctgcctcccgggttcaagtgattctcctgtctcagcctcctgaatagctgagattacaggcatgcagcactatgcccggctaatttttttgtatttttagtagagacggggttttaccacgttggccagcctggtcttgaactcctgaccttaggtgatctgcccgcctcagcctcccaaagtactgggattacaggcatgagccacagcacccggcctgttttttttgtttgtatgttttttgttttttaaagacagggtctctctgttgcccgggctggagtgcagtggtgtgatatcggctcattgtagcctcaatcttctgggctcaagcaat

SEQ ID NO: 1068 - DNA, 1050 bp, Homo sapiens
acttcaagtgatctgcccacctcagcctcccaaagtgctgggattacaggcgtgaaccactgtgcctggctgctttactaaaattttatctttttttttttttttttttttgagacagggtctcactctgtcgcccaggctggagtgcagtggcgtgatctcagctcactgcaacctctacctcctgggttcaagcaattctcgtgcttcagcctcccaagtggttgggattacaggtgagcaccaccgcacctggctaattttttattattttttgtagaggtggggtttcgccatgttggccaggctggtctcgaactcctgacctcaagtgatctgcccgcctcagcctcccaaagtgttgggattacagccatgagccaccgcgcccggccttaaacttttattttgaaagaattttatttaccaaagagttgcaaagattgtacatagaattctcgtgtatgctttgtattaacatcttaatattaatgtctgttataactctaatacaactatcaaaactaagattaacattgtaatcttaattttgtaagtaatattcttaactacactatagactttatttaggttttattacttttttccaccttatatccttcaggatcttatctaggttcccacattgcatttagttgtcaggtttccttagtcttctccaatctgtgacagttctttcagttttccttggtttatatgacctgctgcttttgaaatatataggataggtattttgcagaatgtccctcagttgagtgtgtcttatgttttctcagggttggattcaagttatgcatttttggcaagatgtcacaatatcaggggatacatgatgatgtctgtgtgccttgttactggtgatagtagctttgatcactggtcaggcatggtgtctcattcctataatcccagcactttggcatgacaaggtgggaggattacttgaacacagtgatgcatgtctgtagtcccagctactctggaggctaaagtgggaggatcgcttgagccctggagtttaaggctctg

SEQ ID NO: 1069 - DNA, 1046 bp, Homo sapiens
gatgataagatatgcaagaaaggtgtggatttcacctacatttgcagcacctctctccagcctctcaacagtgtattctttctccaccagatttgaaacgatgcttgctgacctcttcttgctaacgtcatgctatgtcttgtccgtgtaagccaatgctaatgtcttacctctctgcaaatgcctgtctcgttagtttagggggcaattggttgccctctgatctccgtattctgatggagtcagaatactttattttgttgttggagggttgaaagtgacattctttccagctctcaacattccaagcctttagctttattttagagttcctttgcttttaggtatttaatagtgtttgtctcccaagagaaagttaatcgcttcttgctctgatgttagtacttatataacttagtacttgtataactgtatttatcacattatgctgtaattatttgccaatatatctgtctccactcttagcacactgcttgagggaaatagaagagtatacgcaaaatgcaagatctgtgacctctgtatacatagtgcttcctgattggttgtaggcacttattatgtgctcatagaatagaattacagtaagattttaatttataacacagtcctggtactttaagattctgaagaaatatttgttaaataatttgtgaataaaatggcttatttagaaagtatttagaaatggatttagcttctatttcctcagatttccagatagttttttttaaagctcagtttaatcatccctgtaaaaaatcttgctgtgattcagacagaagattcagttgcgtgaattaatccttaattgctcaaaaaatattaacggggttgaattattttctgctcctattgactttggggtaatattgtttacctgagatcttcagagtagtgagtaataaattacaacatttaagatattttttaaaaaatcaaattgggctagcttgtcattgaaagagtgaaatgatattctcttgatagtatttagaaataggttagattaagagtaagtttag

SEQ ID NO: 1070 - DNA, 1022 bp, Homo sapiens
atttacacaagtgagtgatgcatgttttaaaattagaagctttctgggtgaatatattataaactctgaaatttttacctgaaatttatcattggcgttattgatatttttaatattagtatgtttatttgataggttcaagttgttccagtagcagacagaatttgacattatctttaagttctaccaaagacaaaggatctcaagtttgtaactatgctaatggaggacttttcagtaaatattcaggttctgcacagagtttggcctctgtaagtacagaaaaaatattaatttttaaaatttttgtttatatgtcttctgtgatctattagtttaagtgtcatatacttatagttcttagtatggaaatactcttaagaaatcgtctgaatgtgctttctttaggcaagtaaaatacctttttgctgactattagtcaatttggttctaggtttctttgaataagtgatgtggtctcatggggtcctgtgaaaatagtgttgatgtggaagtattgcttcaaaattagatgttcttgttttcacttatttgtgggagctaaaaattaaaacaattgaacttatggagatagagagtagaatgatggttaccagaggctgggaaaggtaacggggggtggaggggaagtggaatggttaatgggtaaaaaaatataggcagatagaataaataggatctagtgtttgatagcacaatagggtgactgcagtcaacacaaagtattatacattaaaaagtaactaaaagattataattagattgtttataacacaaagaagggataaatgcttaaagataaaggtgatggataccccatttaccctgatgtgatcactacatgttgtatatatcaaaatgtcttatgtactccataaatatttacacctactatatatccacaaaaatcaaaaattaaaattaaaaagagttattaatttaaaagaattagctgttcttcaagaagctggacaatgcagccagactttgtgctgggtcac

SEQ ID NO: 1071 - DNA, 1051 bp, Homo sapiens
gtctgagaagtgcctcttctgaatttcctcaattgaaagttgaagcccttgttgactagaagtagataaggtgaatttcatgataatagtgtaacaagtctttagaatcactgtactgtacttgcctaactgaactagtcattcctcttttgttaaatcttacaatttaacaaaaatataaatttaacatagttgccagtatttttatactgattacagtagaacattcaaataccaccctaattaattaggtgaatattttactcttcatttcagaagcagcataatctgtaggctatatgttgtaacttgttgctcctaggctacaaacctgtaccacatgctactgaactgaataatgtaggcaattgaaacacaatggtatttgtgtatctaaacatatctgaacatagaaaaagtacagtaaaaatacaattttgtaatcttacggtagggttgactgttgtatatgtggtccgtcgttgacccagatgttgttatgtcgaaagtgtctgtagttagtttgagatgccagcagaagagccaaatggagtcacctaaaaggcaaatgaaaatgtgggcttagatttctcaaaactgaactggaattaggacagaactggagttaggaatttgagaatcatctgcatagaggtgattgaaatgatttgctcagtggaccttgctaggagagggcatttacaaagatgatagtggcttttttattttaggtatcatttagcagagagtcagcattgtaaaacattctaaaagaaaaataagctagctagcttaaatcacagtaggtatagataaaatttataagtgaatgcttaaaagaataaatgatataaacataactgcctgatttctgatggaaataagtgatttacattcaaaatactactcttcttgtgtatttttgagcaaacaggcttagaatagagtcgtgatttctaagtttgattgattatcatcagaattatttcttcatgtggaaattacatggattgtcttaccactaataggatttataaaaataatttgtaaa

SEQ ID NO: 1072 - DNA, 1038 bp, Homo sapiens
aggttttgccgtgttacccaggctggtctcaaactccttggctcaaatgatccacccaactcggccttccatactgcctggattacaggtatgagccactgtgcccagtcacacagtccattctcttaatcaccatgctgtattgacttaccacttataggacagacgtcttccttgaatgggaggattaactgtgaactttttgtggacaaagtatgcctatacccaaaattccctgtaggaaaggtcagcttagagcaggcagcctggaaattccacagctgacagagtaaggagacttttatttctggtggtggtatgcttttgtgtagatcttttttttttttttttttaatttttcttcctctatactcatgtggtgatctgtagttagctcatgtgtctttcttcctttctcaggctttctaggcagatttcacacattttgtagaaagaaattgtcaaggtttaatccaagaacaaaagaggcaagctatgtgagacagagggcctgactgtgaccctgaacttagtgtagtgctaatgagttactctgacggattatcctacatctgtataataactaaaagtacagactgtggatgcagactaactgggttcaactcctgacatttccatttatctgtgtgattataaaacctgtctaagccttggcttcctcttctgaaaaattaacatatagagtaccaattttataaactgaggattaaatgaaagttctaggaacagggtaacaatgtgtattggctcggaatttggaacttctctaggacactcaggaagaccatcattttacctctagaatcttaggctgtcgtttttgttgttgttgttgttcttattctacctttctgatcctgtatttgccaatttcaagacgttctttaaaatttctggtccactgatatcctattcatgttttccagtgatgctatactttactccattaaaaaaaatttcttctgtccttctcaatgggcctttgggaggaaagagaagtaccttcttgaactagaa

SEQ ID NO: 1073 - DNA, 1283 bp, Homo sapiens
tttaaaagcttgcatagagagaaaaatcatatgaggaaacttttttttgtttaaactgaatctatccaccatcaaattgatttagagtatattcacatgcacattttgtggattagtgcacaaatagcttaattcaggcaatgtcactgcagtttcgttatccaaacagctgtattaactccatcttctaggaaatagaatgcttcttgaacctcgtcagcaatggatttcagcaagattaactcataatgcacaaagaatttagagtaggagatatttaataataatctgtaaaaaaatgttcttcataataacattgatgacagtgtaatgaaattcacctatgatggaggtaaagtcccatgaaacccaattttgattaagaagaaataggctaattatctattttataaaataggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggtaaatttttgtttgtttgttttctaagaaacaaatcaaggcagtttaagttagcagcattttcctttatgactaaaaggtgggttttcataacgttttcttaggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatctacatatttaaaccttacaattaatattaatgaagttagccgacttaagataaggtttactactacaaattcaaagagattttacatatagaagggctgattttctaattgtattcatatttcatatataaaatacatctaggctaggcacggtggctcatgctgtaatcccagcactttgggaggccaaggtgggtagatcacctgaggtcaggagtttgaaaccagcctggccaacactgtgaaatccctgtaatcccagctgcttgggaggctaaggcacgagaatcacttgaacttaggcgatggaggttgcagtgagctgagatcacgccattgcactccagcctgggtaacagaatgagactgtctcaaaaaa

SEQ ID NO: 1074 - DNA, 1078 bp, Homo sapiens
cttcctacaactcctacaaaaagctaatcttgtcatgaatattttagttttagcaagttatcaaggaatgtcagaggattttagccatatttcctaatgagaatagcattttaagtagaatgttttcaataatgccttaaatttgtagcaccattttgagttagtaaatttggaccctgcatttagagaagaggttaaactgtatttttggtttcaaataagaaatagtgcacatcttttggatggtttcttgtacaaactaatatgctgatattcaatcttttttttttgagtcacacatggtggcatgtgcctgtagtcccagctccttgggaagctgaggcaggaggattgcttaaacacaggaattcaaggccagccttggcaacatagtgagactctctcaaaaacagcagcaacaaacttattaattttttttgaaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggtatattacctttatatttaacatagttatggtacagtaatgataataaatttaacagaagtaacattggctttgaaataagttttagtacttaaaattaatcattggtatatacagtaatctgggaagtaaatagcaaaacacatgtagatcttagactttgaaagactagcattgtttcaaaatcacctttatcagtgttaaaacctatagtgaatgtcaaatggttcactctagcaaaaatgttcaaaaatattttttggctgggcgtggtggctcacgcctataatcccagcactttgggaggccaaggagggaggatcacatgatccaggagtcctaggctagcctgggtaacaaagtgaaaccccatctctacaaaaaaagatacaactaaaataatatattttttg

SEQ ID NO: 1075 - DNA, 1038 bp, Homo sapiens
tccaaaaacgtgattgttcttaaagttcagtgttagccagatttaataacctagtatatgtatgtgtccatggccatttttattaagggtttttttttgtttgtttgtttgttttgagagtctcgctctgttacccaggctggagtgcagtggcgcggtctcggctcactgcatcctccgcctcctgggttcaagcgattctcctgcctcagcctcccgagtagctgggacaacaggcgcctgccaccacgtctgggctaattttttgcgtttgtagtagagacggggtttcaccgtgttagccaggatggtctcgatctcgtgacctcgtgatccacccgcctcggcctcccagaatgctaggattataggcgcgaggcactgcgcccggcctgttaaggtctcttaagttaagaacagcattgtttcttgaccaaaatagattttgtagcttcttaggcgtagtttctcccaccccatcctgtgggtactcaaatgtaagatcatattctgaattgtcatcacaggactaggtatatatatatatatatgtgtgtgtgtgtgtgtgtgtgtgtgtgtgtgtgtaaattggtattttatgttatgtacttcagttaccaagtaatgccagacatttcttcagaccttctccaacatatcgtggcatgtaatttactgtgttaatagtagtaagctccaggaatcgtgaggatactttagaagtcttactctttattattgagtatatcacagtgactttttttttccaaaattatttgtttaaataacaaacaatgaggtaaaatgaactttctcgactttgtggcattttgtcttacttggttaggtctaaaaaaatactttttcagcagctcttaagagtaattgtgagaaatatatatatgctgcattctttctgaaaacctaaaagtaatgtgttcatttgcttaagcaccaaaatagcagttaatatgaatgtagatacaggtgagccatcatttccctttaatcagcttttaaggcagtagtatccattta

SEQ ID NO: 1076 - DNA, 1040 bp, Homo sapiens
ctatattgttttcttcttctctggactatcttaaaacctcttttatcctttccttattacaagtctatctccttcagacaacttgttagaaatatttaaatttaccatttcattttcatttccctcttaatgttcaatttaccacattctagcttttattggtcacaattctatctacctcatagaattctgagagactaaatgaggatacatgtgtttttaggttaatatttttttgagggctcaccaggattaactattactactgaagccaaaatcattctcactcttacagatacttttctatcatctttatttacttttctgtatccctcatgaaatagcttctgtcttttggtttttggacactagtggtgtcaggatgccttcagctccaagtaagagaatctcttaagtccaatgataggtagttccaagattgatttagagatgcaacactgtcaagttaggctcttactgtctttgtattctgccgttttcactgtgtcatagacgtctacctttaggattgtaagaatttcattattcaaaaacaggatgcagtgctggggtttctccttggtggatatctccttatagggaggaaaatccccagaacatctctcttacatctcattggctagaaccatgtcacatgtctgcccttaaacaatcactggcaaaggaaatactactgtgattgatttaaatcaaccctgagccatccccaagagactgggggatgctctcaccttccttgagttcattactctatttctgggagaagatatctgttagctagaaagaagatatgaatggttctttggtatgtaaccagcagtgtctgccgtagcattctcacctggttgatctctgatggttccttctgtcttttttattgtctcctgttgattgatgtgccccttaaatgctggtcatcccaaagttctgtctttgattctttccaaaaattgttcctccttcacactataaaatatcacttgcattaggatcctttctaaatatttgtctccaactaa

SEQ ID NO: 1077 - DNA, 1118 bp, Homo sapiens
tccttaaactactctctctctttttttttttttttaactactctcatttttctaatgagccaattaagatgacatctcaggccacatataagaaaagagtatgagaagagacattttagaaaagataaaagtgaaaatcacgtagattcctcatttccaagtgttgcttttacaattaaacattgtgaaagtgtatgtcaactgagcatgtgtaaatacattcctactaccttaagtgtaaagtattattttgaaaaaaattatcatattgtttatatggatgaacaatgtagtactattttataagtaaaatagagttcacctgttaagactttatttaccctaaatgtgcatgtgagaggtatgtatgtgtggtatacttgggctgagattcacaggctgagatttctgaaaaattggattatagtactgccgactagaaggaaccactagatctgcactgtccaacacagtagccactagccacatgagactcttaagctactgaaatgtacctatctgaattgaggtcaaagtgtaaaatacatgctgtatttcaaatatttagtacaaaaaataaagaatgtaaagtatttcattgataatttgtattttgattatatgctgcaatgataatattttggatttactaggttaaataaaatacattattaaaattaatttcacgtttgtttttactttaaaaaaatatggtttctggaaatgtggcttgcatttgtagcttgctttatatttctgttggacagcactggtctaaatagtgtgatctttcaacacaggcaaaatgttataatgaaatattagtttatcaagacccatttaaaatgatgtagaaactctagctctttttaaaattttttggctaatacagtgtttttggttttgagacagtcttgctctgttgcccaggcttgaagtgcagtggtgtcgtgatcatggcttattgcagcctcatctccctgggctcaagtgatcctcctgcctcagcctcccaagtagctaggactacaggtgcatgccactacatctggctaatctgttttattttttgtagatacgaggtctcactatgttgctcagctggtcttgaactccta

SEQ ID NO: 1078 - DNA, 1114 bp, Homo sapiens
tcggtgacagtaaaaccctgtctccataaaaaaaacttcgaacaatctgaccgtaacttattttctgccagcttcccagggcaagccttcctaatttgcatgcattaatctcaccagtatttttgctgtatcaaatacattttatgctcttttgcttcttgacttagtgttcctgatccaaattgcaaattctccctttctctgtcaaaatctatcagtctttcatgactttgctcacaattttctgttctgaagtctttcctatccccaccactccagcccaagttgaggataataattaactttttttttcttcttttctttttgagacagtctccctctgtcacccagtttggagtatagtggcatgatcttggcccactgcaacctccacctcccaggcccaaatgatcctttcacctcagcctcctgagtagctgagaccacaggtgcacgccaccatgcccagctaattttgtattttcacggggttttaccgtgttggctggtcttgaactcctggcctcaagtgatctgcagtccttagcttcccaaagtgctgggattacaggcgtgagccaccgcaccggcctctgtttgactatctttaaagctcttaaaacgatctcatttcgttattaactttttattgtttgtcttccccctctagaatgagttgaatgagagcaaggataatgtctatctagttaacagcacctaaaatagtgtgtgacacaaaataaacactccataaatatttgctgagtgattgaaatactttatttgtggaaaatgtgcactatgataaccacctttttaaacagtttgtgtacccatcaaatactataaaatggacagtcagatactgttgacaaattccaaatataatgaatccaaactactgtcattgcctaaaaaaggacatttacaggtaaggggcgtgggagagtaggatttctaaaacaatttaagcttaaatggatagggcttaatgtcttaaagacacttgccttaagtttatgtatttcagcttgtaacgtagataaggtaagaagtgaatctctttaaaatttctcagctgagtgcggtggctcagacctgtaatctcagcact

SEQ ID NO: 1079 - DNA, 1041 bp, Homo sapiens
gttttagtttagttgaagtaactaagttcagatactaaaatttcaaaaataagtatttgtttgccagaactatgaactcatgtatactagaaataactagttagctaaaatcatgtttaagtcctttacttattttaaaataacgcatttgaattttattatagatactcccttaacaatgtgaaactagtacacaaactttctggcgtttctgattgatagaccccaggaattttgaagacgacataaattacttggaaatcctaatttaaacaacctgcgttttggtattatatacttaacagacaaatagcttaaaattaaaaaatccctaaagtagaattgtcgttccttttatctgtatattaactttaacttcttttaacatagggtgtttaatgactgtgatgattttcacctagtatggagtacataaatatatagttgtgacattctgtgttgaaatattggcatgttaacccatttgtcctgtttaattaggaaataaagacggtagagctagtcggaaaatgaatagttaatcgtggaggaggagaaaacatagctcagtactttgactagaggcagctgggaaagtgacgtcctgtagcatttgctgttctagaaagtacagagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagc

SEQ ID NO: 1080 - DNA, 1036 bp, Homo sapiens
tagtcaaccttaactaattagtgggaatcattgttatagatagtattccaaacacatatttggtttgggactgcaaactggttgactggttagttgtaaaataatagcagtcttgctaaatcataggcaaatgttgcttctctggtgcgttttttgatcacacaaagtgatgacgatgtctagaaaacattttgaatagcagagggaatccaattggatattaaacatttccattagcgttcaaaatgtacatgattaagaactgaccatatagttaatgtgacattacttataattttatgtgctagacaatgcaagtgatacttgcataataatgtatattaaagtggcatgaattttggtaggatttttttcttttttttgttgtttttgagacagaatcagtctcctgagtagctgggattacaggcgtgcgccaccacgcctggctaatttttgtatttttagtagagacgaggtttcaccatgttggtcaggctgatctcgaactccagacctcatgctccacccaccttggcctcccaaagttctgggattataggtgtgagccactgtgcccagcctaggatttttttcattcattagagtagcttcgttctttgtctgagctgcatagttgactgtttaatagtgtctaggaaaacctcaaagctgcattggagtctttttatcagctttggtaagttacttcagactttgtatgaatcttctcagagactttgtaattatgaccgaattgccctttttggcagaggaggaagaggttttccagaaagccaaacccatgatgtaataaattaaaacattattctttcttttcatgaattcattatgggtgcaagtatttaaattttgtcttataagaggctagattgggcaggctgatttacccagtttacttaactcagttaaataattatactcccttaagtctatgggatgaaggataaaattatttaaataatttaagcattggttgagtcactttggtcatgaccttgagctacatattatt

SEQ ID NO: 1081 - DNA, 1008 bp, Homo sapiens
ttggtttggtttggaataaatattacaatttaattcctattttaaacatatttcctattggaaacaaagtttcacttttacagaacattttctgaggtccactttctctttaactatgaattattgatatatctgtgtcaccaacgtatcaatactttaagcatgaaaattatttctgtgttagatgggtagtagatccaccacaggtattactttatgggctgatattttgagttgttttaagcattctttgcattcctggcttcttttatggagagttgagtcttcatgaaaatttctgactgaaagattttgtcagaactttggtggtctggacacaagtgccttggggattaagttagggtcctcagacaggtataaacaaccttataaaaatacaggcttaagaatctcaaaataacatccagtactaatacttcagttgaatattttctctttttttctctcacatatctaggaggattttaatagatattaattactgagccattattttcctgcccaccttgtattttaaaagcttctgatttttaaaaatacccctgaaaccaagcttttagattcccatagttgtgctgtaatagtgacagcttccaggtcaatgccctatttcataccatgtgccttttctctctgattaactgtgaattgttggatttgtatttgaatgaacatctgcacacactctttggccagtgttcacagtcattttcaagtctcaaactggaacgaaggtagaggtacatgcactaaaaggaggaaaggagtaaggtggagatgatggtgtttgtgcttgacaggaactactgcatcaaaacttgtcaatagtggcataatttctaaaatcattgaaatgtataaattgaaatttatatttaagtttttgtcaaagctgatactttattaatttgttgagttttaatcaatacaaaggtaaaatgatcataatgtttgaattctctctcatgttaatagactctattttac

SEQ ID NO: 1082 - DNA, 1055 bp, Homo sapiens
agattgactcaagtgccaccactaaactgaactaattttagtgaaattgactggatcatcaggaagggctgattttttgtcccgaccagaagtatatatggattttatctttaactagactcatattatgctttagggttaaatagacatttattattaattctggctcaactcttttctgtgtgttccacgtgccttaatttgttggtcttctagtatctttgcatttggtctgtaggtttagattggctttttcaaagacaaattttctctaaaatgtatggatatcttttatttttgaaaggacactcttctcatttaaaactcccatcaaataaaatagatagatgccgaggcacagggaaccaacacatacattccagtaaagagataggtcccaaaacagtgaaccaacaaatgcattttaatacatagttagatgtccaggcacagtaagcaacacatacaaatttcaataaataagtagatgccgaggcacagaagaccaacacatacatttcaacaagtagatggatgctgagaccgtgaactaatacacacagtttcaataagcagatagaggctgaggcacagcgaaccaatgcacacatttcagtaatggatagatgcccaggcacaaaagacctacacacatttcaataagtagatagatgagaaaaaaattctcattaaataattaattattgtaccacaactttgagaatgctttgaaaaatctttccaaactactgtagcaataaactaaatgggccagttggaaatttcttgctggaaaaaacataatgtgttataggagagatggtttactgaaacgcctaactggtatggtctgtttttgctattaaaacgacgttgccagtggtcaaataaagtagccttttattcctgaatcattgtacctccaatattacaactaattactggactagttttttctttaattcatagatgggatgctaataattacttcagtcatgatattttagataaacattttttattaggatgaaaatgtcttatgcatctattattac

SEQ ID NO: 1083 - DNA, 1043 bp, Homo sapiens
tctatatagctaaaacgaaaaatacctgaaagttaatacatacatatgtagatatattttgttatgtgataaatgtttcttgtttgcacacttttggacttgagaaatctgcttttgttttgtgcctactctgagtttagaacccaaataagaggacttgttaaatatagagtgtactttttgttaaaactattgctagcttcacctgtataccatcattgttccaaattaaataactgttttgggtcagaatataaatgctgggaatatacattttattacttcttaatctgggtgtcaaagattttaccacctggtaaataatgttggacttcaacttgttactggcacattttaatagtagatgaaacatgtttttcttggttatgtgaataaatgtatgttgtgctcttcatacttgttggattgtatagagattaaatagtgatatgtatattttgttgtttgctttggtatgcaactcatgtaattttagtgctttgactagcttaaaacttcaaacaagtaattttataataaagttggactaatgtttttcaagagtgattatttttagaaggaccatataaaacttgaaacgcttgaacctaaactcccgttttatctgctactggatgagaagaatttcaacttaatttccattattaccttttgctctcccaccctgcccaatcttctgtgatatcttctctcttttacctgtgtctcaacttacctaggcaagtcataatttagatagaaatctgatttcccaaacctccaggtttagatatatcattcagaaaagcctcaatgtgtctgtaataagaaacaatctccaaattacagcgccataaacttcacaaaagtttgtatctcccacatggttcctgtccactctgaaggggagctctgctgttgtaatcactcagagaactcaggtgaaaaaacagccaccattatatgtggctgtttctcaaactacagagcatggtgaatcacacacaggctgttagaatatccatctggaggcaacacacatt

SEQ ID NO: 1084 - DNA, 1034 bp, Homo sapiens
tttgcccgagccccttgctggaaaactcaggagggagagatttgtcctttgacgctgtacacgctagtatgtttatatgattagcccaactggcggggagggcggatttgggggaaggaggaggaggaggctggaggtgactccagttcagacctcgcggagagtctgtgtcaggacttcgcattcccccgtctctctctctctccctctcgctccctctcactctctctccgctcacacacacgcagaggtgctggggcgaaatcgggagcttaccagagaattccttgggattgttggggggcatctcccctccgctgctgtgtgtggcgtggctcttcccggctactccttgcttccccgagcccgagtctgcgccgccagccttccttggggcagcggccaccgctcagccccggccgggagatccgaaatgtgaggaggggtcgccgccgcctcccgccccaggccgcagggtcggcgcgagggatgctattccggccgggcgctcggggggctgaggggcttcgcctgacaaactgagttggcctcgcgcccccggcgccctcccgcccgtcgcttcgaagggactcccaagtctgcgcacctctgtcaggcttttgcttccaccacccctttcgctctgattcccgatttttttttcctaagggagcgtgcggtctgggggtgtgtgcgtgtgtgtgaaagacctctctcgaagagcggcgtgtgggaaactgcgggaaaatgttgacttaaccccaggagccgcccggcgctggctgctcggctggaggcggcggcggccgagcaggaggacgcgccgagctgcggcgccgtgtccggccggggagctgcggcgctgcctcccgcgcggactcggcggccgaggacccgctcgcggccggcctcggccctctccggccggggtagccgctgccctccgcgcctgtccccgcgcggcccccacgccagacggccctccctcggggcgcgctcgcagacggaggtaagagccgcaggagcgaacaatg

SEQ ID NO: 1085 - DNA, 1051 bp, Homo sapiens
gtgtgagtcacggtgtcatgagaaaagggagatcctaatcaaaaatatttaacatttttttcctgagatcatatatctgctgcactaagtaggcaataatttgtagatattttttgatatattcttatccaacagttttttaaaagcttattttattattattatttttttacaaaaaacctcctatatttgacaaataaacattatctaaaggaaaaaaaaagtagatggaataaaggaaccaagcgcttaacatctgcaagtaaagtgcagcttatagcaaaatactattgattggtttggaagtagaaagcaagtttaaatacaatttgtttaattacaacgaaaatgcagttttatgaagtaatatagtttgtcttcacagataattttatgcattgtctggtagtaagtaaaatcccatcacacttatataagtttgttcaattaccagaatgactaaaagaaaaaaaatcaatttaggttgaaaaacaacagaaattagattaccttggtttgtaggaactcgccagcagtgtctacattgcttaataatatcaaaagttaccatgttcacagtgtaaggatattggcgccagttttgatatgcatacatttgttttcttggtgacttttgttagatgcagagttttttctttctgcttttcatttttgttttgtttttatgaaagctattgcatgacatacgagaaactacttccactggcatattctcatttattttagaggtttgtttttaagtagttgcttttccatattccttggatttattatcagttgatattttagattagtgaaatatcaggtgtaatcttaagaatcaaaagaaacctactccattataagatataaataggttattatcagcgaccaaaatacattttggcaattcttactactgattctagaattacattgaattctaaatcccaaattcctgtggcaataaagtagcatgggattcatcgtagcagatagctgggcacctgttttattaccaccttgattaattctggcacccagatttacg

SEQ ID NO: 1086 - DNA, 1069 bp, Homo sapiens
atcttgctactacactccaacctgggcaacagacctctcagaaaaaaaaattcctcttgagagtcttactaaaataaaaatcacaatcatattaaactttcaaaaatcaggtatttcatatgtgggtacaatctcttgaagtatgttatgcttttgtagttcagagcagctatttcctttttttacagataaggtcttggatttactttaataattcacagcatttataatgtcttggattttacattcaagatgtaatttttggtttcctacattgccacagaggttattgtggcagcacatgtggttttaaaaatttgacagaacttctggtactgagtttgccaaaattaccagaccaaaaaatacgcatttgcttgcattggtcttaaaggctgtattttgaaatgttgattgtattttattctttccaagaacgatcctacttataagcatattacatctaccttgccattacttctgggcttaattctattaattttgtttagatcaacagccatttattaaggccatgccaggaaaactgtactgttatgtaaggactgtgctcactaggttcactaggttgtgaaatatttgcacaaataattcttataaaagtcatactacgatatcatgccaaaatgaagtgcagagaaaaggttgtaaaaatatagggtaggttagagtaaattcaaaatgagtggtatggaaaaagagaccccatttatttagaactgaaggcagaggaggattgtaggctatatagtcttttctgaggaggagaaaagttcagaggtaaaggcacaggaaaggtaaaaatatagtgccttagggggaatgtgaagtgtacagaaagtaggagatgaaacgggtgtgttagtttgggacatgattatgaacagcctgctcttttaagattctcttgtaggccacaaaatgttgttgatattttcaattgagaacatgttatacttatttgatagcattcaaggtggtgtatccaatgaactagagtggggaactaatgaaagaaataggaacctaattagaaggggtggacgacagt

SEQ ID NO: 1087 - DNA, 1033 bp, Homo sapiens
tggaatatcaacattagttaaccagttttagaaaattgtagtttaattttcttttgcccttattaatttgaaatgtgttatactctctttcagtgatgcttattaataaacattttattttttctacatttgttaaataagcctcatcacataataaggctaggtgtgatttcctggtaatgtaatgtaaatatgtgacttaaaattagttagcggtgttgtccttttaagtaattttgcggacagttttaggcgcgggatatttaatgcagctaataaatggaagcaggttactgtctgaaagactgcagctgactgtacattgcacgtagtgtataaaacgttgagggctgttgggatatacacagctgaagcatattcctggaagttactgctcagctttggaaggtttgatagtaatgatgcattaacggactttttacatgacagggtaataggatacttagatcaaaaaaaatgacagaggtttggtagacaatggtttgtggtttataggaacaagattaggatgaaattgtttgaatcttatttgaaggataaggaaaaagcagaggtgggagtaggttgtacgttagaagtggtttggatttttgaaagtcatagtcatttatagtttaagtagaaatctgttgtatcttgttttactaagaaatgaactattacgtagcaagcattaccaggagcttcaccatgcactacacctctaccctcccagttcctcccccacttcatcctaagctctttgatgttcttggaaaaaggttttctaaaaatcaaaagaaagttattaatgtgggaatcatttgaagtaatcttttctgtttgttgaaaggaaatttaatagaccttttctggttttgttatttgtttttgttttgctttgtgaaatgctgttattgagctttttgcagttacagaatttgaaggacaaatgttagctgttatctatgccagtggtttggctccaatatgatttagaaggaatgccttcttgggattagtgtcatgatat

SEQ ID NO: 1088 - DNA, 1046 bp, Homo sapiens
gcatagttgctatgtttgtcatttaataatgaagagaataagaaaattctccccgatacaacattgacttaattgtccttttataatacttcttcaaagtatgatcattatgaaatgaaaatgtgaaaacacttggaggaaatgaacctccatggatttgagtaaaaatttattttcctttttatttagcatttgcaagtgtatatctgatgtgccatgctgcctctagctgtgtgtctcgctggcttatttctgttctcatcctctctgtcaacttagaaaaaaaattagtaaattctgtgtttattagaaatacatactttcatggttttgacagctgagaagtactgtactatgtaaataaagatataccaacataatgaactttttagctttattaaattattttttaactgtgcttaagaaaaatcttattggtatttaatctgtatgaagatctgatactttaaatttaacctgtaaaaatcaacatttttttggtatagtagaaaaacgaactgaactgtcaggtcattccaagagcgaagaggcagaggcagctggtccagaggagaggctctagttggtgcataaaaaatatatgtcagcattttgacactgcattcttttggggtatctgttatcactgaataggaaactgtttcaaattgacaggcagacagaatgttgtgctgaatgtgtaaattggaattatcacatctagcagttcccttcaccaggtgctgggttggaacttggttctccactaatcgagagagtgccaggaatagttttatttgctaattatccttcacctcttccaatctagtttttttagtaaacagcttgcctgggtgtttttaggaatacctagcaggacaatgtacgactgcaggtgcttatgtggcaagaggatgccatacagaacactgaaaacacctatatccatctgtgtgaaaaagatgattgctttcaagggttttaccccctaatgtcctgagaatgctgcttgtcagtagtttgttggcccagagatcctggtgacg

SEQ ID NO: 1089 - DNA, 1007 bp, Homo sapiens
ttaaatcctaagcaaattcagacatcatagaaaattggaaagaacattaaaaattattagaaatccttacttccagaaactaacattttcttggaatgtttcactgttttttttttcccccataaaaaacgggccaggcgtggtagctcacacctggaattccagcattttggaggccgaggcgggcgaatcacaaggtcaggagttccagaccagcttggccaacatagtgaaaccccgtctgtactaaaaatacaaaaaattagctgggcgtaatggcaggtgcttgtaatcccagctactcaggaggctgaggcaggagaatcacttgaacctgggaggcagaggttgcagtgagccgagatcatgcctctgtactccagcctggcgacagagtgagacttcgtctcaaaacaaaacaaaacaaaacaaaaaaacacttgactggtattctatattttaaagactaaataacaggtaattcctttgaattattttttaaaaagaccttttatttttattttatttattaacttcctatttttgtagagacagggtttctctatgttgcccaagcttgttttgaattcctggcctctggtgatcctcctgccttgacctcccaaagtgctgggattctaagtgtgagccactgcacctggcctcaggtctttttaagtgtacattaaagttttaaatatgcactatcactagcaaattttataatcatataatgtatgagttcagtcacttagatctctgttcattggaaaaataccccatggtaacatgacacaaaaggtactttggggaagcgtaatttctaggaattcaagatttgggattttggattctctgagtctacctttgggtctaattagttactttctctggttcaagctcccttatcttaaaaattaagaaattattttagaagggggccaatatttatgctgactttcagccgtgaaataaagttagtctactataggagaatatttgcttct

SEQ ID NO: 1090 - DNA, 1048 bp, Homo sapiens
atagtgtggttaaaaggctttaatttgaggatttctttatgttgattatgttcaccaagccatttccctgaccatcagacacagtttcctttcctgttccttttcttccccaagactagtagcagccagcataccataacgatgttctttacaactctgtccccaaacctgctgctgatggccatcatcgtttggagaggcattaaagtaacatttaagaacatgaacccaggagctgaattactgggtttgaaatcttaatttcatttttattggatataactgtagaaaacttaatctttctctgcctcaacttcctcctctgtaaaatgttgataataatgttacctatcttgtatggttgttttgaggattcataatcaggaaatatttatacagtccttagagggacttctgagggtggcaaattccctctaaaacaagtgtaaaattagaattgtcaacaacaaccattttgggagctggaaagtaaccaaacaacaaacggggaaacattatttatgaaaatctactagaacttctagcagatgtttaaagccttctagcatcgggctgctccttatcccccgcaatccctccatctcttactccttaactatgtcattgtggaagtttcatcagggcaagattggccttcaaaaccagtggctttactgccatgaagagctgacatgatttggagtagagagtggaaactcatgcccagcagtgttgtcaatgaaagtaaacactgtagggaaaaaaaaaaatggggaaaacctgtagctctgctatcctttggttgtagttccagttgggatgactggaaaccattctgaaacttaacagggaaatcttggaaatgaagaaaccataaactttctgtgcattcttaactaactgggaagctaaacacatgtacagaggagacatgagaggacttggcagcaagtaaataactgagtctgacttgtaaactacttgaacttttaatactctttctaacatacaatcacatcagcaaagagtggagacttaataatgggcc

SEQ ID NO: 1091 - DNA, 1047 bp, Homo sapiens
gtcgaaggtgggcagccacatctggtgagggcctcatgctgcttcctagaatggttgaaaagtggaaggacaagggaatgcaaaaaactaattaattcctttgagaactaacccagtcttaaaacaaaaactttggggctgggcacagtggctcatgcctgtaaccacagcactttgggaagcggaggtgggcggatcacgaggtcaagggttcgagaccagcctggccaacatggtgaaaccttgtctctactaagaatacaaaattagtctggcgtgatggcacatgcctgtaatcctagctactcaggaggctgaggcaggagaattgcttgaaccggcgaggcagaggttgcagtgagccaagactctgtctcggggtgggggcagggggaaagaaagagttataaagacccagtcacctgttaaaggcacgacctcccagtatggccacactgaggactaagcctctacttgagtttgatgggaacaagccatattcgaacgatagcaagtaccatgatctcttttctccagtagattctgtattggcaatctactaaattattaaagtgcactgatctttcttttctttttccttactatacttttttttttttttgagatgggagtttggctctttttgcccaagctagagtgcagtggtgccatcttggctcactgcaacccccgcctcccaggttcaaatgattctcctgccccagcctccctagtaactgggattacaggcatgcgccaccacacccggctagttttgtatttttagtagagatggggtttcaccatgttagccaggctggtcctgaatcccctgacgtcaggtgatccacccgcctcagcctcccaaagtgctgggattacaagcgtgaaccacagcgctagaccttactgtacttttctggatgactgtgaccaaagctttaagactgccatccctgaattatcaaaacggtaacacactcaactatgccaattcccaaataggtttcaaaagcagaggaaaattcacttagaatgataactcta

SEQ ID NO: 1092 - DNA, 1021 bp, Homo sapiens
aattttgttctaaatttggactaaaaaagacagtggctagagtactaagtcagttggaatttgctagtgtatatggagaagtgattagtagctaaatacttatcccgccttccttttaaataggtaatctatttcataagggtttgttattggcattgatgatacaagactatatccaaattgacagggttctctgagaatcaggtacggctgattgaggcataattggatgtctggtgtttattttctattaaccatgtttatttatgagcagaaatagccagataatcattaatcattatttaattttttcaaaaacaccagattcttatgtgctaggcatataatcacctccaataagaatttgtaagttggcagcttcttttttcttttattattttctcttaaactcccactttctagtagtttctaaatttttaaaacttgtgtacctgaacagaatgtaatttacttattaacatataatttatttttacttagttattgaggctcaagaatgcatgtaattcctattctattaattaaagaacagattcatattgcaatagttcgtctgtagatattctgtttgtttagcatatacaattcacctaaggatgtggtttaagctcttccaggaaatcctgtgtatgttttgtttatacttggcactatgaaaaggagtgtcattacatgataccttggtaccttggaagcattgatttcacctccaaaaagtgagcacttttaactgagacagacagaaagtaactcaggaaaaaaaaaaagtcttaccattgctagtattttgtaattgaagtttaatgaataaatagccactaaaatatttaaattgatgaagcaatcttcatcgaagatgcagactcaataaaggattgaactaattctttaattagtaattgtataatttcaaatttaagcaaactttaattttttagtttctgtcatgatatactgagcttttctgttgaatgctggaatatttgttcaaggcggtaga

SEQ ID NO: 1093 - DNA, 1050 bp, Homo sapiens
ttactttagaaagtaatgctaaatttttggaaatatactttggtttattaagtgagttcagttttgtgggaaataatttttgatgataaacgaatacttcattaaaacaagattatctcatactcatgatgaaagaataatttgttaatgtattattatagagcttgcactgtttataagtcttctatttgaacagtgtttgtttaagatctgaatatcctaatttactgagttaatcttgaaattattgcattatttcaaaattttaggaactagaaagttctttggagtgattaaattaatatcctcaatagggtggggcagagactaatatattttttcttctcttaaagcaatgcaagtacacacacttaaatatgttcataacaaacacatacccatacatattttaagatatgctgttaatcagttttaaatattgtcatacggtcaggacctcaaaagcagaagtcacagctctttgtcatggaatttctaatttgagtcattgtagaataccaaaatacatgagttttgttcatataataacaataatgatccactgacttagtgtacatcccctttttccctaaatcaggttatgtttgtattttttggcttatagttgtagcagtaatgttcattgttaaatttataacaatgaaatcttcttttagggcatataattttattgatagtatcttagaatcatttatttaaaaatgtatacatatgtttgctcatgaggcagcagtttggtttgtttcatctatttcaattgtttttccaaaagctgctactacaatagtgcttctttatcctataggtttgtcaaaaggcaaacttaaggcattgacagacttgtattggcattggctaaaattgtattgatccttatgttaacctttttgtagcctgtattagtctcacagttgttagatttgtcttgggtagcagtaaattttttgtcatcctcagaaaaaaaagaaagaaaaaaaatgttttacaaattgcaaattcataatcaggcaacaacctgaagaattgtga

SEQ ID NO: 1094 - DNA, 1083 bp, Homo sapiens
taagcagttttggtagtcagtgcagactcagactccagaggactactgcatataaacttcgagctctggaacaccagcttaatttttgaggatttcttctttcctcattttcagcagataaaaatctaacctctgatttttcttttcttttacttaaaagctccaaaaacgagagaagacatgcagggcttaccttaaggtatctctcctgtgctgtcaccctgctttctcccttcttcagctacctgccacgctttatcatcttgctgcatgatccaatgtatttcagtctttgataattatataatgtgccccatatcagctgtacaaatgttggcttttcacaggtatattactctcagaataagcaaataatttacttttaatgatttctgctgtttttccattcatccaaaagtacacgaattttaatgaaatatcctcttaattggaaagtaattatgtagtctctttgtttcctgttgtcatctctgtggattaaaaaacaacttgagtaaaacagctatgatatattctcggcagtttatcatatcaaagactgtatagtcataatatatgtgcatgaaaaagtcactgctttcttatctttgtggtatactcttaaataaaataggctttattctgaaatttttaggagtcatttctagaatcaggttgatatggggatgggttactaaaaatgaaatatgaatataatttgactgtgatatctgtatatgttacatactgttttttatcaagctaataggaacagaaagccactgttgagctcagaatccctgtccactccagccgggttttctccctggtatatccaagtaataggaaacatgctgaggctgccatagtggttctgtgtgatagatcaaaataataataccaaattgcattttgttttgttctctgaattttaggagttccttttggggagatattactttctaaccttacttttcaggggaccataaccatggtaaatcaaaccttgaagaacgaatccatatattgtgacaagaaaacaaaagaacttttgtagtttcttagactagagagtattaaaaa

SEQ ID NO: 1095 - DNA, 1049 bp, Homo sapiens
ttttttgtaaagatttttttttacattaagtggatgttgaaatttgtttctgtgaatactttttaaatttctctatttgatgaattatatgaatacattttctaatgtattaatttctatatgcttttttaacttaatttactaaaaatttaatttgtccaggatattataaaatgtgtgtatattttattaaagattttttgcatcattttaatgactgaaagtatcctatatttttttgtgaaatgagttagggatatatctttttctgttttctgaaacagaaaatagaaatcttatttaaaattcagtatgtatttatcagttgagttttttaatggtcataaactattagggtttttaatttcttttagtcagttttatttttctaggaaagtttctattgtcttttaaaaatttattgatataaatttatctatttgttggtacaaagttcattattgcattttcttatggaaatatcttaagtagcttgaaatatctactgagagctgtagtcatgatcttactacttttaataatttaaagtttttctttactgtgaacattattttttaaactctaataagtaaatttctgtttaatgaaattaaagtttgataagtaaatatttgtttaatgcaattaactctttgtacatgtatatctatgtttgggatgattcatgaaaactcagaggatattcttctttcatcctgtcttgttttaagatatgaaagcttctttcaatgtgaggaagaatcagttactttaattaaacttctttccctctttcctccctgccgcccacacagagtctgagaacagttcatccatctacccagcagcttaatctttccaaacaagtatcagtaaaataagtgtatcaaccagtttctgcagctgatagaattttagcagttacatgatgctcattataaatttgtatttcagggtttgacatgtggtttaattgcttataaaaatgtatgaatgttattatatttacacctaaatatagatgtattttacaaaacagagttgcagaa

SEQ ID NO: 1096 - DNA, 1051 bp, Homo sapiens
aatcaataaagagtccagccgagtatacctgactgatcctgtgctttttaccctgccacacattgatgtaagttaatgtatgctaatgaagtaatggaaggttataaaagcagaaagaaaggaaagcaaaactgaggtgctggggatggggagagaactggggagatgggagggaggaaagacaagacctttccatttgaattttaaatgttggactaggtcagagacacaagtttatttaagtctgtgaacataaaattaaatgagcttggttcagtgattattagaacttaagtgtattcttaatgaaagctaattcagtaatcaacaggaaaatgtaaatgactctaatttgttttcaaatgaaaattaacccttaccttacttagcagcaggatagctgagtattaactcttaggactctgcctttctgtgtggcaaaatttttttcattagtttactgatcacgtttgacacagctgttaccaagtattgtgtttaaaaaaacagttgaggagatgtgattcctctgctgtgccttaaaatgcaagttgatacttacgtaactacactgtattggaagattgtctacagaatgtttggctgttgtgataagtagagtgaataaatgcccacagataaaaaagtggatctccaaataggcaaagaaaaataaatttgtgtggttatggtactcatatctgcttcagttgattgactcttttttttttttttttgagacagagtctcgctctgttgcccagtctagagtgcggtggcgcgatctcggctcactgccagctccacctcccgggttcacgccattctcctgcctcagcctcccgagtagctgggactacaggcgtcctccaccacgcctggctaattttttgtatttttagtagagacggggtttcactgtgttagccaggatggtctcgatcttctgaccttgtgatccgcccgcctcagcctcccaaagtgctgggattacaggcgtgagccaccgcgcccggcctatttgattgactcttaagagcttgtaggtact

SEQ ID NO: 1097 - DNA, 1105 bp, Homo sapiens
attttctgaacttgtattgtgaatgtattgtatgtgtaactagaaagatacattaaacacatgtaatgtcaaaaacctcagttaagtgaggggagcaaaagaggagaaatgcattgaacagtctgtttttaaaggattaattgagataagttttctatggcatattcaccttggttagtattaactaggaagaatgactttatcatacttaagtcttgattgtatttttatattggtagatttcattttagtatgtcacttttattggaaagttgtccctgatttttgccattgaaaaatatttcttctgagttcacttctaagattttatcattttctactcctcttctttttgcaatataatactttatatgttcacatttttccacattcacattttttagtttccttataaattttatacattgtagtggataatgaataacttctttctttccagaatgttttagtactactaatattttgttcccaagggaataattaatatgcttagaaaattatgaacaccaaattatggtcctgtacacttcaggaaattgtttaagaagagcaaggaaaaaaaacccttatgttcagaagtttgggataaaagaaagtaaattgttcttatcaggccattcaaaaacaaagagtcagaaacaaagggagaacaatttaaaggattttaattgtgaatctgcaaagcagccatcttacctattatagtcagtttatttgtttacttgggtttttatttctctgtttatttttaggatgtttatagagttcttgtttttaaccattcttgaattttactagttaaagctagtgttgcataaaattaaaaaaaaaacacactcttaatttttgcctttaaaaaataattagaggtacactttaccatgattctttaaaagcctaatcagatatgtactatactaccaaaggacctctaatttctcaaaggcagaaattgtgtcttacctcatccacaatacaataagcacatccttgtacggaacaaggtcaataaatatttgttgaatgaaatgtatcatattgtaacatctccgaaaattcaagcatttatttatattatgaccaa

SEQ ID NO: 1098 - DNA, 1045 bp, Homo sapiens
tcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttggtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtagttaacatgtgaacttttatgtatgatacataattggctttaacatgttggtccattcccaccttggtttaagtaacgtcataccaaagtccatggatatatgaaaggatacaattaagttgcctgtttgttctttatgctgaaaggaatatatgtcttccaattgcccactacatatgcacaaaatctgctggataagttttaagagggatatattctgaaagcatttttgtttgttgcattgtaccaggactaaaaaaagaaggattggaagttctgccatcaaatttgggtatcataaaaagtttttaactgatttttcagcagtattgggaagtttcttaaacatactttaaggattataaatatccctatagacagctgtgaataccaatatacattaccctggaaaagttttactccaagttcaaaaatcatataattgaa

SEQ ID NO: 1099 - DNA, 1083 bp, Homo sapiens
atagcatgttatgtgtcatagggaaaattatttgaaatgtcacgtgttgattaatgtttgtaatttcatttggagcagtgttatcaggtatatgttgctgttctgtagtgaacaaagaaattgtattttaaacttaatgaaagaactcatcattacgtacctaaatgttctgtgtattttttaaagaattattcttgaaaatttgtttttcaaaacttttagaaatatatgatgttagagatcagcctgtacaatcattccctttcaaagatcctgacctccgaagaagctggagttgagatcatactgttagtaataacagagtaaggaatagagtctgatgcctggactccattcagcatcaataaataatcagttaatatgtttattttcaaaatattcaccaaatgttttagtttcaattaaagactataagtaaaagctgaaaaatgttactgtctaatgggaaagaaaatatgtatatataagagttacctgaaaggcaaaaatacaagtgctaacattatggaaagtggaattagaactctgaaaattgctgtatgaaaatgtttgatttgaaaagttgattaaaaatatcaagtcagttaagatttcaggttcagttagcaccaagcttcagaaaggcaggtgattccagagcttatttctaaaaatattccagaagaatgaagttaggcataaagataatttagaagggtcttggttaactttaactatctggtgcctgtattgtactctactgaaccttttccctctattagaattaacattttctggggtaagacctaaaagctaggtgagattccatcttcatctccacaggttttggagataacattaacttaggtacctgttgttctgctgtagtgaattaggaaattgtattgatgtatctcaaaacttaatgaaagaataactggtactattacatacctaactgctctgtgtgtgtttttaaaattactcttgaagatatattccttttaaaatttgggcgtagttatttaaacgtcagctaatacagagaaacataaacttttagaaatatgataaaattctcag

SEQ ID NO: 1100 - DNA, 1028 bp, Homo sapiens
gcatagagagagcccaggccagcccacagcactcctggtcaggcagccacaccttggtcctcatctctggtcccttccgatctgaagcctcgtgcctggctcttctgccacctgcatttctctttcttgctgctgttttgtaaaaagaaaaagaaaaaagaagcccaaactagtgagaataatttataactctctcggtttttgtaggtctgtaataaagaacttagtcatcccacctcctactgtgaagagcagaccctgggtcccacactcaaatcccctgtagttgcccatcctcacccctcagggagccccctcccagctagcctcccgggcagggggcacagaaaatgagtggtgggctggggagccctggagagccttgactctgtaaggctcgaggcacctcctttgccccttaactggcctgttggtcctctgagcagggggcttaactgtgaacaaatcagacaataaagcaagggtctgcacctaaaaagacaaatttatgaatcactgtactgatctttgaagatattttcatgttctactacaagtaaaggagccatcaaaatgttcgccatcagggcagagtcttggaaataaaacatgaaacattctattcttatgtgaaaccattaatgtgctatgtgtagttgtggtgttttgtgtatagcagaaccagagaaagtttagatcagggcagctaacaggagtaagagcatgggaagtctattctgtgtgaataaactgtatatatacatatttcatttaatctagaaaaattaaagttacatgattaaagtgtataaaatcaagtggcatagacagaaaatctgggattgctcacctaaacttgaaacactagaactcatggactattcttccaaacttataaaagctagctgtagaacaagtaaaatgaattatcgtaaaaccttgatatagactgggcttagacaataaatgtatttaactgattagtcatttatgtttaaaggtgaaacatgtgtttacaaattcaggta

SEQ ID NO: 1101 - DNA, 1027 bp, Homo sapiens
tcatattcctggtgtcactggaaagctttcaatattttggaaccaggcagaaaatttttaagatatcctgttatctgtttaaggaaggtttcttctattcctggtttgctaattatttttcctttgagaatgggtatttaattttatcaaatgttatttctgcgtctgtgagttttgaatcttaaattaatattgcatacctggaataaacccattctggttgcaatatattgtccatttcatatccttttttaatgtaatagtgaatttggtttgctaaaatgtctcagtgtgttttctttttatcattattccattgttttttctttgactaatggctacattggttagttttcaaatatttgggggtttttagcttagtttcactgtgttcagagaacatgtttggaatgatttcagttctttgaagtttgttgatacttgccttatgggtcacctttatagccatatacagtagtcatttgtaaatgttccaatgacttttgaagagactgtctattctgctttcgttgcctacatgtactctctctcacacacacatacacatacacacactaagacaattaattcacactgaattcaaggtattctgtatcatgttatatttctttagagaggacttattttacttctggtgtgattcaatattatttttactaattgcagtcatgtggtatgtaacaacatttcagtcaaaaacatactgaatatacaatcatggttccaaaaattatactacttcatttttaatgtactttttatatgtttagatacacaaataccattgtattacaactgcctacagaattcagttagtaacatgcagtataggattgtagcctaggagcaataggctatccatatagcttagatatgtagtaagctatacgatctaggtttatgtaagtgcactctatgatgttcgtacagtgacgagattgcctaatgacacatttctcagaatgtatccctggcattaagtgacacatgactgtatttaacactc

SEQ ID NO: 1102 - DNA, 1033 bp, Homo sapiens
tttgcgcttattccttcatgcattctctggtctaagttacttgtgccataaataagtcttgtgtaaaggtgtcctagtgatgaattatgtcagtttttatttatctggatttgtgtattttttaccttcactttttcaggatatattttataagtatggaattttaggttgagaattactttctttgaacactttgaagatgtttcatcatgttttgttttccattgttttgttgagaaatcagctgttagtctcagtgttgctttatgaaggtagtatatctttttttttctttggttgctttgagattttctctttgcctttggttttcagcagtttcacaatatgcctaggtgattttattccccctactttctgtttgcaactttttagaatcatggctcaaaatgtttcatttatttaagacagttttcaataagcatatcttaatatgttgcctctatcccgtcttttctttcctattcttctgagataccaattacatgtatatgtaaaatttctgatatataatttcaattattatatttttaatctctagattttccagttgatttttgagtttctacttgtaaatttttctactcatttatatttttgtacaaattaatcatagctatattaaagttcatgtctgaatttacaatttttattaccagtgtgtttttctatggtatgtttgttctcttatttttggttatttggtcttatcttttggcatgcctaggaatctttaattgaatgtattttgtatcatgttatatttcttaagagaggacttattttggctgatggttagagttgggtcagattgtgttgatccatcaacaattaagatgacttgttggctgttctcagtctttgtgaggcttggtctatttcctattcttactcctatcgatggagcctttcagtggttttgactgaaggcctggtggtgtttatcagggccctacctcatgctagccctgaacttcaatttttctttcctcactgtgagattactgaaatattt

SEQ ID NO: 1103 - DNA, 1051 bp, Homo sapiens
catttaggtctgcttgcatgtctcagagcagtagaaagcaatattatcagttgtgaggaagaattatgggaaaagtgttggaagtttggtaaagaggagaaggtataaaagtcatctagaagagtgggagattggatggactaggggagtacaatatgattgccagataacagtaaatatactcttgaggtttctggttatgaacttcaaatcataaaaagttaagagtagtttgtttttctccagtcttacccagctgcacaagtgcaggcacagtgtaggtatagagatttcaccagggttctggttttgccaagcaagtatagacaaaacgagagagaggcaagtggctgaaaatgtatgctggaagtgattataatgctcggctttggaatttgtgcattttaaggaggaaaaaagataatatttggggtatcaaggatcctgaaaaggattagagatcctggtaaggtttaaagattgttgaagttgagatcttaaaagagagtgagctaaaaagatagaacatggttagagagaaagggtagaatgaaatgggctaagggtatgatctttggagtcaatggctaagacagggtagggtgggaatgtacatattaaatgaatttagatattgtattagaaaggttagaggatatacatattcgatgaatgtgtatatcttcaattaactacaaataatccaattttatttgtagtgttaagtatagtaagaaatataagtacaatacctgtttaaaaattttacaaaatattttagcaaagtactttttaaaactttaatttttaacttaatgtaattttcaggtaaaaggataatatattcagtgcattttaatggcatgagtttttaattaatgttgtatagtcgaagacatagtagtatgttagtttatatattttctagaataacatatttcagtttaaatatgtatttatttttgaatttaaaatattcatgtttgaatggttaaatgagaatgtacccttatttctgtggaaatatagcttttattaacagcaaatataa

SEQ ID NO: 1104 - DNA, 1050 bp, Homo sapiens
ggatcatcaagaataaaaagatataaaagtgaatggggacattttagaaagttattcaccaaaactttaataattataaaaagtggcttttatctcagaataaccctatgtagtaagaatactgaggcttagagaagataagatcacacatttaatggcagaattttgaatgatgcaaactccatcagtctgattctaggccctctgctcataagcaccatattataccatttccctaacacagtgaggaaaattttcttttaaaaattatgtacttaaaactcatcaaatctgaaggaccttagaagatctatctacctacctatcaagtttgtagagtattacatagctttttctatgtgtcaggcactgttatcaatcctataacaactcatttaatctttacaactctttgaggtgggaaccatgattgttcttattttatacaagaggtaactgaggcatagattaagtaacttgtccaaagccacacagttaaaaagtaggcaagctaggacttgaacccaaacagtgactctagagtgttgttaaccgtgccatattgactgcctttctaaaaatttgtgaagtttttacttcatttagttttctccttattataatcttttcaatgataagaaactcattacgctgtaaggctatgtgccagtcagagttacaccagagaaacagaaccagtaggatatatcggaagagatatattgcaagaaattgacttattgattgtggtggctggctaggtaagtctaaaatctatagggcaatctgcaatgaagggcaagctggacctctcaatcacaggctgaagctgtactttacaggctgagtttcttcttctgggaagcttcagttctgctcttaagggctttcaactgattgagtcagatccacccaaattatctatggtaatctcctttacttgaagtaaactgactgtggactttagtcacatctacaaaataccttcacagcaacacctagatcagtgttgaataactaacgactataccctagccaagttgacacata

SEQ ID NO: 1105 - DNA, 1145 bp, Homo sapiens
caagtatatgttttatggcttttgcctttggtatcatgctttaaaaggcctactcatactttcagctttttcattctgctctgttcttccccaaagtgcatgtgtatgtgtatgtgtgcatatatacatgtatgtctattcagattttcccataaaaacatgatacagatagccctccatatccttggattcaaacaaccaagagaattcaaccagccatgtatcaaaaatattaaaacaacaaaacagtaaaagataacaatacaacaatatgaaataatacaaataaaaaacaatacagtataacaactatttacatagcatttacagtgtattaggtattataaataatctagagatgatttaaagtatatgggaagatgtgcataggctatatgtgtgacagtgtatgtatgtttacatatatatatatgtaagtatatatatatacttgagtttttcccataatgttcaatttcctctggaaagaaaatgtaaacttgcttcctctatgctgtatcatcatcttattctcaaattcccttcaaaaccaaactttttaattagtagggtaacacactgcttccattttcttactttgtgtttacgcctcaaatcctctgaggctgatatctattccttcctgccgtggcaaaagtcatcaataatttgttgtgagttttttcccttactctatagtagagtttccctaatctatagtgttttccccaagtgacttattcactaattacttcatgttctgtcagttccaattactttctatctttgtgacaacatatatctcttctgtgctctgagtgtaatttttgctggatatgaaccctgcaaagtcaaattggggaaattatcgtttcctgaatctgcacttcctattttggtgaaaatgatgcacctctttagtcatataagccagaattttgggtgtcatcttagattctttaattttccttgtcttctacctctccttgttgactgagtcttaggaatttgtcccttcatttctaatttcactgattctagcttagttcaggtctttatcaccctttttgaggatatctacaacagtttcttagccattctccctgccttcaatttccctagtcgatcttccaaatctaatctaa

SEQ ID NO: 1106 - DNA, 1034 bp, Homo sapiens
gttggccaggctggtctcgaactcctgaccacaagtgatccacctgcctcggcctcccaaagtgctaggattacaggcgtgagccaacatacctggccgtactttttaactatgtcttgcctcatttggttcctggctaaatctggcttttcagtcttctcatccattccatatgtactcaatctaataaattcattttctgcttaaattgactagcatcaatttttaatttacatttttgcaactgacaacccagactagtacaggtcctaaaggggactctaattcacatgtcctcccaagaaaggcaggtagcaaggtatcttatttgtatgtgtctgatagggctcccaagaaaccagtggaaggtactcttaggattgatagttaaagtcttaggcacagtaatcaaggaacctaagaccgagtgacagaggaatgtttttacatgggagaactctgagatacagtgttagaaattccctaaggaggttagtaggaaatattttccaagaataaaactgacagaggattaatatccagaataaagagcattttataagtcaacataaagagactaaaaatgaaatagaaaaacatagcaaaggatataaatggataaattactaaatatgaaatttagatgatcaattaacatatgaaaatattttatttcactagtgatcagtgaaatatgatttaaaatgaggtaccttttttaattcaccagattagcaaagatgaacaagtcacgtagtatcacatatgacaagcatgtcaaatgtaaattgggatagccattcctgagacaatttggttgtatcagttaaaatgaaaatgggcataaactgtgacccaggaattccactgttaagtatcttctgagtagaaacacttatacatgttcaaaaggaagtatgtatcaaaaaaagacatactggtgaggatgcaaaggcatgggagccctcagacattgctggtggaaatataaaatggtacaggtgctttggaaacagtttttcagtttcttaaaa

SEQ ID NO: 1107 - DNA, 1803 bp, Homo sapiens
tcagttgagggtttatgtgttctaagtcctgtgataggtaccaggaatgcagagataaacagatccattgtaaacagtcaaatgtaatagaagaatcatatggctaatctgccatatattaagtcatagtgtctaaattgcattaaaccagctcaatataagaacaactgttttcttaaaagttatatgagattttataaaagattttaccttgccattatatagtaattatgattgaacttaccaaattaaatgtaatgtgacgtttactagtatttttccattaaattgttagtgaattaaaaggacgttttggaattatatgggggatctttggaagacttaattttttcatgggttgtataaatagatttatgagagggaaaatggatattagtttctgatatggtagtttatgtgagaattttatagtttgatttgtataaataaaataatgttattgcatatttctggtacattacacttttatttgtataataacctaaacttgtgtttatcttatattgctaaaatttaaggtaatgacaataaaagatttttctggtatgtatgtgaagcctaaatggccccattctgccaccttctggctgactccgtagcttataatattgtgaggtaagtgtcatctaaccgttctgccatggttggcagcagaccatatatttggggcctgggtgatttaaaacagggtcagtttaagcaataatgtagttctagtgcctcaggctcacctttatttcatagttctaaaatgtgttagaatttattggaatagaataccacatagtgatgtatgagattgtttctcccagggtatggagttgtagttaattttgacttttctgcaatactaaagtttcttcagatattacttgataattaaaactgtatcaacatggtaagctatttatcagaatcatcataagaaagttacttggagagtgatatagaaatgaaagttactgaaatcagcaccaattccttatagagaaactaatgggttcagtaatcacttactagagttctaaaataaaaggagaaaccatatgtacaacaacaaagtactaacaaaatcttagtaatttaaacctctagttttgtgacacttctatatattgccatttattaaaaaaaagaatttgggaaggcttaaaacttttggaaatgtaattcatttaaaattggtttgataaactttttggagagggatagagaaaataaagtagaacgctataaaatgttgcaatttgtgaccttttgcagcacacttaacctctttgtcactctggaaaatgggataataatatccaatataaaggtagattgttgtgaggaataaatgctttatttacttcatgtgaaacacttagaatgatatctgacatataataagttagcattgttatagtcaatcttacaacatttagaatatgttacatagtctaatataaatggattccaaaatattctaggcagtaagctttgtattttcttaacatttttacactcaataatattaaattaaaagagagaaattgaagactggaaatgcatagctccctaaagtagtgtagaaatatatgtgatatattggggcctaataaagggcctttatttctgtctgtgactcatcttttagatacctaaagctatctcataaaaaagctatggtatcttgaagaaattaatcaatttaaaaacatttattgagtgtatactgtgtgatcatcagtgtgttagattctggtaagaaatgatatgagaaactcacaaaaagaagta

SEQ ID NO: 1108 - DNA, 1030 bp, Homo sapiens
catgcaggtgagtgggtacagggactgggacaagtgcttctgggcatccgcaggagtagaatcctgtgcagtccagtggaagcttcctggggggtgggggggaggggaggggaacctgtgacctccggagtcctagagggcatgtgttacagtgtgctcatttagctttgccatccacagacaacttaagtgtttaacagatcagtggagggtcagggtgacagccttttgcacccgccctcttggtacccgagtacttgtctggcatccaggaagaataaggtcatatgaatgaattgaagggtggtgaatgtggaggattttactgagcagtagaagtggctcttggcaggatggggagctggaaagcggatggagtgggaaggtggtcttctcctggagttcagccgtcccctgtggaactcttctgcgaagtcctgctgtcaagctgttcctctgaagtcaagctgcttctctttgatgtccttctgctgcctctcttctctcctctgccactctgccactctgctggtggggcttggggtttttatgggtacaggatggggaggtggggacagccaacatggttttggaaaaggcaaatttgggcaggaaaacaggaatgcatgttctcactttggactgcaggtccaggcttgagagtgtggccctcgttggggtctgccctcttctacccagtatttccccgcctcctgtctatatcacttcctcacccttccccagcttaataataactggcatcactacttattcacatgctcaagccaaaaaaagtaggaattatcttttattacttttattaattttctgggttcaatgaatcatcaaatctccttgtttttcaaaaatatatatgaaatctgtctgtttttctttcccaccacaacctcagttcaggtatccatcatctcttgcctggacttttgcagtagtccttaactatttttcatgtttccattcttaccttccacctacacagaagattcctgaatccattctcttcctagta

SEQ ID NO: 1109 - DNA, 2092 bp, Homo sapiens
tagtgactataatattggacagtgtaccctagactcaaacatatgaataaaagcaatttgaattcctggaagaaaaattagagaatacttacctttcaatgtacagcatatgttttgagcaattgaatattcttacattagaattgtgagattaaataaatttccatatctctttttatgttgaatagtaagatcattgtttttgcatattgtattaacttactgcttaatattcagcacaattataaacttttttagtttactatactttgagatatatattactattataattttaggtattctggtgagttcaaggataaaaaacatggagtgtaattgtgaaaatttgtttatgtatttgaaaatatatcagtttgccaagagtgaatcaatttcatattaataatgacaccatacttgatagtagtaatcatgaaattttgtataaaaattacattttttaaagaaatgtatgcatgtaactttttgtctcataaagtactgtgacaaaagtactacaactttactgtggatttactcagaaaaatgtatgtcaatttcacactgagattaaggtgaagcatgttgaaagtaaaacttttatcttttacattttttatttctaaatctattattaaattattaaaatcagaagtgatgagattagcttctagttccaattaagatggagtaagtaaatgcacatcactctattcctcccactgattatgcctaaaaaagattctgaacagaatacataaagtagctgtagaaagactttgaaaagtaaatatagcaggaagattggaaagggaaatcaaaacttgaaaagagacaaatacagtagtgaatttcctgcttttagcaatttcttcctacatcctccagcttagactcaaggcagtcagaattccagaactgtacagtggattcagacagaaaatgctgtggctcacgcctgtaatcccagcactttgggaggcccaggcaggcagatcacgaggtcaggagatggagaccatcctggctaacagggtgaaaccccatctctactaaaaatacaaacaattagctgggtgtggtggcgggcacctgtagtcccagctgctggggaggctgatggcatgaacctgggaggcggagcttgcagtgagccaagatcgtgccattgcactccagcctaggcaacagagcgagactccgtctcaaaaaaaaaaaaaaaaaaaaaaaaagagaaactctctttctctaatgagagaccctgtaaggaaatccctggtgacaaggaaaaaaatcaatgaaattccatttgtttgtttgttttctggtcctgctttgagacaagatatactcctaaaactgcactcctgtgtcagtggcagtagcaacaatgaccaaacaagtacctcaaattatgagaaagaatggagacaacccagaaaagagtcagtgaattagaacagaagatcaggagaaattgtctattgtaaacaacaggaaaacatttgtttaataaagggaaaagagccttaagaatctgtaaaacaatataaaaatgtctaaccctacaggtctttgaaatcacagtagaagaggaaagagattgctgcagaaatttctaaaaaaattgaatatgtaatggctgaaaacttctcaaatttcgcaactgacataaatttacagattgaagaagcttagtgaatgccaagaaaacaacatccaaagatataaccaaattactggaaaccaaagagataattcatcaacagcaatgctgctttaaaagaaatgctaaggaaagttatttaaacagaaaataagtgataccagagagaaacttggaacttcatgaaggaaaggaaagcaacaaaaataataaatatctggataaatataataaattgttttttctcctcttaagttcattaagatatgtataatggtagaaataaaaagttaacaatattgtctgttggggtttccaatgtgtataggtcggaaacaactaataatatgaaggagaagactttaaagagaaccaaatgtctgtaaggtttataagttacccatgaagtgataaaattttaat

SEQ ID NO: 1110 - DNA, 1078 bp, Homo sapiens
atacacaaagtgagcatggggcatcttgcagtgctagaaagtaaggatgtgctcaaacacatacacaggtgtacacacatgcacacatacacagtgatggaggtatatcaaagggacataggaggaagttgatggagcttcccatggtcaaaatggaataatttgaccaacaaaataaataatgtaatgttgtataaatgctacaggcattaaaagagtaatgtgtacattagaaacaactttattacacaaagttgacaacttagttgaaatagaccatttcttgaaagatgcaaactactaatattcattcgagatgaaattgataactcagtaatactctgtttattgaagacattgtattagtatttgtaatcttcaaaaaaaatcaaaaacaaaaacgaaaaacaaaacactgtcccagatagttctgggaaattctacaaaacatttaaagaagaaatgataccaattctcacagtttcttctggaaaaatataagacagaatacttctcaacttattttgtgaagccaatcttaacctgctaccaaaatcatgcaaagatggcacatgaaaataaaactaccaagcaatgtatctttatgaacacaaacagaaaaatcctcagtaaaatattagtaagttgaatccagcaatatatacaaggaatattacaccaagaccaaaaggggttcattctgataattcaaagctggttcaatatttgaaaattaatctgtgcaacccaccatattagtagactaaaaggtaaaaaccacatgattttatcaacaaatgctgaaaacacattaggtaaaattcagcatcctcctaagataactcttcactaacccaggaaaaaaaaaggaaactttgttatctcaataaggggcatctacaaaacagtgtctacagctaacattttagtagttaatgatgaaaaactgaatgctttcttcctaagacttggaataaggcaagaatgttcattgtcaccaccttgttcaacattgcactgtaattcttgaccaatgcaataaggcaagacaaataaataaaaggcatacagattagaa

SEQ ID NO: 1111 - DNA, 1061 bp, Homo sapiens
aggtaagagggttccagttttttcacatgctcatcaatgcttggtatcatcagtctttctttcttttttttttttcccctcctgaaacaaagtctcactctgtcacccaggctggagtgcagtggcgcaagtgattctcctgtctcagtcttgagtagctggcattacaggcatgcgccatcactcccggctaatctttgtgtttttagtagacatggggttttactatgttggccaggctgggcttgagctcctgacctcaagtgatccgcccgcctcagcctcccaagtgctgagattacaggcatgagccactgcacccgtcttatcagtcattttgattatggccattatgtgagtgtgaatccgttgttcacagttgtttcactttgtattttcctaataactttatgatgttgagcatattttcaagtttttataacccatttgtgtatgtactttggagaaatgtattttcaaatcttttgcccactttcaaaattgagtcgtttttcttcttattatcaattctcaataattctttgtatattctgaactaagttcttttccaaaaatataaatatcaaatatttccttctagtctgtcttatgttgtcatttttaaaaatgatgtatttgaagagcaaaatttgtaattttagtgaagtccaatttatcgttttttcctttttggattgtacttttggtaccagatcttaagaaatttgtatctaacgcaaggtaatgaagattttcaatctgtacttccttctaaaagtctattttttgagttaatttttatatatgttgtgaagtatgaattgaagttcttttttcaacatgtagatccattttttactgcactacttgttaaaaagaatttcctttctctatttaattatcttggcatctttctcaaaaatcagttgaccataaatgaaagggttcacttctgaattctcaattctgtcccagtgaactacatgtctgtcctcattcctatactacactgtcttgattactaaaactttaaggtaagttttgaaatcacatagtgtaag

SEQ ID NO: 1112 - DNA, 1029 bp, Homo sapiens
aaaaataaatatgaggaaaaaatgtatgtaattctaacagagccttaaaatatacaaaacaaaattgacctatgtaggagaaattttatagatatagatagagaattcttacccagtaattgaagaatacataggaatatgtagaacacttacaaaattaataatatgactaaatgtattcaacaaatttcaaatgattgatatacaggctacagtatatcaattcttaattacttaactaccacaaggcaattaagttcaatcagtaataaaaagctttaaaaaaatcacacaaatgtatacatttggagatttaaacattttaaataacttaccaaataattaactcgtaaatttaaggtgtaactatgtatcagaacttgtggggtgcagcaaaagtggatatagagttaaattttaagtgctcaaattaggaaaaagaaagacattcatgatataagaaaacaagtttaaaaagccacatggttaatcaaaagaagaaagaaactgataaagacgagcaaagatcagtgggtggaatagaaaataaagatacatgagaatcaaaggttagtttatgggaaaatattttaaagtactaaatagaactatacctgttttaaaaattgaatcacagaatctttatgcagaacttaacaaaattaggactggagagttttacatacaagttttaggaaaccttcaaagaacaaaaacttcaatcttgtatggaattttccagagcattgaaaaagagaaaatactcttaaatgcatttactgattctagaatagttttacaagtcaagtataggaaaagaaaattagatacattttctctgaagttgggaataggaaaaggatgtccactgccattgtttctgtacatcattgtactgttagtcataacctgagcagtaaaacaagaaaaacgtggagagaaccaaattgtcattattcacaaatgatttgtgattggttacatagaagactcaagtgaatctaccaatgtgatttcagaattgataac

SEQ ID NO: 1113 - DNA, 1134 bp, Homo sapiens
taaaaactgggcaaaggacatgaaaaaacacttctcagaagaagacattagtgcagccaagaaacatgaaaaaaactcaacatcacagattattaggtaaatgcaaatcaaaaccacaatgagataccatcttacaccagtcagaatggcaattattaaacagtcaagaaacaacagatgctggcaaggttgtggagaaataggaatgcttttacactgttggtgtgaatgtaaattagttcaaccattttggaagacagtgtggcaattcctcaaagatctagaatcaggaataccatttgattcagcagtcccattactgggtatatacccaaaggaatataaatcattctatcatgaagatacatgcacatgtctgttcattgcagcactattcacaatagcaaagacatggaattaacccaaatgcccatcaatgatagactggataaagaaaacgtggtacatagacaccatggaatgctgtgaagccctgaaaaggaatgagaccatgtcatttgcagggacatggatggagctggaagccattatcctcagcaaactaatgcaagaacagaaaaccaaacactgcatgttcttacttgtaagtgggagctgaagaatgagaacacatcgacacagggaggggaacaacacacactggggcctgtcaggggtgggttggggagaaggagagcattaggaaaaatagctaatgcatgctgggcttaatacctaggtgataggttgatagtgcaacaaaccaccatggcacacatttacctatgtaacaaacctgcacatcctgcacatgtacttaaaataaaatttaaatttaaattaaaaaaaatttttaatcagctgaagaagacttatttgacaatatatgggaggtcttcaattctagttatattttgtaaatctactattttgaaaagcctgcctagtttcatctctatgacccagttttctcatttgataaaatgggccttatgtattttccttcatcagaaatgtgtttcaggtttttgttttttgtttttttggcttttttttttttgtaatacagaccctttatcacctaccttgtgccagcagaaaatattaaatagcactaggaaatactcatgaagt

SEQ ID NO: 1114 - DNA, 1132 bp, Homo sapiens
tgggcagacaaaaaatatttattgtgaagaatatggggagggagaatagaataaaataagagaaaaacgatgctctttatttactttcacattctttcaaaaattttttgatgtgcaagtagtgttctgtatattgtagatattaattccttgccagttctaaacattataagtattttcttccagtcgtcatctatctttttgtccatggtgttcttccttggatgaaagtctttaattttggtataggaaatcaaaattaaggatattaatccttatagtttgtgcttttatgatctttttaaagaagttgttctctacccttaattcaccattcttctgcattttctgtaatagttttatccttcatatcaaattccattgtacttcaactttgcatgtggtgggagatattaatgcaccttgatttttcgacatcaagtaagccagtttccaacaagctatcttataattcagggttggctaattttttttctgtaaaaggtcagatacaaatatgtaggctttgcggattgtactttctcctttacaaatatttaactatctagtgtaaagataatcatacacaatatgtaaaaaagagagtggctgtgttccatgtattacaaaatatttattcttattttaattttttaaaaatagactctttttagagcagttttaggtttattgcaaaatttaacagaaagtacaaagttcctatatattccctgctcccacatacgcatagcctctcccacactattaacatcctacaccagagtagtacatttgttataatcaatgaatatacattgacaaattatcactcaaagtccatactttagggttcacttgtgtgcaggctctaagttttgacaaatgtataatgacatgtatctaccactatagtatcatacagaatagtttcactgcctgctgtggactgaatgtttgtccccactttaccaatccccctcccccaccaaaatttatatgttgcaacctaaatccccaatgtgatgacatttggagacggggcatttgggaggtaattaggtcttgagggtcgaaccctcgtgaatgcaattagtgccctagtaaccatataagaaaaaacaggagagagata

SEQ ID NO: 1115 - DNA, 1118 bp, Homo sapiens
ttttttaattagctgggtttggtggtatgcacctgtggtcctagctactcgggaggctgaggcaggaggattgcttgaacctaggagttcaaggctgcagtccagcctgagcaatagaacaaaaacctcatctcaaaaagaaaaatatatgaattttttatatattttgaataacaatacttttttcagataagtctcttgcaagtatttttctcctagtttgcagcttgtcttctctttctcttgatgatatctttcatagagtagaagtttttaattataataaagactaatttatcaattatttatttcatggatcatgctttcagtgttgtatttaaaaagtcagcctccaggaaaaaaaaatggcagataggaggcaggactaacttgcatctcccactcagatgaacagaacagcatgtggagactgacatcatgagcttttgctccaagaactaccacaggaacataccaggaacactgaaaggattcacagactctttgaaaaagtggcttgtggctgcaaactctgtgaggcagctgaaaaattgtgagtgcccaaaatgtgaagggggaaagcctacctccgaacacacatcctcactggggaacctgaaaatccagatcacgggagaaggatttaaccttacctagagctgaaatgaatttagagagctgagaaaaatataaaagtagaagcagcactgggaagagccctctaggtgctcccagtcaccagggaagccatttctgactttatctcactggggtccttggggagggctgccaatggaattggggaaggaccatagggagaaggaaacttccagttgagctttgtaataattttgaccaagtgtgaattttcctaggcagaatccaggagtgggagatggacgggaagtgcagataggaccacagaagcagtggcaagctgggagaggtagggcctgaaagccctgctggctttttcagtggagaggcttgtagcctggggcaattagtgccctagcacccatataagaaaagacaagagaaagcatttgagaaaaccagtgtactaaacaaaactacaaccaaggaccctcacagagtccacttcactcatatgctac

SEQ ID NO: 1116 - DNA, 1051 bp, Homo sapiens
aaaagcagtgctaagaggaaagttcatagcattaaatgcctaaatcaagaagtctgaaaaaacacagacgatctaaggtctcacctcaaggaagtagagaaacaagaacaaaccaaacccaaacccagcagaggaaaggaaataacaaagatcagagcagaactagatgaaattgaaacaaaaaaaaaatacaaaaggtaaatgaaacaaaaagctgattctttcaaaagataaaattgatagaccattagtgagattaaccaagaaaagaagagagaagattcaaataagctcaattagaaatgaaatggaagatattacaactgataccacagaagtacaaaagaacattcaaggcacaaactagaaaacctagaggagatggataaattcctagaaatatacaaccctcctagaagggccaggcacagtggcttatgcctgtaatccctgcactttgagaggccaatgcgggtggatcacttgaggtcaggagttcaagaccagcataaccaacatagtgaaatctcatctctactaaaaatacaaaaattagctgggcatcgtggtgtgcacctgtaatcctagctactcaggaggctgaggcaggagaattgcttgaatccgggaggcagaggttgcagtgaaccaagatcatgccactgcactccagcctgggcaacagagtgagactctgcctcaaagaaaaaaaaaaaaaaatatatatatatatatatataatatatatattttatatgtgtgtgtgtgtgtatatgcatatgtacatatacatacatatatgtgtgtgtatatatgcatatgtacatatacatacatatatgtatgtgtatgtatatgtatgtatatgtgtatatgtacatatacatatatatacacacacacacacatatacacatatacaaacatacaaaaccatcctagattaaaccaggaagaaatagaaactgaaaagatcaatacagacagcgagattgaaatggtaattttaaaattgccaacaaaaaaaagtcaaggaccaaatggattcaca

SEQ ID NO: 1117 - DNA, 1104 bp, Homo sapiens
caggcacagggactggcaagtgcaaaggccctgagacaggagggtgcttggcaaggatattgcatctggctggagtgagcaatagaaagggtatacagttatagagataaggtggcactcaccaagtttgtcttttactgtaactcaattggggagatttgagaaccacaaacagaagtgatatgatcagatgttggctgctgtggttgacagcaggttgttggaggagtgaggatgctattgcaataatataaatgagagatagtagcttggaccaggctggtaatagtggagttgaccaggtgatttttattcttttttttttttttttttttttggaaacaggggtctcactctgtcacccaggctggagtgccgtggcacaattgtggctcaatgcagcctcgacttcctgtgctcaagaaatcctcccaccttagcctcccaagtagcttggattacagacacatgccaccttgactgctaatttttttaattttttgtagagatggggtctcactatgtttcccaggctggtctggaactcctgggctcaagccatcctcccgcctcagcctcccaatgtgctgggattatatgagtcacagtgcctggccaatgaaggtagaacaataggatttcctcttggattagatgtgggaaagaagagattagtgaaagagaggagtctgtgatgaatccaagatttttggcttgagtaactgatgagagttaccattaaccgaaatttgaaaggctatgggaaaagcaggttttgactgcagaggtgggggctttagatgttctgttttaggtgtgttaaatttgagaggaaaagcagacatccaagtggagatatagactaaatggtggatatgcgaatctggagttcagggaagaattctaagtgggggtatagatttgggaatcattggcatatagatactaagctgtgggacaggatgagattaccaagacagtggcagaaaagagaagatgtccaagcactatgccttgaagcattatcaccttaataggttggtgagatgtgagggaaccagcaaagtcagaagaccagccagtgacttaggaggaaaaccaggt

SEQ ID NO: 1118 - DNA, 1035 bp, Homo sapiens
catgaatataacaaacatcttttatatttagttttagctattatcaaataattcaaaaatggaagaagaaagaaagacacatatatgatcatttttacctgcaaaaggagatttcaacatgggactgtcctccaccattataccttcttgtgtcttgtgtcctagcttttgcttgtactgctgcacaaattctgtggaatgggcaggatgtataggattcattccatttgaccgtgtggtctgaatatcacctgcatgttcggaagagcacagtgagtcttcagtatgccgctctgctttcatcaggtcactgccagacaacatgctcaaattgacagcagggagcttcagaacagcagagtcggcctcaccaaaactcaaggcacttgatataccaaggtcatcatcctcaggaatgggattgtaccatatttctccttcatcatctgcatcattttcctcattaaaatctaaagcacagtttttcgataatgaagagtttgtagcgttacataccacatatgtacagtactctttagatgatttgaggaaagactgtgatagctgatgtttaggtagagacacaggtgagatggataaatgacttctatcttggcatttcttattttcttcttccagattaagaggcctcagagtactctgatatagccaattgcgtttctttgaaacagtgatgctgttaagtggcttatgacctctgaattcaatattatccttcagctcttcaagttctcttcccttcattgaagacccataggcattttcaaataaatctgttgcaaagatagaatagaaggtagaatataatggctggtatatcagaaagacatgtcacttcagaccagttatttaaaaaaatttttttaaacaaaaagtaacaacaatcacattcagagactaaaattgaactagaaaaaatttgaattttacatataaatatgatttatattatttagaaatcaaactgctagtacaagtgtcaaagaattctaagaaaaaggatatacaaactct

SEQ ID NO: 1119 - DNA, 1049 bp, Homo sapiens
actgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctggtaagtggagactgagcacttcagacactgtactgagatgcatttctggtctaaatctttgtagaaatgagtgcttgagcctgtttgtgtcggtatgcctctgagaagtcttccctcttatatgtctctagtttttggaatggagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaagtaagttccttcagggacgtgtagactgttgcctggcaggtgggtgggatgtgaacatctttttgaagaaagagaaatatcacccctaactttccttctctcctttctcttacagaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatg

SEQ ID NO: 1120 - DNA, 1218 bp, Homo sapiens
ggcttcttagaccacaagagcttgctgtgaaatcgtgaatcattttcaattccaaatgatgaggtggcacttttcttctaatgaactgttatgttagatctcttggaactctaaagttctgttactctgactttctttaataagtttgtatgtgctaaggcatcaactctgtttcttattcccctcttacaacatctaacatggttcatcttttatatcattttagccaggcaaattaccatccatatgtgaagtttaatctttgaagggcaacaataagcatgttaaataacagtatctttattagtattttctaacattgtttgcggaccttgaagttaactaataccagtataaattgagtacctcctaggtgcttggcgttgaaagatacaaagctgaatgagaccctgttcctgccctcagagacttcataataatagtctcaaacttgtcataaatcttatttgtactaaatagccattttgtgaataactttatttgataaatctttcaagtggataaaggaacaagagatgtgtttttaactcagaattcttattgaagcaaaaccttgctcaccatcattaaaataagagcaaagactttctaaaaagaatttttcaaatcaaattacttagggagggagttcattttaattttctaacatttcctctaaactgattattaaagtcatactatgaaattcgtgaacaccagctattttctaaggaatatagttcttaaaatatagttttgagcttggccttgatctcccatttatttcagcaagtgtcatggtgtgtctaaggatgtaaagatgaatatgatgttgccgttcaatagctcctgtcagaccctccctggagtttcagtttggccaaacaactctctcaagcacttctgaaatcctatttcttttacagaattcacaccgtgacaacttcaccatgtttcttaaattctaataaataaaatatgtcacattcgaaatccatacattttcttgttatataaaaactctacatgtttagtgttacttaaaactgttttcacatcctttggtgctatttgcattactttagtaaaatagatagaagatagtttgttaacctgatgttaaaatttacacttatgtactacatgagtaaggtaattagaaaatctataaaactcttttaaattcatcatatttcttgaaagaattttttttttttt

SEQ ID NO: 1121 - DNA, 1025 bp, Homo sapiens
ctgtccagagtgctgcgaacagacataggagaaaggaagcacagaatatgattggataatagtaatagaaatagaaaatactaattttggaaatcagcaagtatttactggaagggtagtatagcatgataagactatgactcaaacagatgtgagattgaatcccaacaatgacaccttggacaaagtgtttaatcaccctgagtctcaatttattaatctctacaattattcttactttattttaagattctttcgagtatttgttgtagaatgcacagcttagttaatggaatttttgaacatacactaagccttgacacagaagtatgagaaagatgtaaatggatgtgctgaaatgtgaaacatagaaacattgtcatgtgaccctacagtactgctattttctaaacaggttttctgtaattagactgtctcactcatgtgtaagggttccatgtatcttctgaactaaaatagttaaaaaaaaaaaacctactaattgtgtgtgtttgtagaatctttatcagttaacatattttctttcttcctcagactcatacaaataaatcacttggtgcaaatacccatctttgctctgttatactttcatactcttttcaaaaagaatatatatttattgagatacctgggaggtagtatcatgagagtcacaaagaaaatgttaaataattaagcaaacaggcctttttacctgaagattgaagtgttttattttccaaataattaactttctaattgctgattttcctgaaatactgtcgggagaaaacttgccctgaaccccagtttgtatcagataaattcagtgactattttattttatatttatttattttattattaacttattaattagagatagggtcttgctgtgtcacccagaatggagtgcagtggagtgcagctgggactacaggtgtgcaccaccatacctggctaattttttggatttttttgtagagacgtggtttcgccatgttgcctaggctggtctagaactc

SEQ ID NO: 1122 - DNA, 1722 bp, Homo sapiens
tctgtctttgccattaaaatgtaagcttcctaagaacagaaaccttatatgttttgttggctgctgaaacccatgtgtttagaagagtgcctagcacatatgtaggtgcttaataagtatttgttgaaggaataaacaaaatgaacaaacaaatggataaacttgcttattaaagggaaatttatgcatgcagtttcaatttttaaggggctaagtgaattttttttagatcactctttataggtgatgttcacctgagtgaaaggtattccctttcttcccttcctattggtcactttatctgggagttattttatctagccattggtggtagactttgaacatgtaaaagtctagtaggaggtctgttgcttagaatcttcagggatctgtaaagactacggggttctctgttaagaatgaggttgcatagtttatccagctggccttgggatcagggtttgcttttgctcagtgcccagtcctccagctacactgcaagtttatgggcttaggcaatagctttgtaactgctatttttggttctacccactaggtcaggggctggctatagaccattctcaaaaagacccaaggctttacaaaagctatttaagctgttatttctagcccctaaacaggagcctcagtggagattgtaaccagaagtctaagaatagaattctagaggatccttcagcttaaggtgttgataataacctgaaagtattaaaccaagaagaaggatgctgaaagaaacaataaaactcagaaaatagagtagcaaacgagatttttgagaaacgaaaggagagaaaggcaaggtgaacactgttttgtcagccagaagtgagtcattactgagcacagaattaatgctagtgatatacctgtgttaagatgggaggaagccacatattctagaggaaaatgatgcatgataaacagcttgagtcatcacctctaatgtttaattaaaagtatccagaaggctgtagatctacacagaatctttttactgctttattattatataggcagtgctaccttttctcaaataccagtatattcaataataaaaattgattcattgagtacgtttaaccacattttatgacctttaaaagatgtcttcatagtatgaataggatatgttccaaaagttagtctataaataaattgctggaacatatcctcagcagcttaaatgacaggttttatggtatgttctgggaaactatttatctaactaggtgtgattaaagtgctaataagacataaaccacaataaacattaacagctctttcaaaacttaataattacaaggcaccaaacaaagtgatttgcatacacaatcatacttaatcccccaaacactataaaatatgtattgtctctcttttataatagagggtactaaagaaaaaatattcaatacattgctcagctcacacagcaaggaacaaagttaagatttgaattcagattcaactgactcaaagctcttactctttaccgttatcctagtctacctaggataggtagttgaaatagttgcatgctttatataccaagaagtatacttaggttttctgtagaattcacaccatacattttagcagaactaagggtatgtgatgactgtaaggtagggtcatccacaaaagaagtatggataaattaccataggagcaaaaaaaagtattcataagcaatggctt

SEQ ID NO: 1123 - DNA, 1044 bp, Homo sapiens
tacattctatatgggggcagaagggagcagaaaagcaatatgtatataaattatatagtatattagaaggtgaaaatggtgtaccggaaaatatagcaggaaactactttgatgggagtagagaaagacgtgagaaagcacacatgcaggcatctgagagaagatgctccaggtagagggtgcagcaagtacaaaaaccctgagggcatgacatagctggtatggtcaaggaacagcaaggagggcttggctagagacgagtagaggaaacggggagccaaaacatatagggcttcgactttggtctttactcagagatgaggcgcctttggaaattttgagctgaagagtgacataattttaggctttaacagaatcattctggctgccacgttgaggataggtgttgggtggaagctgactgatctgtttcaaacttattgcaataatgtagtcagtaattcagtcagaagatggcagtggcttggatcagggtaattgtggtaggtaggatggaagtggtcaggtcctgtgggcctgtgggtgttgtttgttttttgtttgtttgttttgttttgttttgttttgtttttttgagacagagtcttgctctgttgcccaggctggagtgcagtggcgcaatctcggctcactgcaagctcctccatctgggtttatgccattctcctgcctcagccacccgagtagcggggactacaggcacccaccaccacacccagctaattttttgtatttttagtagagacagggtttcaccgtgttagccaggatggtctcgatctcctgaccttgtgatctgcccgcctcggcctcccaaagtgctgggattacaggcgtgactgtgggtgtattttagacttaaagccagaaggatttgcttgacagactgtatgtatattggacacaaagaggtcaagaattattgcaaggttttgttttgttttgttttagagacagagtttcactcttccagtccaaggtggagtacaatggcgcaacttcggctcactgcaacctctgcct

SEQ ID NO: 1124 - DNA, 1048 bp, Homo sapiens
ccaccacgtccatctgcaagtttttgacctaagtaactgaaagaatggggagttgtagatagttaaaatggggaatgccagaggaggcaaagatttcagggatggaggtctgggaagtatgtcagttatattagaagcccagttttaaatatgttaagtttgagatgtctcttaaacatttaagtggaggtatccaattttaggatatgcaggtctggacttggattgggggcagggtgaattagataattagagagttgtcagcatatcaaagatatttaaatctgtgagactagataaaccctcaaaggagtaagtatagagaaaaggagaggatcaaggactgatccctgaagtactctagcatagagagttgaggaacgaggcaaggaagatgataacgagtgaggcagtgaggtaaaatggaaactaagagtatggcctggaagtcaagtgaacatgtgtgaaagtgggagagaatggtcactgcctaggtcaagtgagaggactacgaattgaccattggatttaggaacattaaagtcattgctaaccttgacgagtagttttggtgaaacagtaggcgcaaagtaatgtttgtaatataagagactcggaggagaggaattgtgaccgtaagaatacgtaaatctttcaaggggttttggtgtaaaggggaacagaggaatgaggcagtagtcggaggagaaagtggggtctagcaattttttgcttgttttttaagataggagaaataagggcatgtttgtaagctgatgggaatgatacactaggtggagaaaatatgataatgtgggagggaaagggaagaattgctagagtgataccctagagaggcaaaaaaggatgagattttgtgcacatatggaggaattagcatcaggagcatagacagctcattaaagagtttcctggccaggcgcagtggctcatgcctgtaatcccagcactttgggagatcaaggtgggcagatcacttgagctcaggagtttgagattagcctggtcaatatggtgaaacgctgtc

SEQ ID NO: 1125 - DNA, 1061 bp, Homo sapiens
gttttcaagggctcatggaatcagtcttccatgtgacagctttttaaatattttaagacaaaaactgagtcttctaatcttaattgtgttctagcagtagtcattgtaattatagttatttttataatttatttgtttagtgtatatctgtcactctagaatgtaggctccctgagataaaaactataattcttttgatggcagttacattcccaactcttagcacaagatctaggacatagtatgaactcaataaatttttgttgaatgaaagaaaaatgcaaatttataagccttttcagagacctactgaatcaaactctgagagtggagcccagcaatctgttgtaaaagctgtttgagtaatactgttgcactctaagcttgagaaccactgcaatagaactaagagaacattcatttcaccttcaggcctattctctgacatcacttgaaaaatcctctctgccttctgtaacccttaaccaacaacagtgccctgtccatgtaggggaaacttctgggctgtattacaagtgggtaggaaggtataaggatatcatagtgggaagtattgcttagaatgccagtacttgtttgctgtggaaggtttctaggaatggattgcttagtctaaagtaagcactaccaccatccacgttttcactcaacacagtgccttttaattggtgactaacatcaaaacaccttgacaaaccgttaaaacagtatcagaaaccatgtgtacatccctgtgcctcttagattgctaagttctgctctcattcttacttcaaaggacactttttaaagaattgttaatgcttttttataatacaagtcatagccctgttggcaaaaagaaaaaagattcagtgagaaagaaaaatcactgataattccatcatccagggagaaccactgttatttaagtatatggccttccagacttttctgtgcatttatagatatttttaatgggatcaaagtgtacatactgttttgtaactttttttcactcaacaataccatgactgtcttgctgtgtcaagtatatttct

SEQ ID NO: 1126 - DNA, 1023 bp, Homo sapiens
tccaagtttacccaattgaatgtcgtcttgattgagctctgtggcagaggaaaccaaccgtaaaccgaaccaagagcgaagcgcaggggctcttccgtccaataagcggacccgaacggggggaggggcggggcttctggttgccgagcagcgtacgcggatgcgtgcgcgtggtggcggagggggatgggcgggggcggggatgagggcggcgcagccgcagcgccggtggaggggcgcgcggccgcgagcaaaggagggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctaggtgaggaactgaactgccccgggctgagtgctgtggaaggggccgaggaggcgctgccgccggagcaagtgggcgttcatctaacctggggtctggctcgggggctgaaagcggtttcaaagagaaccgggaacaaggggcagcgagagcacgagctccaagaatgggttgaattaagcttgagcggcgtgctgggctcgcgaggtcacggggcagaggttgcaaggttgggcttccctagccaaagggtagccccgaagtaggcattccgcggagagagagcg

SEQ ID NO: 1127 - DNA, 1030 bp, Homo sapiens
atagtttattacatttggctctttaaaccatttgtatgtttacagagatttatcatgattttctcagtaaatcattttttccaactgtatgttaacattccttcttttaatcacatactaagttttcatatgttcttggatcaattttggatgctattttccattaatcagagattctttaaacctcggggacccataaataggcttcaaggtatcagtgaattccctgaaattatatacataactttcatcagatttgcaaaggagtatgtgattcctttaatggcaaggatcacagatttatagtagatgtttcatatttagtggacttttttttgtttttagtaacataacgtgcagattgtgagttaaatttaggagataagcttattacctgtgaaaaagagaagtttttcaacttcaaatgaagttaatacttcattgtattaaaatgtagacttaattttctagtgagaaatggaaaaggacagggaatccaaatgaaaactatttaactgtgactcgttactataaaatgtcagaatttgtggctggtaaaaagtagttcttcccgaatttcaagagcgcacttgttgctaatattgactggtcgaacagtgcagtgaaatattttctcacataagtgatagaactatgtgcttggtaactttattttctatagggttttagcattgtaaataatatttgttgactgtattcttacatctctatatggatttatgagcacattaggaataatcttttacatggggaaaataattgagaatggattatgtaatcatccattggtgagaattaatgttagtcattatgttcttaaaactctactagactaaacaactaattccagggccaaggttgagactgctttttggaatttggtagtttttacaagtaagttcctgaaaccatgcagcaatacctgtaagatgttccagagaatgctagatttcctcacttctgaaatcatttggaaaacctcatagtagctactgttttgaggactttg

SEQ ID NO: 1128 - DNA, 1034 bp, Homo sapiens
aactttgatgctctgtttcccttttaaaattgaatgcctttaatggcacccaagtcatctcttgaatgctttgctgcttagaaatttctttcaccagaaaccctaaatcatctctctcaagttcaaagttccacagatctctagggcaggggcaaaatgctgccagtctcttttctaaaacataacaagagccacctttgctccagttcccaacaaattccttgtctccatctgagaccaccttagactggaccttattgttcatatcactatcagcaattcagcaagtctctaggaagttcccaaactttcccacattttcctgtcttgttctgagccctcaaaactgttctaacctctgcctattacccagtcccaaagtagcttccacatttttgggtatcttttcagcaatgccccactctatgataccagtttactgttttagtccgttttcatgctgctgataaagacatgcccaagacaacaattaactaaaagacgtttaatagttctacatggctggggaaacctcacaatcatggtggaaagcaaggaggggtaagtcacatcttatgtgatggtggcaggcaaaaaatgagaaagcttgttcaggggaacgcctctttttaaaaccatcagatctcatgagacttattcactatcatgagaacagaatgggaaagacttgcccccatgattcaattacctcctaccagttccctcctgcaacacatgtgaattcaacatgagatttgggtggggacacagccaaaccatatcacatgcttttcctaattttttttgaacaagtggaatattgttataataactctttctggtgctgttgtctactaattctatcatctgggtcatttcttggttgctttctattgatttgcttttctctacattatgggccatattttcttctttacgtgtctggtaatttttaactggatggcagacattattttaccttgctaggtcctggatatttccatattcctataaatactttcaaactttgtttt

SEQ ID NO: 1129 - DNA, 1411 bp, Homo sapiens
tgtattttaatagatagtttctgcatttttaaaaataaaatagaagaaaacattcatcattgtcttctaggacataaatttcttattttccttcctactttgaaggttaaaacaaaaaagcaaacaaagttgtgtgatgatattttagtgtcttgaaatggatttctcagccattaaaataagggatatgtatgacttttgcacctcacctgggatttgtcagtgatactctctgacttgatatgtaccttttcaggtttgtcttatagataagatgccatcgtgtgccctttttcttttaccctaggttggaactttgtgtttaattagtaagccatcatgacctctgaaccttcatttagacaataactaacagttatggagtacttactgtgtgtttataagtgttttatgtgtatagtttcatttaatgtaaatgatacttgtttttgctttcttcagagaattgctgtgaagttaaatgatgttcaaatgagataatgaatgtttgtacaaacactgtagttataaattgttattaataatgacaataatatctaactactttctctttgccattgttgtctttaaggtttaatatagtctacagcctacattttttggtgctgtagtttttcccagtgcctcatctcataggatgacacttgtctgataagtcctcagataaatcacatgatgttacatgagttatagatttgacattcagattagctttttattctttccttccctaggaagaagtaataatcactggcaattcatattgttatttgcctccttaaagtagaaatctatttgttttcatataaattctagaaaagctatggctttttgatgttactggactctcttcactctttcctattaatacctgtgaaattgacaatttaaagatagatttataaaatgcaaattaaatttaaattgtgatggagtttttgcatgtgtatatgtatgtgtttatgtgcgtatacatatataaaataactctttggcctctaaatttttaaaggattaatgatagtcaaattaatgaaagaagaaagaacctaagcctatttctccattttagaaaaagttttgtgtgatagttgctttattatattgtcagttttcccatggtgattcattgtcatatctcaaatagaggaatatgttctgtatcctttatttaaattaggaaagttcagtttttcttacctttttcactcaaatacagaacagtataggctgtacattaatatttattgccaagattttgaggatgactttagaaaagacaaaattcttgaatcttacacagcttcaaacactattaactcaggtaaatagttacttgccattctacaatcagaaattttggtagactgaaatggtggactatgagagg

SEQ ID NO: 1130 - DNA, 1035 bp, Homo sapiens
aggagcttgagaccagcctggccaacatggtgaaaccccgtctctactaaaaaaaaaaaaaaaaaaaaaattagccgggcatggtgttgcatgcctgtagtcccagctacttggtaggctgaggcaggacaatcgcttgaacccgggaggtggaggttgcagtaagctgagatcacgctactgcactccagcctgggcaacagagcaagactctgtctccaaaaaaaaacaaaaagaatggagtgaattaatttcataaagaaaattcaggttaaacactatttgcaaactgatattcccgaatttaaatagacttatcaaaattgtatgtttatattttaaaggatcaaaatactgagcctgcaccttcctccctccttccttccagaggtattaattaagtatagcccctattgagaacctaaatatgtcaaaatttacctaggtggatatggaattaagtgtgggaatacaaggaaattaatattttatatttaaatatgaaggacaatgtatagttagctttttgaagaacatcaaatattaacttttctatcatgcaagttgtatgcattctttcttatttgtgataactttaagatgatgtcaaagtttcactgtgacttaagagtgagtaaattataaaacagtagaatcatttatttgaaagaggccttggttttactcagcttccttcccattgtgggaatgccttcctctcctacattttttcagcatcttatttgggagaaaaggtttaattttttattcctagctgcagtctttaacagttttcttaaaatatttattcttttcagattgcctttccttctaccttatatatatataaaatccctttctaatctgagctaatcagtctttttttttcttttttttctggtagctatattgatttctttaggtacctttatcttctgcattggcattcgttggtaccttctcttccacctgtcctactcttatttcagtaatttagatgaggtaaaatttgtaaaaatcacacttgcgcttaca

SEQ ID NO: 1131 - DNA, 1067 bp, Homo sapiens
ttctatatgggaatggtggaattttctagacttgattaaagtactgttgtttaattttttaatgagaaccttctttcccaatacttacaatgtcagtactttcaattaagttgctgtgaataattcctcctgcccattttttcttcagctttttaatttttccaagttgagttttgaatttttgatctcttttgacagcctttttttctttttggctaggactctctacataacttttttgatagttatggaaaacagtgggatagatgttcagatgttataacttctcttttttggctgggatggggtggatgagtaaaaagaaaaaatcaataagtcagtgaatgttggcaggtgttcagagattttttctgtgtgtcattcaccgtggcacagttaagtaactgcttatgattaagtttttcacagtctcagaaaataaggagtttcaaataataatgtgggtaactgattagtatccaactagtagtggtgttggatggattaattgattcttagagagtctaggaaatgtcagaacagtatacattcaaactgctattacgacaaagtaaaagttaccttgaaaaataagtaattcaactggtagaagaaactttaagggacagactagatttggttttctatatggtctttcattctgaatactaattagtacttgaacatatataaagctcaagtgttgttttttttagaaatacagttgtgaagtggttatgcaaataaattcaatttaaatttcttgtcatgtaaaatgtgtagaaggacttactgaggttactttcagtcttgtttttttctcagatagcgatgaaccattttcatcattattgtttggacttttattatatttaaggacaggagttaaatataagtcctgaagaaaaacaaatgtttcatatcacacttactttagagtaaagcttagttgtagctgtgtacaataatcagttgtaaaaaggtgtttccattcttccattgtccttttggcttatttctcttgtcttattcaatttgctgtggatttgtttttgtagtgggaaaat

SEQ ID NO: 1132 - DNA, 1049 bp, Homo sapiens
tggtacagtggctcatgcctataatgccagcattttgggaggccaaggtgggaggactgtgtgaggtcaggagttcaaaagttcaagaccagcctggacaacaaagtgagattccccgtctctacaaaaaattaaaaaattagccaggcatggtggtgtgtgcctatagacccagttactcaggagactgaggtgagaagataatttgagtccaggaggtaaagtctgcagtgagctatggtctcgccactgcattccagcctgggcaacagagcaagtccctattaaaaaagaaaaacagaaacctgaaacagatgatcaaagttgcatgtataaacgttattaaaaaagattcatcatttgaatatttagttactatttactaaagctgcatgtttaagagtttctttaggtgacttcacatatattattgtcatattcattaggctatggtaggaagtccagttagatttaaactgatacttgttctactcagaataatttatgtcacctgaagagaggctgatggctatattcttatttcagcatatttggatatgggaaaattaattaaactaaaattctcatatgactttggaaatgactattgaaaacacactggcgactgggcacagtggcttacacctgtaatcctagctagccctttgggaggctggggcagtaggattgcttaggcaaggagttcaagaccagcctgggcaacatagcaagaccccatctctacaaaatatacaaaaatttaccatgtgtggtggcatgtgcttgtggtcccagctacttgaggggctgaggtgtcaggatcacttgagcctgggaggtgcagtcgggtgagatggtgccactgcactccagcatgggtgacagaacaagaccctgtctcaaaaaaagaaaaaacacattgggaagtagaaaagctactcatgagccatctaagtgacatgtagtccaaacatctgtaatatgctgtagaactggaacaaaatgatattaaggataattttagaagcatcttcgtgaatagttactga

SEQ ID NO: 1133 - DNA, 1050 bp, Homo sapiens
taaaagtgctaaaggaatgctgaagagggtggaacaacagcataaacatttttgagagggtggaatagagaacataaacatttttggagttctaaatctaaataaaattatttcagaaataatgaaaatattttgtattatttctgaggaaaatcagctttttggggggtactttttctgcagcactgtttagctatttttggcaaatgaaaaaggtattggggtagagacagagatttcctatttgaagttgaggcaatgaataactcctttcccctactccaatctccttaagaagaaataagcttttcttcattgataaggtaaagttagttttatactgtttatttaaaacaccaccaccaccagcatctcaactcttcccccaaattagctttgtgtctgaactctactttagtcaatgattcctttatatttttatatctcttaggcttgaaaactaggagtcatccttgattttttttccccccttatctacaatcatcagactttctggctctgtctccttggggcttgctttaagctttacccttcataacaaacatgatatgttagtagtttctttcagctttaaaatattatgacctttaagatctaaaattaaatgttgaaatgtaaaatttaaaggcttattgaaagaatgttaataacttttaaaaaaagtattggtttaagattagattctcctaactaaaaggatcctaaaaattaagagtaagatatttagaactttgtactaagtgtaaagtcttagtattacaaataaatcattgggtatttattattatttaaatgtctgatactgagctttgcatcttattatggagaaaaactttggattccaattgaaacgagaagaaattattgttatatcttaaccagcgtctaggcaacttggacccttcagatactgacactgagagaacttaatcccaaaataaataaaaattttgaattaacattctttttagtccgggtgcagtgccccacgcctttaatcccagcactttggaggctgaggttgaggct

SEQ ID NO: 1134 - DNA, 1381 bp, Homo sapiens
gagtagctggaattataggtgtgcaccaccatgcccggctcatttttgtatttttagtagagatggggtttcaccatgttgaccaggctggtctcgaactcctgacctcaagtgatccaccaccttggtctcccatagtgctgggattacaggcgtgagccactgtgccctgccaaaattgacatgcttttctgaatggtgtcttgctatttaggaaattttatttttaatggtaaaagcatatttgcttgaagaaaatgctgtggtgtgcctttttctctactaaactatccccgttcctaaatctgcatagaaccatgaaaaatattatttttaacttcctaggcctttttgcttatgttcattaagtcaactcaaattgtcatgaagcaactcctgggtatactagatactccgctgtttttaccccacttccattgtacgtttagcttcaaacataagattcattcctttggcctatttctaatttgcaacctgctgtattctactttctatgaaactagtgtgtattatctcttatatccctctaaattttcttgacggttaatagtatgtttccctttgatcaccaccagcaagcttcgggggtcagactgactctgaaagtagcagatatttgaagttctcttgaaggaacatgggattttattaaggattttaagaatggataggaatttgatgaggaaaattcatgcagagaggatggcatgatctaaggtgtgaaaatggagtgctcaacataagagatgtgatatggtagaaatatagaatattattgggatatagtaggggatatcattgggaagatggagaaaagatcatcgaaatgagtttctggtcgtttagtaatgtctgtcatttattgaatgcttactgcatatccaactgtgttaggctctttatgaaaaatctaatttaattatgacaacagttttgtgtggcagatattattctctgaagaaattgggatttagacagactaaataggttataagactcatggagctaataaattagatttgattccgcatctcttttaaaatatgctgccatcataagcctctttaattaatctgctttgcagtgatctctagattctattcaagaagaaatttgcgacaatcttgaacttgtacttatagactaggtgattactttaacagggaagaaccatgattatgaatatgccaggcatcggaagaacttcaaatataaatctactacaggaatatgaactgatggcctgaaaaagactgcatttattttggataacaaaataatttcttggccaggtgcagtggctcatgcctgtaatctcagcactttggaagggcgaggcaggtggatggattgagcccag

SEQ ID NO: 1135 - DNA, 1064 bp, Homo sapiens
ctctttacactttgagtaacatgttcttgctagttgaatttaaggagttagtagcatatattcagtaattgcaaaacagaccttctttcctcacccctgaatctttggacagtaaaaatacattatataacattgaaatcattcacaatttagtggtttgaaattccagatggtaatgccatgaaaagacctgtcatattttgtaccttatattatgaagagggttatattaatcacaattagcaagtgagttgtgggcttcaagttgtcaagtgaatttttaggtaatgaacaagtttctagacatttatagtctaagtttcaggacatttatagtctaagtttcttgaataaattttgtcattttaaagagcaaggataaatgattgaaaaagaatttctgaatttaaatttttacatgaattatttaatttgacaatttaattcttacatgggtaagtaatgttaatcatcccattttacagaggaagaaacatgactctcataggacaaatggcccatcacatgtttagcaagtgatggaaaccagatttaaactccagcagtcttatgcttaaccactttgctgtgattctcaaaatgtgtagaataaacacaattgcaacatgtgatgtctcagctctctcctaagactgaattgctaaggtctctgctcttttattttacttctctttttacttcctaatccccagtttttgcttgttttaataataaaatctagaggaaatagaactgctacagttaaatatacttggattgaaagaccagatcttttatttattcatagctacatgacaagttacttcatttgagctcacttaaaaaaaaatgtaataatgtactaataagggagttaaaaacataatgttttgttgtgaatagtacacaggtataatttttaaagtattgaaatcattacctggaagatattagaggtttttttagattttttttttttttttttgagatggagtttcattctagtcatccaggctggagtgcaatggtgtgctctcagctcactgcaaactctgcctcccggg

SEQ ID NO: 1136 - DNA, 1090 bp, Homo sapiens
tgaagcaaaatagcgcataggtagaccacgaatatagtaaattgatccttgacaaaggagcagagacaaggaaaaacggtaattttttccacaagtggcactggaataacaggatatctcattcccctccacgccaccaaaaaaaaaaaaaaaaagaatcttgacacagactttatacttttcacaaaaactacctcagagtgaattgtagcctttaatgttaagcacaaaaatgtaaaactcctagaagataataaaggagaaaatctggtgaccttaggtttggtgataactttttagacaaaacaccaaaagcatactccatgaaagaaagacgttgttaagttggacttcgttaaaataaaatatgtacgttttgtgaaagttactgtttagggactaaagagataagtcacagactgggagaaaatctttggaaaatacatacctgaaaaagaactggcatccaaaaatattcagagaacccttataactcaataataaatgaacaacacaattaaatggacaaaaaaatctgaacctccttggagaagatatacagatggcaagcaagcatttcaaaagatgtttccacatatcattagagaacatgcaaatttaaaccacagtgagatactatacacctattagagtgatgaaaattccagacactgacaataccacatgctggtgagtatgtggagtaatgggaattctcattcattgctggtgggaatgcaaaataataaccttcaaaagacacttgggcagtttctttaaaagctaaacatattcttaccatatgatccagcagtcatgttccttggtgtttatccaaatgaactgaaaactttaagtccacataaaaatctgccgatacatgtttgtagcaactttatttgtaattgcccaaacttggaagcaaccaagatgtccttcagtaggttaatggataaacaaactgtggtacatccagacgatgcaatattatctagccataaaaagaaatgagttatcaggccatgaaaagacatgcacagagtctatttaataaaaaaaaaaaaatctacttggagattgaggttacagt

SEQ ID NO: 1137 - DNA, 1049 bp, Homo sapiens
aattccacccaaatgtggaattctcaacaaggcattgatcaaaaattggctaatcaaattaatgatttaagacagtctgttatttggcttggagattgggtagtgagtctcgaacattacatgcaaatgcagtgcgattggaatacttcggatttctgtatcaccccgtattcctataacgagactgatcattcatgggaaacggtcaaagacaccttctgggcatgtgatcttaatggtaagagtttcactactcagtcctccctttctttctggtgcggaggcagacacccttaaaaatggagatttcctttatagatgtagatttcttttataaacatgtttcaaaatagccagctaaaagacagaaaggtgtattttagagaccaatttagttcagtagacagtctttataacttagctatggttttttaactaaaatgactgagcttagggctaagcccattaactaatagggcaaagaaagtattctctctacctggactccacaaggatagctcttataaagaagcaagcctattttacctgagggcttaccttctattagcaaacactttatccacctttattttcacattcaggacagtatagtaatttagccaaaagatttgcagattcaatttttttaaatcaactagttccttaagctttttatttgctttttataaagaggctttcaaaagaagcaataaaaatattgcaacatttttagaagcttctgcacatcaataggcatccttgggtcagccaaattcaggagaacttatttatttattattatactttaagttctgggatacatgtgcagaacatacaggttcgttacataggtatacacgtgccatggtggtttgcagcacccatcaacctgtcatctacattaggtatttctcctaatgctatcccttgcctagccccctagcccccagcaggccccagtgtgtgatattcccctccctgtgtccatgtgttctcattgttcagcttccacctatgagtgagaacatgtgatgtttggttttctgttt

SEQ ID NO: 1138 - DNA, 1038 bp, Homo sapiens
ccacagataatgcagttttatacattttattttcaatgctttttagtgggtgtatgtgtatgctatgtagagaaattagatgaagtttctcttaacttcattatgggcaacaaaattccttggctttgttacagtttactaggccccatagtgaaaacacctctgagtgtaggccaattctagaatacaaaattacttgtgatcagagctgtaatatgagattgaaatttgttacacaaagaggttactatcctttttttgaggataattaaacaatttgtttctttaaaacaaattaatagtgattgtttcaggatagtataaagtacaatttaatctttaacagtgagagaggctttgtagtggggtctcagtggttaagtccaattctgggacaagtaaaaatgttttagggtcttattacagaatgaaaactatattgtttcttaaggaatttaatgaactaaaaaacatttttgcttaacactcttgatttgtagtacatcgaccaagtatcttcatttaacagaaagtacatacttttgttaaataatgaagttttctggaaatctgttaactaagggtacttagagtaggaatgtgaatatttcaaatttcaaatcatccttttcttatgacaaaactctttttgtggcattacactgctttagaataaagttcattaatgcttgcttaaaaaaacataaggggtactgtatgtgtcaaaaataaaaagttggaacttcataaaattataggatttttttcttcctttcccacctctactgttttgtcattgctctttgagatgaaagagtctaaacctgtatgtttatttaactgttggatttcttgtttctcaattaggaaatgaaagcaaaaatctacacttgattttataattgacctatttgttttcaaaagtatgcacataaatgtcaaaatttaagtctaatgtaagctatttaccctaagcattaacatatctgtgtaaaaatggttacccatattgcatgtttaattaccttggtgtttaag

SEQ ID NO: 1139 - DNA, 1061 bp, Homo sapiens
cacttttatgcttcctattctagtacatgcagtgctgaaatgaatgggaaaaaccactttcccacatgaatgctctactgcacttttatctcaaaaggagcattgtatttcttgagtttccaaaggattttagataccattcttaatttaattattttatggccctttctctttaggtctgtattagtttgtgagggctgccataacaaagtatgacagactggatggcttaaacatctgacagttttggaggctaggagtttgagatcaaggagatcaaggtgttggcagggttgatttatttgaggccccttcccttggcttgtagatcatcttctcactgtgtcttcacatagtctctgtgcatgtctgtgttttaatctcctctcctgtgaggacataattacctctttaaagaccttgtctttaaatacagttacattcagaggtactgggggttaagacttcaacatatgaattgggggtcagggaaacaattcaggacataacaagatctttagccctcatctaaatgaaccatgaccataaacagttctgagcctcattctataggtacatcagttttcttctctacctttggttatcaaattccttagtaccccagctactcctcttttcccatttaagatgacctttctcctattccagacattggctgggaagttagtcaagaggtaacttaaggaatttagtgcagggtgtctaccttaagattttcactgatttgccttaaatcatgttcttccattacatataaaaaaaattaccagcaggccttgtccttcaggtgtgtttctcactcccagaatacatgttgactccacttgtccttcaggtgtgtttctcactcccagaatatattttgaatttgtaagaagtacgcagtttagaccttgttcagaatccatacagtattcattagttcccccctctagtcaatatttgtaggccctacaaacattccatgttcttccataaatcccttcttgagataataaagaagtatagccttttaaaccagctactcagcttgcttgtca

SEQ ID NO: 1140 - DNA, 1025 bp, Homo sapiens
gtgatccaccagcctcggcctcccagagtgctgggattacaggcgtgagccaccgcccccggccttaaagtggtaaattttttagtttgcataatactttgacttttgttgacttaaaattccttatagtgaataacagtataccaccacagtgagcaatgatgagcttaatgagggacaggaatggaaaaattacagttttactggtttagaagttcagacacagtagctaacatattgtctaatgagtaatattttgcaaatattgaggattattaatttttaaatataaagatgtagtaatagttctttggtaagtctaaaaaataagtagaccatctacccttttatttgtttcaaagtgtcaaaacaaaaatagaatcaatggtgagaatggctttgatgaaataccagtgaggaaggtcacagtaaattattatttcatgacaaacaaaaatgtaaattcttttacattgcaaatataatattacaagagaatagcaaatttacagtatacacttggagaatcattctaaagcagttgaagtctccccaacaccacacttcaattttttgtgatctgtggtctccagagtaactattataagtggttttcccagattctggaggggagaaaataaattaacaatggattgataactttattgttcaagctatagtaattcttttcactgtgagattttacataattcactaaaattacccttgttttgtaaatatggaaccattcaacgaactacttttgaaaatgcaaatattgtactctagctagtacaatgagctctaggaaatcagaatcacattttgaaagaatcttgaggtttcaaagcctttcaaattctctcagttgagaaactgttacagtgtaaagtatatgtacgaagctttcccttttaaaagacaataaaaaatagttttgaattgaagagtaataggattagtaatctttataaaattaaagagccagatatgcccattgttttcagctaaataatggttcctta

SEQ ID NO: 1141 - DNA, 1057 bp, Homo sapiens
ggccacatcttaaatgctttgctgcttagaaatttattctgccagatgtcctaagtcatcacttttgtgtgtgtgtgtgtgttttttgtttttttttttttttttttttttttttttgaggcagtctcactctgtcagccaggctggagtgcagtggcacgatctcggttcactgcaacctccgcctcccgggctcaggcaattctcctgcctcagcctcctgagtagctgggattacaggcgtgtgccaccatgcccagctaatttttgtatttttagtaaagatggggtttcgctatgttggccaggctggtctcgaactccagacctcaggtaatccgcctgtctcggcctcccaaagtgctgggattacaggtgtgagccaccgcacccgaccagtcatcactctaagttcaaacttccatagatctctagaacttggacaccacatagccaagttctttgctaaggcataacacaggtgacctttactccagttctcagtaacttcttcatttccctctgagacctcatcagcctggacttctgtccatatttctgtcagcatttttatcacaatcattaaaccagtctcgacttaagaaatttcaaagtttccctcttcttcctgtcttcttctgagcccttcaaattcttccaaccgctgcccattacccagttccaaagccactttcccattttcaggtatctttatagcaacacccaactccttagtaccaattttctctattaggccattcttacattactgtgaaggaatacctgagatggtaatttataatgaaaaaaggtttacttggctcatggttctgcaggctgtgcaagcatggcaccaacatctgtttggcttatgatgcaggcctcaggaagcttacaatcatggcagaaagtgaagtgcgagcaggcacatcatatggcaagagtgggagaaagagagtgaagggggaggacccagtcgtttattattattattattattatttttgagacaaagttttgctcttgtcgcccaggctggagtgcaatggtgtgatct

SEQ ID NO: 1142 - DNA, 1040 bp, Homo sapiens
ctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacaggg

SEQ ID NO: 1143 - DNA, 1029 bp, Homo sapiens
tctcagggttttgttacagcttaattggtgcagttcttattctggtttattgtgcggtcactggacacacgttccgggactctttcggaggaaatgtgtttaaaatcggcctatttaaggaacccgagtccttgtttcgttccttcctcgttttttttgcagcagccaagttgggccgggtacaggcaaagttcgccttcttctgaggtatcagctgaatgtcttgagcagatagccgggagcctcagggggagcccacactctcagcttacagaggacaaagacaatacaggctgcttaattggcagtaaataacttgatctttttacagaataagtgactagaggaacactaggactttattggactcgggattgaaggcaacaaattaatcggtttaggctaagctttataaattgattcctatattatatcccagttgcatctcttgtggcattcattagagtggggaattcttttttaaagcagtttttggtgacagcaggacgggctcgaatttaacttgtgcatcccttaatggtgccttctcgcacattatctgtaacgccgcccgccccccccccccccccgccctttggaggaacaaagctttagcatttaaattgctgatcaagggcagattagtgagaccaaagtggagagtgtttgtataggaagttaacaggcatcctaaagttcaatgatctattattcttgcctgtgtcctgaaaacccagagaaaacactcattgatcttcaaaatgaaatgagatttggaacaataatgggagatggcggtcaccacaatggcatgtgaaaggtgctgcttaaaatacgaaaaaccagtttcgcaactttacacactgcacccacccctcccgtcaccttgccttccctcccatcaccacgctctccgtctcccgtctgccggtccctccctcgttccctttcggaaaaccgaactatttccaacttgtgaactgcagctgcacttcccggggcagaacccgggagggaacgaggctccgg

SEQ ID NO: 1144 - DNA, 1068 bp, Homo sapiens
taaactccagtcatgaattgtatcttttttttttttatgatgaacctagtaatctgataaaatgtgtgtagaacagaattgtatttgctagaggtgtaagtcaatattttgattaaatctggggcatcctctgcggtaggcagaagtttgttgtcccacaaaaaggatttttcccagattatgtaaatcactcagaaaatctgaggcttgagcctaagaattcagcctgtcaaatgcattccaaagggatgcccagagtctgggggtgtttttctttctttttctttggtttaggattattcactggtgtcaaccgttattctttgtttcaggttatttggaaatagcggtgcttgcagcgcttgcggacagtcgattcctgcgagtgaactcgtcatgagggcgcaaggcaatgtgtatcatcttaaggtagtatttgcatctctcttttttttttaaaaaaaaaatcatacctttcctacctacatgggggcaaagcatttctccttggtatgaactgttttctcaagctgcagacacttgaaggaatgattgaaattgtagcatggcagtgatggttacacatccacatgcacagaccacgcttcccctatgccacagacagaagtacacatgtatttggatttgtccccatttagcctggtccagttgatagcaatttggcttactgttttctggagatctgtcaaaggaagaaaaaacgctaaaccctaagtgtctctgtacttgacagatacctgcttaataacaggttataaacttgtgaccaaaaaaagacttaatttttaccttgttttcagtgggtttgtttttccctttcagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtgaatacccagcaattactaataagctttattagagcaagttggaaggttcaacctcttaacctagca

SEQ ID NO: 1145 - DNA, 1081 bp, Homo sapiens
ttataatagggagccagccccccctttttttgtatattggccattgaataatattattttataaaacatcttagcgcaatgtgtccttaatttttcttagcctcagttttgtcatctgtgaattgcaaaagacaagctgactctcaatatttcacaatgagatcatgtatatgggaagactttgtaaactctaaagctttatacaaatgtagaaaggcacatgttgcagaaagaggccccagccccaagtgataactggtgcactgaaatccaatttcatttccacattcgtccttccttggcaaatgtcacagctttgtgtaatttgtaaagtcttcattattagctaactgtgttgtcctgtgcagacaggctgtgaggcagaaaccagattacagtacttacctttgtgctactgccctcttggggagtctggcacgtagtaggggctcaacaaatgcgtgctgaattgaactgaattgtgcagagggtgtgaggacttggagtgaacaaaacaactgaatgcaagatcagccactagcttggttgaccctctccagggaggcggtgttccaggacactgccttgagacaggtcacttgaggactagggaaaggacccagccattctctatagcagggcagagtgctcagagcaattgtgatgggtgggttgttgcaatctgtccccttttctctcctgtccgccgaggggagaagttgttctcctgggtagctttccttctgatgctttctctcaccttcccttccatcttttaccacttggaggaaggagaaatgctgagcctttacttatttgttgcttataggctttttcttactctgagaaagcttagattctttggggaaatagcatggattccctagctctcttctttagggaatgcacaggagctagaaaaggcgatctccagattatgtcacatggtgagggtagggaagaaaggagaaaggatggcattttggggaaatacgtcagcacacagttttgggaggaagatttgcttactcaatttgtctttaaaccaaagcatctgttttggtcattaaagtaaaacatc

SEQ ID NO: 1146 - DNA, 1050 bp, Homo sapiens
gcttaagcagaaattggattttttgaaaagctatggggttgtatcacttaagggtaagatgtatagccagatcccatgagtactaaacaggaaactggatgttttctttctagggctacatgttctcttttctttaagtatgtgtactgctttatgtctctgtatactggttctctttgctctccttgcctgtggtctccaagttgcactcctaacttctaaatttacattaactacaagttcattgcacatagaccacagctgactgactgagttgctatatgtcacaattctaaattcttagatgagaaaatctgagtggccttagtcagtggaacatgtgtccctgatccagctaactatggcagtggagggatgagattctctagtatcaatatggcttcaagaaacctcttgtgaggttgggacagactattttctgaaaagggattctaggttgagaattctagggattctcctgcttaaatgtttcagttactttccatcgattatagaataaaatatatttatacttttcatcatctgacccccattttttctgatttttctccctatttatcttacactctggaatattaaaactatttacatttctttgaaccacactccctatctttgcatatgctgattctggttttaagaatactaatattgcttgtctgtctgaacagcatttgacaaattggacaatccttaaaattctgataagaaaatcatattcattgactatatgaatatatttatatctaataaaagttttacttaagatatatttttgattaataaatttagggaattggtcatgaagcattttgatacatttgcaaattagtctctgattttacagctcctgttattgaataatatatcacttaatatggtaattgttacatgtctctactactttcaagacaggaactaggtcttactcctctttatgtcgctagcaactgacatataggttatgcttaataaatgcttgaataaataaatgaacagattttaaaaaacattatatgaccaatctgc

SEQ ID NO: 1147 - DNA, 1047 bp, Homo sapiens
tagttacttttatttgactgttgcttcagtctcttcagttgtttcttctacttctgtatcttgagttcattcattactttgccattgtttaagtgtgggccttcattatcatttggatgattataatatcttgatattttacctccacctcttttgccttgttctgctgttatttaaactatgtacaattgctagattcagaatttgtccttagcattcagtgactccttaatgcctgtgggatatagtcctaattccttagctaggcaatccaagctgtcattgttgtagccccaaaatgcttttcattcttaagtcttactcatgtaagcagcttattttttcaggcatactatgattagtgatttttcctcacctgtatttttactacattctgtcagctggaatacttcaaggccaaattcaaattttgcatatttatttttttccttattttcccctactcatgttcagtctctcctcaaaacttaagaatattttctatctcatgacatttattatatattgcattgtactgtagttgtttgtatcctacttcattttctcttctaggcttaatgcttaaaatctttgaaggaaaggactatatttttaatcttcatcatttacccctttagccctttagtcctgaagaaagtagcttgcacatagcagtgttgagactcagaaaacaatactctacaatgaaggtcttagaagtagtctcagaaacaaaaggactgttttattttttaacctttttttgtcctcttgtctctcagttttatttttcctccaaggctagccatataaactagaatccatctttttaaaagtgggtcataggaaccagaaccaccaccccccttttctttcttccccagcagaagcaagctttatttagcactgaccttgacagagattcactcaaggacccccctgtacaatgaacgatgactcatgcataaacaatgtcctcaacaagttttacagtaaacaagaaaatattctttatggttgtttttcaaagcaatctttgataaaagc

SEQ ID NO: 1148 - DNA, 1050 bp, Homo sapiens
catggctgcatagtattccatagtgtatatgtactacattatctagtctgccattgatgggcatttaggtggattccatgtctttgctattgtgaatagtgctgcagtgaacatacacatacatgtatctttgtaatagaaccatttatattccttagggtatatacccagtaatgggatttctggttgaatgatatttctgcctctaggtctttgaggaattgccacactgtcttccacaatgcagaacccgttttaaaaagtcagtcataaagcctaagaatattattctaacttttccttcttccttttttttgtgtaacaccagtcataaaaaaattacctgacctacttcgtttgaccatagttcataagatccctattttagaatccttctccatacccaaaagtaaggagtacatactcagagaggcacacaaacacagaagaatgagacaggtcttgcatggtttccccactcagtctattaacattagatcattccctttttgtccaatcacgttacggctgtccatactttgttgaacctaagcgtaaaaaaggacagcttcccctgtatttttggttcttcattctgaaggctttcatgtcacgtaaaactatgatcaaataaatttgtatgccttttcttctatttatctgcctcttttcagtagttctcaacaaaccttcagagggcaaaggaagtattcacttctgtctgacagtggctgctgattaatgtttgttgagtaaataacagtctaatgtctgaaaatcttccaattttaatttgttacttaaattttttctgcttttattttggtatttatgagggagcagaactgcagtatatcatttttcccttggtaggtacataattttatcaccttaagtcatataataattgaattcccacatctcagactgagattttttttaccggcagaaggagctgtcaccagtcacaacagaagtagataataatagtaatgtttattattaaaaacaaatgataatgaatacatattgatgttacttaatcgttaa

SEQ ID NO: 1149 - DNA, 1077 bp, Homo sapiens
tattttgttgagcagtggtttgtagttctccttgaagaggtccttcacatcccttgtaagttggattcctaggtattttattctctttgaagcaattgtgaatgggagtgatttggttctgtatttgtctgttcttggtgtataggaatgcttgtgatttttgcacattgattttgtatcctgagactgctaaagttacttatcaggttaaggagatttggggctgagacgatggggttttctaaatatacaatcttgtcatctgcaaacagggacaatttgacttcctcttttcctaattgaataccctttctttctttctcctgcctgattgccctggccagaacttccaatgctgtgttgaacaggagtggtgagagagggcatccctgtcttgtgccagttttcaaagggaattctttcagtttttgcccattcagtatgatattggctgtgggtttgtcataaatagctcttattattttgagatacgtcccatcaatacctagtttattgactgtttttagtatgaagcgctgttgaattttgtcaaaggccttttctgcatctattgagataatcatgtggcttttgtctttggttctgttgatatgctggattacatttattgatttgcatatgttgaacaagccttgcatcccagggatgaagccaagttgatcttggtggataagctttttgatgtgctgctcagttcggtttgccagtattttgttgaggatttttgcattgatgttcatcagggatattggtttaaaattatctttttttgttgtatctctgccaggctttgctataatgctggcctcataaaatgagttagggagggttccctctttttctattgattggaatagtttcagaaggaatggtaccagctcttctttgtacctgtggtaaaatttggctgtgaatccatctggtcctggactttttttggttggtagactattaatcatttcctcaatttcagagtctgttattggtctattcagggattcaacttcttcctggtttagtcttgggagggtgtatgtgtccaggaatttatccatt

SEQ ID NO: 1150 - DNA, 1053 bp, Homo sapiens
tttacacttagatctatgactcatttgagcataccaattctatacatattttgttaggtttttatctatgttttaattttttagacagattgtaactggtattgtgtttttaactttgttgtctacacagtcattgttagtatatagaagaatgattatttttgtatatggctcttgtattctgtgattttgcgaactcacttattgtagatgttttctagtacattccttgggattttctatatacatgaccctgttatctgctaatagggggagttttatttcccagtttatatgctttttattaacttactgtagtggatagaatgtctgatattgcattgaataagagtgctgagagcagacatccttgtcctaatgccgatcttggggaaaagcatttagtttttcaccgttacatatgatgttagctgtaaatttttttgtagatactctttgtcaagttgaagttcttttctagtttgcttggagtttttgccatgtatagctcttgaattttgtcacataatttttctgcataagttggcgtgatcatgtgattttttaaatctttattctcttgatatatggtggattatattgatggatttttgcatattgaaccagtcctatatacttggagtaaaccctactgtgttgtattgtataattctttttcttcggtactatattcaatttgagtatattttgttgaggattattacatctaaattcatgagagaaattagtttttgtgtgtatttcttctgtcagggtaacaccaacctcataagagcaattgggaagtatttcctctgattttctggagaatattgtataatataggactgtgcagattatgtatttcatattgggtgagttttggtggtttttttttgaagaattggttcatttcatctaagttattgattcatactctgtatgcttatgtttcttcacatttctttaggttttatgatgcaggctgtggtctatcatggtgagcattttgtgggtgcttgcaaagaatatgtattctgttcttgttaggtg

SEQ ID NO: 1151 - DNA, 1040 bp, Homo sapiens
agagatggtgcataccaaaggtgaagcatgcttagtggctgagccaagagagatgatttcttgaagtaaagttttataatttgatatgattggagtttaaggaacaaagtggaaagaaatgggagttgaggtaggcagtaaacgaaagtgttaggtatttcttctggcctatgagaaataaggaataatttcctgagatattaagagtaccatgaacaaggaaattttgcagacctctggctttggacataatattaaagaacaaatctgcgaaagcagttcataaagtgttttctgataaatgtgtaaggattgaaacaaaaatatttggaggaatggaactagcttaaactattttttatctaagcattttttgcctcagtccactttacctgaaactagacaatatgaatttgggattttattctttgacaatagacatgtgctagtgttgttgacaacttgccaaggatagacacttaaactttggaaaccaaatggatcgtaggacttatattccattataaatagtgaaaaatctagacagcattttggctcaggtagaagatcattgtttatctgtatagtgacagatcagaaatacaacttctaacaggtgtagattacctgttttaggaattcttaacctaggatccgtggaacctggtaagtatacataacaacatgaaattttctttgtactattttttgttggcgtttcaaaggaattcttagctagaaacaggctgggcacgtgtttcatgcctgtaaacccagcactttgggacgtcaaggtgggaggatcacttaggccaagagtttgagatcagcctggacaacatggcaaaatcccatctctaccagaaaaaaaaagagatttatagaaatcaactacttcatattttgcataatatacctgcaggcacaaggtaaattgatatgaaaaccaagacgagatcccgtatcacccataagctcacccttttcactattttgcatgatacataatttttagaaattaagaatgaatgtagaaagta

SEQ ID NO: 1152 - DNA, 1058 bp, Homo sapiens
taaaaggtggctactattattatttagattttgtagactattaaaactgagtatttgaaaagttaagtaacttgctcaaggttcacagtgtaggggttgggatctaacctgggttcctaagataccaaaatccgctatctttacacagcctttgtgtgtagatgtgttcactttattttaatataaatgtatttgtcaagtaatgctacttagtagccagtgagttcttgaatttatgattttgtatggttataataaaagtcagtaagtagttggtctattgcttattaaggagataattaaatatagttaaatgtaatgtaatcaagaaagactctcttaggctgaaaacactgcatatttactgagcagccaactctcctaaactcccacatttgtatgtttattttttctgtagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacaggtatagtagtgctttatttgatgtttatatggtatattaataaaaaaaatgtatctttttagaaaatagtaagtttggggacatgaatagtttttagcttttctgaaagtagagagactttttctcttttggttaaggtcttatttatattctgtttagaagggcaggagttgataggtatggaaattgaaatgtttacttagaatttaataaccctaatgtattctctcttactctctatcagtaggacgttacttagagtgagtctccagtattaatgttttgtattgagtcaatcacatgcttttacgtgattcatcctgtaatcaacagcacaag

SEQ ID NO: 1153 - DNA, 1057 bp, Homo sapiens
tccagctactcggaaggctgaggcatgaaaattgcttaaacccaggaagcagaggttgtgttgagccaagatcgtgccactgccctccagcctgggcaacagagagcgattctgtctcaaaaataaaaggtttattgaagtataaattacgtatgacaaaatgcacgtattttaagtacatgatttaatgatttttaacaattgtgtgtgtgcacccagctaaccatctctacaatcgatctagaacattttcatcacttcagtgcttctcgtatattccttcccagctaacccatgatccccaaccctggccataggaacccgctgatccatcttctatcactttagattgaatttgtctttcctactgttttatataaagaaattacctcctttaagtcctatcaaattcctgatcacccttaaaaaacaatttttaggtattaccataaaaccttccatgacattctctgctttatcttctctgtgctactttgtccattcattgttgcattgtaatgtatttctgtacatgttatatcactaaactgtctcctccttgaagggagggacatgtgttcactcatctattttcaaggcttattacagaaactgaaacatagtagatgcttacttgggaatattatatctcaaaatagaaaaacacccagcaaatcgcatcttatattagtctttagaattagtatcaaagcctaattattatgacacttgaaacattaaataacttagaaaacaaagacttaaaagttttatgataaagccagaaactttttatactgaccatttttaatactgacatttcagataattggagggcagatgatatatgaaatataactttatactgtgacttcttaatacttcagtttgtttagaataaacttgataagttcgtcaaatttttattttattaaaaaaattctgtttgcaaatggcatatttacacaacttggtaataagtcattttctcttttttccattttactaacttaacaatctaaaagcaacaaccacaacatagaggattaaaattaat

SEQ ID NO: 1154 - DNA, 1062 bp, Homo sapiens
caatgtgatctacagattcaaggtaattcgtatcaaaatcccaacatcattcttcacagaaatagaaaaagaaatcctaaaatttatatggaatcagaaaagaccctacaccatcttgagcaaaaagaacaaaactagaagcatcacactaccaaattccaaaatattacaaagctatagtaatctaaacagcatcataatgacataaaaatagactcattaaccaatggaatagaaaagagagcccagaaataaacccacgcaattcaaatcaattgatttttgacaaagctgccaagaacacacggtggggactggacagtcttcaataaatggtgttgggaaaactggatatcgacatgcagaagaaggaagatgaacctttatcttacccttatacgtaatacctttataccttatacctttaaaccttatacctttataccttatacctttatcttaccttatacgtttataagacttaaatgtcagtcctgaaactataaaactgctagaagaaaatatagagggaaagctctatgacattggtctaggcagtgatttcttggataaaagcagaggcaaaagcaaaaatagatagatgggtttgcatcaaattggaaacttctgcacagcaaaggaaacaattagcagagtgaagagacaacccaaagaatgggagaaaatatttataaattatatattggataaggggtcagtaaggaactcaaactactgaattcaaggaaaagaaataatcttatttaaaaaatgggcaaaggacctgagtagacatttatcaaaagaaggcatataaatggccgacagataatatgaaaaaaatgatcagtatctctagccatcagagaaatgcaaattaaaaccacgatgagataccacctcatgtgtattagattggctattatcaaaaaaatggaaggtaagtgatggcaaggatatggagaaaagggaagccttgtgcattgttggtggtattgtaacattagtatggccactttggaagacagtgtggaggttcctgagaaaactaaaaataggatt

SEQ ID NO: 1155 - DNA, 1199 bp, Homo sapiens
tggcgggatctcggctcactgcaagctccgcctcccgggttcacgccattctcctgcctcagcctcccaagtagctgggactacaggcgtccgccactacgcccggctaattttttgtatttttagtagagacggggtttcaccgttttagccgggatggtctcgatctcctgacctcgtgatccgcccgcctcggccccccaaagtgctgggattacaggcgtgagccaccgcgcccggcccttttttttttttttaatcttgagttttagactcttcacttggatagatgcttttagatatttggcccttatgtttcaagaagatattgatctagaatgtatctcttcatttaaatagattatcaagtacttacaatcagtcttcatttaaaaaaaaatctgttacctgtttaagagtatggctttgttttcttttgtttttttgttttgttttatttattttttaattccagaagaaatctttaaagctagttgctaagagtaggagtagaaactttcggtctccccatgttacaatatttggatatctttcagctctaaaatctttttttcagatttgtaatttagatgtgtaatgacaaaaatgaaaggctctgaatttcaatatcatatcaaatatttttatttcagtgtttattgatgtaaggactaagttattgtaatgttataggaattcatttcttttcatgattttaatcactgcaaattggaaagtcagataaatggtgcaattaaaatttttttttcctttctagcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagtaattttaaataaaaatttttatttggtttaataaatacattattcaaagtatgtgattatttaaatgacaacaattgtcttttccctgtgcaaggctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaa

SEQ ID NO: 1156 - DNA, 1048 bp, Homo sapiens
atgctcaaaggaaattctcattggagcattttggatttgggatttcagatttccagattagggatgcttaaccagtaagtataatataatataaacattccaaaatctgagatacttctggtcccaaggatttcagataaggaatactcaacctatactatatttgattgacctatttgtcagagcatatgagttctttttaccttttgactgttgtgagtagactgctatgaacatttacgtgcaggtttttgcttgaacatctgttttcaatttgggggtatattcctaggaatataattgctaggtcatatggtagctatatctaagattttgaggaactgtcaaactgttcttctcagcatttacattattttatacttctaacagtaatgtataaagtgggtttcagtatctccagatcctcaccaacagttaatattttttttcattcttctttgatcgtgttctaataggtccattattggaagtatggtaatatatctaactatgtctgtagaactgtctgtatttctcccttcagttatgtaaatttttgtttcctatattgtgggctgttttgctaggttcatgtatgtttacaatttttatatcttctagacggattgactcctttacctttaccttaactcctttataatgtccttctttgtctcctataacaatatttaatttaaaatctgttttgtctgattttataacagctacccctactttgttttggttttgtctttgggttcaaatgagtctcttttagattatatattattgtattctgttttataagatccattctgtcagtcttttttttttttaattcatttttattgagacagagtctcactctcattgcagcctcccactcccaggttcaagcaattcttgtgcctcagcctcccgagtagctgggattacaggcatgtgctactgcacctggctagtttttgtatctttagtagagacagggtttcaccatgatggccatactggtgtcaaactcctggcctcaagtgatctgcatgtgcca

SEQ ID NO: 1157 - DNA, 1019 bp, Homo sapiens
agaatacagaaattagccaggcatgatggcgcatgcctgtaatcccagtaactcaggaggctggggcaggagaatcgtttgaacgcgggaggcggaggttgcagtgagccaagatcatgccactgcactccagcctgggtgacagagtaagactctgtcttaagaaaaaaaaaaaaagtcctcctgcttcctccaggcctttatgttttgtgatgagaaatccactgttaatgttactgaggatcccttgtaagtgatgaattatttttgtcttgttgctttcaagcttttctttgttttttcacagtttaattataatgtgtcttagagtggatctttttgaatttattctacttagattctttgagcttgatgtgtaggttcttgtctttcatcagatttgggaagtttccaatcatttcttcaaatgttctttcttctccctctgagactttgatttttgcctacattggtgtgctttatggtatttctcttagactctgattttcttcattattttttctttctgctcttaagactagacaagtgcaattgatctaccttcaaattggctcactttttcttctgcctgctcaaatcttgtattgaacctctctagcaaattttttcatttttgttatacttttcaattccagaatttctgtttggttcttttttataatttttaaatccatattgatgttctctatttgtagacacatcacttttcttgtttcccctagatatttgtccatggtttcttttagatttttgagcatcttaatttagtaagtccaacatgtcttgacttccccagggtcagtttctgttaatttcttttttctgtgaactgaccgtattctgttactgtgcttgcttcataattcaagtacttcatttccttagtatacttactcacaaatcagattttactctttccaaagatttcatttttctgctatatgttgaatgtagttgtttgcctagtaacttttataatctattttgtagagactatt

SEQ ID NO: 1158 - DNA, 1054 bp, Homo sapiens
actgttctttgtttattctcaagtctttctttagtgtcttctatttttgataatttctttgctgtgtcttcaaggacactaatcttttcttttgcaatgtttaatctgcctgcagtcccatccagtgtattttttttttaatctcagatattgccattttttaatcactagaaatttggtttaagtctttttcatttcttccatgtgtctgtgccacattttcagtagattgactgttttgatgtccttgccttctaaccctaacatttatgtcagttaagccactaagcttgtaataatttgtaacgcaaccatagaaagcaaatacacctggtaatctttgagtagatgcagacattgtgaattttaccttgctggatgctgaatatttttgtatttctataaatgttcttgagctttgttctaggacacagttacttggaaacaatatgacccttttgggtactgcttttaagatttgttatgtgaaacaagcatcatttagtttaggggtaattattctctactgctggggcaagactcttctggatattttcttcagtgcctcatgaattgagattttcaagcctggctggtggtaacaaacactattcctacctatatgcactgagtattgttctttctaactttttcagtgggttctttcccctgcctcagatattttcttcataggcaggtgctgattagtactttgatgaatacttgaaaaccctctgaccatctcaggagttctttctatgaacagctttaactgccttgtgaactctagctgctttggtttccttgtactcttatttctgtctcttcaacttggctccgcctgagtttccccctccctgcactgtgtcctagaaacccttaagacagtaagctggagcaatcttagggcttatctcatttgtttcccatctctcagggatcactattcgtctttaacctttttcatatattttgtctgattttctttttttggtagtttgaattgggaagctttgtttgttactacttggatagaaatatataagtacttcag

SEQ ID NO: 1159 - DNA, 1053 bp, Homo sapiens
gtagggtataatccaggattttttttttttcttctttcttgagatggagtttcgctcttgttgcccaggctggagtgcaatggcacaatctcggctcatcgcaacctctgcctcccaggttcgagtgattctcctgccttagcctcctaagtagctgggattacaggcatgtaccaccacgcctgtctaattttgtatttttagtagagatgggggttctccatgttggtcaggctggtcttgaactcccaacctcaggtaatccacccacctcggcctcccaaagtgctgggattacactcctgaaccaccgtgcctggcctaatccaggattcttaatgaagtctacttactaccagctctgtgttctttctattctgtcgggttactcttttatattttcttgtagctatgcaatttttcatttttcctgaattccctcagccttcctgttataaaaagcttaatgaagctcccatgagagattgaaataaatgacaaaatgttacactaagacctgttaactctttcccttgcacctttcctttagaataacgttactaacatagtagtagaagttctttatcaatattagaaacagagaagagccctgtccttagaaccaaagcttagaacaattttagcagatttcagtgttgttaagagcagaactatagaaaatgtcgaccgatcactgggaaaggagggaaagagagtatagaagcagttaggacaagtaaaaaggtggtaggattcatggattgggactaacagtgggattgtcatatcagtggatgttgaagtattagagagagtgaactagaatattaggagataatgttcagagagaaagatgcagacagttgagattgtggaaggattatagttactggtatgacagtatgatgacaggagtgaaacggcaaggtaaggcaagtcacaagattataagaagttagccgtgtgcagtagcttatgcttgtaatcccagcactttggggaggccgaggcgggcggatctcctgagttcaggagttcaagaccatcctgacc

SEQ ID NO: 1160 - DNA, 1060 bp, Homo sapiens
ctagaatatcgttgctcctagagtttgaaattatctaacagcatgcccttgccttgtgtaactgacctgcttcatctagaaaattgccggcgtaccagcaatcacacttgcattttaaattctaaacattgggccaggcacagtggctcacgactgtaatctcagcactttgggggagccaagacgggtggatcacctgaggtcaggagttcgagaccagcctagccaacatggcaaaaccccatctctattaaaaatacaaaaattagccatgtgtggtggtgggtgcctgtaatctcagctactcaggaggctgaggcaggagaatcacttgaacctgggaggcagaggttgcagtgagctgagattgcaccattgcactccagcctgggcaataagagtgaaaccccatctcaaaaaacaaaaaataataaaaaataaatggtaaacattagtgacatcttcttatgcagaagcttcagtctatctgtatggtaccttgtttttcagataccatgtgactgttttacttattcaaaccatgctggatgttaggatttaaagtgggattgaacacaagtggtggagtactaacataaaatatctctagatcacagccccaccctcccacttatgttgtgaagaaagtaacgctcactgggaacagtgcaaagtaacaaaaaatgaagagctttatatgtaaaatgttagaaacagataatcggtgccgtgaagaaaagtcagcacggagacaaaggatctctcagcaaggcaatctttactttctgcagaaagcgtgcccctcgcaaatggaacaatcgcgagagcacacctgaacaaaggaaaagcagacatatatatcccttatgcatttgggttgtccttactgctgtgtcctgcatccattggctggagctggacctcacagtcttaaactgattactgatttgctaataacctaaaactttcctaaataggtaaatgcaaaggagaacaaagaggaagaggaagttgcttatgaaaggtttaaggaagcaacaacatttccaaataaggaagg

SEQ ID NO: 1161 - DNA, 1107 bp, Homo sapiens
cgtagattataaactaatggataagaatttttaaattatgacttttggttatacataaagaaattacttgctgtttttgtttttttcaacatctacaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagtgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacagagtttcactcttgttacccaggctggagtgcaatggcatgatctcggctcactgcaacctccgcctcccggattcaagcgattctcctgcaagccattctcctatctcagcctcctgaataactggggttacaggcacatgccaccatgcctggctaatttttgtattttcagtagagatgggatttcattatattggtcaggctggtcttaaactcctgacctcgggtgatcagcccgcctcggccttccaaagtgctgggattacaggcatgagccactgcacccagccgaatttatgtttcttatggtctagtctcagctaaat

SEQ ID NO: 1162 - DNA, 1053 bp, Homo sapiens
cctctggatgctcatggtccagaagagatagaataggctgcttaaactagaggtaatataggagtgtggttgatactacatgacatactgcctgaaatactattcttcttctaacttgattaacatacataataatgtgttagtttttcattgttttggttttgttttgttttgagacggagttttgctcttgttgcccaggctggagtgcaatggcatgatcttggctcactgcaacctccgcctcctgggttcaagtgattccactgcctcagcctccctagtagctgggattacaggcatgcaccaccacgcccactagttttgtatttttagtagagatagggtttctccatgttggtcaggctgctcttgaactcctgatctcaggtgagccgcccgcctcggcctaccaaagtgctgggattacaggcatgagccaccgtgctcagcccagtttttcatattttttagataagtttaatataaaagcgatggctccagctactcgggaggctgaggtaggaggattgcttgtggctgggaattcaagacctctctaggcaacatagtgagacccacctctaaaaaaagaaaaaaaaatttttttaaagaatgagtatctgaattttacttttcactccaacatttatattgacttttgaaatgtttttccttaattttatcattatcaaataagttgttttctgggtatttctatggattcacgtgtatttaatattttacaggattcagagactgtttttgatattcagaatgacagaaatagtatacttccaaaatctcaatctgaatacaagcctgatactcctcagtcaggcctagaatatagtggtattcaagaacttgaggacagaaggtaaagaatatataccaaattttgcgactacatgtttggtaccatactttattgtcttattattaattgaaatttctcttttcagatctcagcaaaggtttcagtttaatctacaagatttcaggtgttgtgctgtcttgggaagaggacattttggaaaggtaatctttttg

SEQ ID NO: 1163 - DNA, 1034 bp, Homo sapiens
attaacatcagcacgataaaagccatgttgagtggcccaggtcaatttgctgagaatgaaaccaatgaggtcaatttgagagagataccttcacatgtgctatcaaaagtattcgctacaccaacagctccaccgagattcctgaattcccagttgcacctgaagttgctatagaactgctgatggctgtgaacttcctagattgttaaataaaatataattttaaaaaaatgaaagaagtgttaccttaaaaaatggtagagttgaaaaaattcgcattttttcctactgttttctgtagattaacttaaatttctgaggataattgagttgtacatagaaattattactattaggaaacagtgagttatgttaaggcaataataggagactaataatttattatgttataaattgttagaaatgttgaattgggatgaaattgggaaagagtaaatcttttaataagtaattgaagattacttgaagggacttgaactggagatgcaagaaaaattattttaagggattggttcattattctgcagtttccccatgccagcaacctcccttgtacacttgtaagtttgaagaagttagtgctgaatgaacaaattatcaaattgaatatcagaaatttctaaagttttgttctatgcttgtcatttattggcacttaccccaaacaaatggttttagtttcgccggatggataaccccttttggtatgtcaatttgaagtggattccttggaaaaggaggagaagtatggctaattaaaatttatcatgtgctaagcactgtactgtatgccttaaatattagttcatttaattttgcaacagcctttaataagctcagtactgatcttctgcccattttcggaggtgtaaatagagacacaaagagattaatgacttgcttaaagtcacacagctctcatatggtggagctggaattttaaccttgtcactctggctccagagcatatctaaagcattatgctttgctgctccaggacaggatcttcaatt

SEQ ID NO: 1164 - DNA, 1032 bp, Homo sapiens
aaatggaatggagtggaatgaaattaaatgaaaagtcatatcatatatgagatagacaagttttttataagggtctataaaatttaaagatttcagaaagagtatatggtgtattccctctgtaatagatacatatctgttgtcacttcttatagttcttttgttgttgttttggtaggcatgggtttattgttgttgttgttgttgttgttgttttgtctgttttttctttttcactgcctggatcttggttgtactttgaatgggtgataagattttactgccttaaaacttgctttaacttactcaaaggtatttcttctagtctccctttcctggtgatgatgaagaggaagtttttgacagtattgtaaatgatgaagtaaggtatccaaggttcttatctacagaagccatttctataatgagaagggtaagaattaaaataaggataagaattttttaaagactactttaattttttatactaaagaaaatttcccagtagaactttaaaagctgtttttcagttcataaatgttgcatggcttagacaaaaaaagacaaaatatatctaagttttttaaagtaataatccttatcagtgaattttattctattggttttattttaacttttttattttacattatgctagctgttaagaagaaatcctgaacggcgccttggggctagcgagaaagatgcagaggatgtaaaaaagcacccatttttccgggtaagtgtgactatttaaaattttttatgaaactagagcgattagatttaacaaactaaactagtcattttttattttatgatccagctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagt

SEQ ID NO: 1165 - DNA, 1050 bp, Homo sapiens
tcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcatttcgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaag

SEQ ID NO: 1166 - DNA, 1102 bp, Homo sapiens
tgagggcctgaaactccttctacctctaaattcttgtttctttgcctatgtggctcttttctttttacttgacgagcaaaagaagtatactttgccaattttgttatctgttgtaatggccctaacagtgatgtgaaaatatgtctgaatcaaccccacgctttgagttttaaaaaacccacacagtgtaaccttccccagtcatgtcagcttttcccctttgtgacacgaatgaaagaacaagagcattggagtgggagttggaacagccagtgctgaccgtggcacagcctctgccaggggtgagcttggagatacatttatatctctatacaaagcatacagcttcctcaggaagagcccaggagccccaaggaaggttttgagagattatatcagattagttttgggaagtaacactggcaactgtgtggagggtgtgctgaagatgagagagatcatattgcgagaccaagtagggcagtgggatgaagtagaggagactagtagaaaagttagtttagaaaaaagtcataggattaaatattctatttccttttatcagaagatcctatggtaattacttaagtcaaactgtgattactgacattttactagttttactatagcttctaactttttcagagaaggagtggattaagttttgaaccagatgatttggggtcaaattgtcaaatttcaggttaccagtgagtgtgctttatattagcacaactttttaaattatagcttctaaacatttatgtcttctgactggaaatgggaaaagatttgggggaagtactatttgttctatggaagaataatgacactttgcacaggagaggtttgctgaaaccaggtaatccctccaggcagcttagctcattgtcttccagaaagctaaaaaattatgggctcattgggtaaggtttcttggcctagagagaatagaggttgtatttgtgaggagcttattctttcatggattgctgttctctaaaacctcctgggcagagagagttcccatcacttttgatgttgtcatcactgtgaacatagaaagtagaccaggtagagttatttctatttttatcaatta

SEQ ID NO: 1167 - DNA, 1091 bp, Homo sapiens
ttcaaaggcatagtaggaagggttggaaaagcggcctggtaccaaatttgatggtgggggaggatttgtgaatgtatgctgtggagccttggtgagtgctagtaggcactggttcattggttggacttgagttctgcttgactgtgagcccaaagtggagttgcagtccagtgttggcatcttatcaagaatggcagtaactccactttaccatctgcttcaggagtgtcagatctaatgtgccatattcagttctggaaggcacatttaaagaggactttttgcgaaccaagtttcaatggtgggatatatcaagcacggaagagtaactcacatcttcttagccatcttctttctgtcagaacactccatcagctcatggttgtctacctggaatagatgtattttcccttcttccaagtctctctactactccctttcaaactctttgtcttttgagagccaaagaataggcaataaaaagcaaattaaacacattgctgtgattccttagtgatatgaaggtacataatcacaaaggcatctgactcaacctcctggcaacagactaacagctgactgagctatacccagaaaggagccctcagtgtagctttctgaagcaaagttcctcctccttcttgctgaagctatttctctatagctaagtaaaaaagacaagagatgtatcagaaatttggttaattgataatattaaggaattgttaattatttgtatatgattcagtaatgattctagagctgacacacataagcttgtgaaaactgattgttgtgttataggaattttcaagctagttaaacatagtcattaaaaactaaattgtacaaacttaaagtactaaaagtaaaataaatactcaaaactctcacttcctaattattttgctataatttgttgttatctatgctcttaaggttatttatgtctaaggtatctgcagagtagaagtgctgtataatgatgtgtgacacatctcttctcaactccacattcagtgacatcatgttggtactttgaaattggccatggtgggaatcatggaaaatggcaaagaaccagggtcctt

SEQ ID NO: 1168 - DNA, 1067 bp, Homo sapiens
tctagtaatgagtcttgtgatatatggtgagaactggcatggaaatcacaacttaggtggaaaaccaaacctcctaatatgtaatctggtatttgtttataggatcatactttaaaggcaacctttaaaggattaattttagataaagttactactatgttaataaataatcatgtttagtgcttacattgtacctgctgctgtgctaagcatttgaattgtagttgtctcaattaattcttaaaacaactccattaggttgaaaccattattatggttattatccctattttacagatgagaaaagggatactcagcttatctaagatcaagcagatggtaaacaacaaagtcaaaactcaatcttaactattctgcttccttcccttccaagtctctcacattttcatcagttttaggataagaactaggcctaacaaagtaacacattgaaaacatgtgatactcctttttaaagtctttcaaaaagaaggtcatatatgggtaatatggttttgatttattttaaccacattgtaatcggtatgtctggaagaaaagccatgtaaaacactgttatttaactacagattaaacttgagttattcatcttgttattaaattgttggtaaatgtttcttcataagaggctgtgcaagcaggatgtacccttgctctggctatctatcatgtcgactttaattatttaataggcagccagggtggaggaagcacttgttggttctgtttcactagatggaatactgagcaatgagctaggaaaacaaaatagatctcatttttaaattgtctcttttagtttttctaaaagatagattgtagctttgaaaaaaggagagagctgtcacattctatataaaactcctttttatatagctccttggagaggctgtgtagcagatggctcttagtcagctctgttgtgaatgctgggtctgcttatgaacttgagcaagtttgtttctctgaacctcaactttttcacgtttagagttggctaataatatctacttcaccaggtacacagtaagtgttatccttcccct

SEQ ID NO: 1169 - DNA, 1052 bp, Homo sapiens
catatattaataaacaatgtaaaagaaatattagtaaatgacttcctggaacgcagatgaaggagcaacaaattcagcctgtgctggtctggatggctcatagaggtgattccacttgatccagaatgggacagatgatgcagtgggatgttctttttttaaatccatctgttatttatgattttgaatttttcaaactgatgaaatgggagactttaattttacatagtaaagccttaaacttatacaattgcccgaggcagggtgaatgagtatgatattccagtgattcctgccatagctgtcctgccaaacaagatcccagtgactatgcctttaacccagttcaagtcctttgaccagagattcttgatatcttgctagatctttcctaagatttaactatccctacaagacaaatatacccaaatggaaaaccaggctcaaattccaaaattgtataatagttctttgtgcactacaaaaaagtttgttttgtcaaatccaccatctctcctgacaagaaagaaacaagaacatcaagagtaagatcctttggggctttttgtttttctatcagaaagctgattgctgctgtgttgttccttaatcctcagtcacttgggagccgttccttatatgtccttggttgggagccttcctttcaggaggaagctcttatttgagaaagaagagaattctcagtgttacacttatctccaaatcttccagaatacccttttatttttaggttatcttggaattgactttttaagttaaaatacacccgtcttgtgtccttcctctggagagagaatgtttttgaaggggtagattagctagttgtgtaacactcattagcatagcaaactggtggacgtgctgacgcaggccgcctgcctcagcagctgggtcggtcagaattgctttaacaatctttgtcctctttttatcctgcctaatatggactatttatgctattctaagaagcattgtcatttagtatttctcatttcattcttccaacttggtacttttatgttttgctaagg

SEQ ID NO: 1170 - DNA, 1026 bp, Homo sapiens
tgtcagcccagctatcccagtttttatgaaacacttctgtaaaggaaaataccctttcctcctaactaattcctatattcattcaagaaggaattcaactcagttttcaattgttttgttctgttacggaatgttaggtttagtgacttagattaaccagttctaaaaacagattacctgggttgtatgcaggcccctctgcttactgctctgtaaccccaggcaagatattgaccttcctaagcctccatttcttgagtaagagtaggcttatagtacctggagcccagagatatttgggcgttaagtaatgtaatatgtatgatgctcctgacacttctaagtacacagtaaaccttagctcgtgttatgatggaggtggggttttcctttatacataaagagaacttcattttacagtaacagtaattaattgttactgttaataaaactgtcaataaaatggtaatgaactgttactctaaaataaaatgcttataaatatggaccccatcagaactacagttttaatgttcaaaggatcatctacattgagaaactgttttgagaggtaaatcattgctgtacatgtggactagctctgtgtcatgcaaaagtgttactgctcagacaactaggtcaggggctgggcatgccaaaatgagcaacctggtctctgcccttacagaatttacagtgtgggaatggagatagttgagaatataaataacccaggggagtgaagaggtgaagagagcaagtaggaaagtgttgatcttggactgcttatgaaaatactcagccacgggcttccaaaataggacactgcagctgtggtctgagaccccttcaaatattatccaagcagcgtgctcttcttgagagagggtgggctgtgtggggaagcctgacagtcctgatgtggtgatctgggaatgggtggtgtccaggtaagtattaaccaaagatgtgatattaaaatataaattcatggagtactgaaatcattttaagtgagtaaaccct

SEQ ID NO: 1171 - DNA, 1033 bp, Homo sapiens
tccagctgtttgtggagcccctccacttgggtgtctagtagacatctcagatttcagatgtctctatccaaactccttattccccactccctaaacctactttctgtagcctctcactccctttataaaatggcaactccattatttcagcttctcaacttaaaaatattggactcataatgattcttctctctcaaacctcacacccaatccatcagctagagcacgagttacttatattgggaaaaactaaaaaaggagtaaacctagggcagtgggaggaagaaattaaggtaaaatacaaagcagagcagtaatagagctactttctgggcagtgtttgatgggatgaggaaaatctaagctgaaggcatttgagccttggaactcaggttgctgggaaatcacatcctaagccacattcccttaaaagagctaaaactttaaagtggtttgctatgttttgatatgtcttaacatcaagagtgagttagttggcaaaactcaagctgtcaacccatgggttagaaagagactttaggtacccgtgagaatgttttacataaagtttacctaaagtattttccatttcctgcttctggaaacattgtgggacctgaatggagaagccagaagtgcaaagtcataataataattttaaaaaacagtgagcatttgaaccagtcttagaaaaatgaatgttctttgttggcatatctacaataaagcaaaacacttagctgaaacatcagggaaaggaaatgataaatgtcatggggtaaaagatggttaaatacttaagtatcttgattatattaatttgaaccatgaaaaggaagtaagtactcactgtccttctgttttgatttggtatacatttcccagcattcaaattctcagcacagaaggttcttgctgttttgctgcaccaagttcttggaaatcacatacagatccccctaaaggagattggaacagtgcaatatttggggactgcattctccacccaaggatttagcatcaaatgaaaaac

SEQ ID NO: 1172 - DNA, 1033 bp, Homo sapiens
gaattatgcttgtgagagggaaaaagcagctactgatcatagatttttagtgaattcaaaggcctgtggctacaataatataggtaactgtggaaactgtcatgtaaagcaaaagccttgaaatgtacagcctgaagcacacacaattaaaaggatttttctttaaatatgtgaagagcataatcagaaacgaataatatcgtcattgtttgagagaactaaaattgctaggtagaagtacttttgccacacccaccaacacccttagaaaaataggttaagctcaacttgaagactttccaaataatgtaattggtccattaattgaacatacaatatcatggagatatccaaggaaaagatggaagtattcattgggttgcaagttccgcttacctcttaagattcctttgagtcaaaagttctatcattttatgatgctatgaggacagtatagcttaagaatcatttaaatgtgttaatgttcgtttattttttcttttatattgtcaaataagaaacatgaaaagagaaatttgagtacaggaaaagttctatttaaactctttgtttcttagcacagtttaacttctttcagttacagtcagcatcatgtggtattagcaaagagctctagatggaaagaaaaagatttggttaaaagttatagttcaccattagctgtgttccttgggcaagtcacctaatctctcttggctcaggattttcacccataaagtaaggggtctggactggatgatctctttgacctttttcaggtcctaaaattttataacccatttatgcttttctcatttaattaaatacatttctacagaaccatataattatgttctgcttcagtggatttttccagaaatattttgtcatgaatgccaaaactgtacaataaaacacaatctacagtcatgctctcccaagggagaaaggtataatttttatgtaattgggaaattttgcctttttgctcctgctttttatttccatcttttcactgccaaaagaaaagcaa

SEQ ID NO: 1173 - DNA, 1056 bp, Homo sapiens
tacttatggagccccccataaaatgattaggtaatctatggagccagggaaaaattccaaaatcttgaattggcacagtttatttatatatttgaacactatgttagatttgtctcgtttttattgagagtgtatgtgtgcgtgttgattaaaacctaacagattagaaggttggagaggaaactgtccttagatgacccagccttccattaccatgtggagtagcatatgatgcaacacttaaagtattgagccatattcatatcattttctccctgctgtgttttccagcatttaaaaaacatggtcaaaacttggccctttttttctcaaaatcgctaaagtttaatggaaagaaaaaagaaaaaaactaggccccttttcccttaatttttatattatgcagcatttttaaaaattaattttagaaaattctgatgtgtttgtcatgtccaaatagttaaattgttttggtagctatagtttggaaattagactcgattctgttctcagtactgtagacaaaatagctattaaagtcaaaagtttgtcaaaactttgtaatcatgattattatgttgttgaagtggtagcttgtaagagatttcagttatttttaattggagctggtgtttgacattctaagaaacaccagttaatatttgttgagtgccagcaggaagcagagaactggagtgggtgctgtgggatcttaacaaggcaggagaggattctcgtagtaatcacagagagcagataagacaggcacacatgaggatgccagcagaagcagacagttacagttgtctaagaatccagggtgtgtggaaccagataaaagtttatgaagtatgctgagggaggagtggaaatctgaattgacttttgacagtggtcagggatgtggaacagaatatacgactaataaaggagggtagagggaacctagttcgtgaaaaacttaaccacaagtcagtggtgttaatcatttgcctcaagaccagtggctctcagaagtaggcaattttgcttctcagcagacattgaggaatgtcg

SEQ ID NO: 1174 - DNA, 1038 bp, Homo sapiens
ctgacctcatgatccgcccgcctcggcctcccaaagtgctgggattacaggcatgagccaccgcgcctggctacccttaaattttatagttgagcgtatccaggcacagggaggtgatgtgcttagcgtaagtttacacatgtagtgacagagtaggcattagaatctatctgccttaaagaccacaataaaggctaaggatcaggatttcttctctgcttagaggtgtgtaaacagtggggtccctcgggtcttatttacataattgatctaaaagaaggaacacacagtggaatttctaggtttgcagatgacagcttttctggattatgaaatgtctaaccactgggtatttgctccagggaaaccacactaggatgtattagtcatcagacgatttgcaggtgagtttcttgtgggcaaataggtggttgggtattaaggggaaattacagaattttcataggatggtgttttgttggataaactcagggaagggctctgaaaataccttcatgttgttgtcctgacttgctgttgcagaaaaacaaaaaccatgaaatgctaggcttcatcaaaaagattttggggctgggcatggtggctcaggcctgtaatcccagcagtttgggaggctgaggtgggcagatcacctaaggtcaggaattcgagaccagcctggccaacctggtgaaaccccgtctctactaaaaataaaaaaattagccagatgtggtggtggtgcctgtaatcccagctactcgggaagttgaggcaggagaatcacttgaactcaagaggcggagtttgcagtgagctgagatcgcgccattgcactccagcctgggcaacagagactgtctcaaaaaaaaaaaaaaaaaagattttggggaaaaaaatacaaaatatagtcttaattgagttttcactgtgttttttcccccaaattcgtgggcacctaaccttcagaaagacactagagctggaatgaccattgtaatgatacctacctagaatgtttggacattgctgctagaa

SEQ ID NO: 1175 - DNA, 1040 bp, Homo sapiens
cctccttttggggaacgctcataaatatggtgttaggttccattacaagcattttttttttcttaaaacatttttttctttcctcttatgcttgctggtaatagttaggaacattgccagagaaagcttcacttccccaacaatgcataaatcccattgctacatcttagcatcgacagatagccagcactgcaacgagttctgcagaacaaggagaagaaaggatgtacaagaagacacctttttctctgatggtcattggccgccagaaagctgtgtctcaaaatctctcatgctatagagataggacagaactcttcagattgggtattagatgccgtcagtcaaaattctcttcactgattgcttacaacccaattttaagaaatactagaaaattaaaatgcttggaaaaatggtccccatggtgcttgcaatggcactctactgagtaggcttttaaaatcagagtattctcagatatggctgcttttttgttttcgtatttaacttagctggttaagaagtacttggacaatgtatggaacacctaaagttattaataataacagctattaggcacttaatgattgtccaaacctatgccctggaatttacatgcattctcatataatcctcaaaacaattctgagtgaaagatagacttattcccactctacggatgaggtcataaggctggaaaggttatgtcatttgcaacaacgtcacatagaagtggcggaggtggaatttgaaaccagactcattttataccagacttttttattttaaaccagactttttaatattttataatatatacctattctcttatctactgtaccctttctcatttctgcacatttctttgtatttattttataatacctagtagtatttctgttacatgaaaaagagaatcaggttttgaggtgtaaaggtacctgataactcctctggttcgtgctgcgtgtttgaagagtagagccatagcggcatcccggcatttaggcttccaggccaatgctcttgtcacccca

SEQ ID NO: 1176 - DNA, 1050 bp, Homo sapiens
gttcagacctgaagtcttaacattttaaacatgtatctatttgctattgcttacttagttcagtcttggcattttaggtttagaggtggttactacccattggacatccatagccactccctgcaaattaaaggggacacaaaaatgaaactgaacttctgtttttcttcacctctctgctaatttaactaagtcaattggctcgccctcatttgccctcttcacacctcccaaattaatgttatgtgcaaatttgattaaaacagcgtgagtaatttccaagttacttttgaatacggattgaattccgttccttgtggctttttcttcatcatactagtagatgtagccagtgtttttgtttctagcctgcttaacttgtgtggttcttggaacaacataagttttggttgatttaggatcctgatttcacaggatactgtatcaactgctttaccaagatcaaagtacatgggttcactgcattcctttcagttgctaattcagttgtgctgtagccaggcaatcctggagccttgaaatccaggattctggtcaaggtgaggaagcagcccttcctcctggccttttcattctgcaaataccttttctttccttcttaatatttatttattcagcaatgtggcccaggctctgcatccctgacttcctaaagctttcagcctagtgcccctagacaagtggttacattcttgctacaaactggaaagtctctgagcccctcaccccactcctccccacttcttttcttctgctgtatttatggcactgtacctcatgaactttcacacaagggaaagcaaactcaatccaattgggtcttatgggtaagaaaatgtgttggttaaagtagattctggtcagccaggctatcgaagttttagtatttactagcagtgtgactttgggcaaattacttaacatctccatgtccatgtctcttttctcatctgtaatatgaagataacaataactcctacctcatagggttgttgtcaggaatcattgaagtgttaatacatgtaaagt

SEQ ID NO: 1177 - DNA, 2185 bp, Homo sapiens
actcccctgcaaaggctcagtcttgtctttacaccttccccgaggtaattattttctggggggtaggggtgggggttgggagggtgaagaaaggaagaaaaagaaggccgatcacactgggcaccggcggaggaagcgtggagtccattgatctaggtacttgtggggaggggagaacccgagcagcagctgcaaacggaagggctgtgagcgagcgggcgggcgggtggctggcagcgaggccaccagcagggggggcccgggccgaggccgcgccacctcggcaccacgcgggcagccggtgcggcggggtcgccacggccaggggagcgctgggtgcccaccatggcagttatgcaagcggtgaccccctggtcttgcctccccgccgccctgcactccttcctccccgctgccgacacttggatctctctagctctttctctcccctgtgttttcaaacaggaagtgcacggctgtctataacgtgctgccgggtctcaggatggaggagtgaagtctcctgtcgccgtggttccagcctccggagctcgcccaagccgcgtccccagagagcgccctgagagaacagggtggccgcttggtccaggtgcgcggggtcgggtctgggtccagggagcgggtcgggaagtctgcggcacggagcactgctagtgtcggatctgcatctccagctctgtgctgcagcttcacttgcccgccccccaccactggcttctcacccggggtctctgccaaactctggctgctgccgccctgggttcgggccggcggaaggccctgggcgtgcgctgcggagccgcctgcgaggactccactagggcgctttccaggctggactgccccgggctgcgctggagctgccagtgctcggggagtcttcctggagtccccagctgccctctccaccctctcctccagctgctgctgcctgaagcagcagctctttgttcctcccttactggtctggggtcatacacataaatgtcctgggaggcagggtggtgggagggtaaggggttgggacgtagggaagaggaagaagatgagttgtgggtgaagtgtaaggtggacaggagaaaagaatcttagtgtccatgctcagaaatcagctcttcagctgctgaaacagaggaccccggttccttggtttctgttttgggaaagccaggccatgccaaacagagggaattaatgatgcaggcacacaccggaaaggtagggaccaggaatgaggcacagcagcgagttctgagatgtttagtctggtgtctggcttgttaactccactgtggtttctgagccaggcctcctcgctgagacagaaggtactttaacatatgagccaggcatctttattaattccatttgtcatcaaagtaaaattgagagtgacttttctcaaattcaccaggtagattatactttcacttccacatcgtgttccatctcaaatgttcataggagaataaaacactagggttggttttatgctacagacgttttgcatctttatttccctggcaggtccaatctttctccagaataactcagattgacttctccccccagtgaaagcctagccttgttttaccgcctgtttatctacctggtgaaactctagtcttggggaggacactaaggggagtgggatggctgagaataatcagtttgatgggatcattatatggcctcaaattaaatgtttgagccctgttaaagccagtagcatcttcttaatttttatttccgaggaagggatgtgagcatatgactagaggggaggaaagtgagactctgccaaagaagatctctccctgtagcacagaggaaaagtgaatctgtgtagcacagtatcacatacactgcgcgctttcactttatcgggtagccaagccatctaaggagtcagggttaggtgtagaatttacattcatgacgtgggatgctgactatagcattctgatgctgaaaattttatcataaaacatatttactacataattaagtttgctttgaaaggaaaatttaccagggtggtacaaatttaccagcttgagtacaaaacatgtaatcaataagtacatggcattaagtagccaaaatgcactatgaaaactgaacaattaaacttatccttcctagatagacatgaacttcgtaa

SEQ ID NO: 1178 - DNA, 2315 bp, Homo sapiens
aatgcataatatgttagccatcagattataaagattcccaggtggaatttttcctctttgttgtacattaaaaggatgatgtgttaagccctgattttggatctggtcatgtttccgggctaatcgtttttcatggtcagctttgagatctttgcagttagtcatggataactggatttctcttaagagcattttccctacaatacttctgcgaatatgccttccctgtttttgtagagtcaggactgtgaggccagtttcagaatcatgatggtcatagccactaccaccaccaccaccagccctatattcatttcccagaagctaaaagaggcttcccaatcttaacctttacaatttgtggtaagtttaaggaaagggagataggatttatccctgttctgcagtgggaaaaactgatgtgtgggttcatattgaattagtctctctgatttctgtgtgtgttgtattgacatgaatgtaagtcattctgcttgagataggttgagcagggcatggaaatctaatagggttatttcatgaagttcctttatttgttaaaagaaattacttcctatctattgaacaccatatttttcaggcattgacaaatagacactgattatctctaatcctcctggtgttatgcagagtgggtaataaccctgtttgtttttttggttttttggggtttttttttgagactgagtctcgccttgtcacccaggctggagtgcagtggcgcgatctcggctcactgcaagctctgcctcccaggttcatgccattctcctgcctcagcctcccgagtagctgggattacaggcgcccaccaccacgctggctaattttttgtatttttagtagagacggggtttcaccgtgttagccaggatgatctcgatctcctgacttcttgatctgcccgcctctgcctcccaaagtgctgggattacacgcatgagccaccgtacctggccaataaccctgttttatgtgaagaaactgaggcaggcagagactccaagtcacacagacaagctaaggcctggacttggatccaggtttgtgcagtctccaacactaaaacatttccctcactgtatatcctgctttccttgttcttgaactagactatgtaaagaaatgatcatggtttgtttagtcttacctaccctttcagcaaaagttaagttaaaactgtaaacaatatggagacagtacaaatagggacatgaaagggtcaacatttttatgaatatttttggcttccatgtagtatgtattaatttttttctaagcaacctaggcatatggaatttattggccttcatgagaatttcttgaggcgatattgaccacaaacaatattgctggatcataggatatatgcgtactaggaactgcataattttactgggaactgcacagatagttgccaactttatatctccaccaatactgcataatgccttttttttttttttaaacaaatttcctgattgctgccaacctgataaatgttgattatacctaatcaattataattatacctaaccaaaattaatggtttaattttgcctttttctgattgctagtgaggctgaacatgtcttcatttacttaatttaatttcccttttccatgaattgtctttttatgtctttagcctgccctttattttctgttgggtctcttgcctttttcttgcaagaacttcttgagagaatttttgtaatgtttcttgtgtattctagaaattaattcctctttgtctttagacattgtaactttcttctagtgtgtcactttcctaataactttgtctatggtgcctttcagtaatagcaacaataaaatctttagttttaatgtacttgtctcatcactttatattattattatggtctgtgcattttgagtcatttaagaaatcctcccctattctgggctcacaatgttgtctctcctcattttcttttattaacttcaaaggttactcttattatttgggtttttaaactctttgtaatttgagatacgaagtattaacccaatttttatttttaaaaatctggtcatattgtgagccagttttcccagcactatttgccaactagtacattctttctccacagagttttggtgctacccctaggatgtcagtgcatatatgtagatgtatctttctgagatctctatttggttccagttgacttaattgtatgttcttgggcctttgatacactgttttatttatttatttttcaacttttattttaagtttaggggtacaagtgtatactacaaaggta

SEQ ID NO: 1179 - DNA, 1034 bp, Homo sapiens
gacagttaggtattcagtgggtagtcagaagacctctaaagcctaacactggattgtcaccagtgaggaatgaggaggagttaagaagtgggggcatcaaatggagagacagcgagagagcacaggcaggagagcgagcagatacacgcgggtgtgtacacgtttgcgaggagttgtgtgtatgtgtgtgatagtgattagagcttatagtttggttgagaatagtggtgaggaagtgactacaagtagaagaggaaatcattaatggagtaaagttccagaaaagataggggggccaagttctagagcacaagcatactcaaaggggttgttataaaagggaattgggacgtttattccattgggacaggagaagacgaggaagagatatgtgtggctgtaggtgaatatgcaagtggatgggaaagaagttgagaaagtttgttcctgatggcttggatattttcagtaaaggaggagatgaaatctgctgagagtgtggggccttgaggagacagctggaagttagtaacagttacctttgtaaaaggagcccagtgctttaggatgagtgatagctgtgtgtcattgaaggcccagttgtagttttgtcagtggtggttaggtgctgacggaggatttttttttttctgtttgatagagtactgtaatatgaatagcatgaatgaccttttacaatagaacgcacaggccctgcctgaaacattaagtttggatggtgatttaaagattggacaggaggagagaaggagcagcagacttaacattagggaacttgagttctagtcctagttcttccatttaatggaagacggggagttcttcctcctcatctttcaatggaggaagttgcatttgatgtcctctcaagtcttctgtagctctcagaacttctgtgagatttgcacatcattagacaaaaatgagtggagaagagagtaagagcagctagactcccatcacttatcatttatgggttcttctgatggcagcgctaatcccagagcctttgg

SEQ ID NO: 1180 - DNA, 1050 bp, Homo sapiens
agtgtagtattgtagaagagaatcgaacagttggagaaggataagtattcagaggatcttaccttaagagtcctttctcctttccgtttccatcactgcaccttgaatgtctttgcctatagattttgaaggatttcatcactcttctgagttggctgtattcttcctctggaaggtgtacttattcttcaaagccatttaactgtctgagcccccttttaagaacagggataacatcttaaagccctcaaggtgtggttagcattaaaaggtgaatccagtcagatgagtggctccagagattattgtaataatttaacaagcctaagcaggtgataggacactcctttgtaaattaagcctctaatctttctttatgctcatgccgatttgagagaaacctgggaatttccttttcccccattaagctattacacaacttaatgcttggaaaattcttcacaggaagaaacagggtgtaacagtttttgtgaggcatcttttaaaaatgcacccttttagctgaagtctgactatacaattgcctctccacctctttgctctagtttctttttgagagtcttaatttctccacataattatatactcttcaaagtgaaaatagttaaaaaattaaaaccacttaaactgaaagttaaaacattgttcataaatatgttcttccatttcctgagaaacaacaggaaagattgctttctcaaaataaactaagtagcctgagtatgaagtcagaccaatagagatcaaagattcacgcatcatcacacaatgggaaatttttagtcatttttctaaccacaaaaataagtctaatgctagttctgggggtttgttttgttgcctgtggcatcaagatatgtatgtataattcagaatgtacctttggcatatttgaaattgtcttagcctaatgtgactatctagtgtgtctgaaagagcctattttcaagatatatttgatgagtgtgaacatactacatatacagcaatggaaaatagccttcttgggcattaaatttaggaagaatg

SEQ ID NO: 1181 - DNA, 1027 bp, Homo sapiens
ccatccttggccaagggagtagagagatttgaaacttcatgggagggtggggcagagatgctctctaaggttacacagtgtgtacataccattcagtcacaagctttgtgctagaaaagcccatgcttaaataccacctctgtcccctgctaactgtgtgaccctaggaaagtaagctaaattcactaagcctcagtttccccctctttaaaatgaggtcaaaatgataagaggattatcatgtgactttaacatacataaggcacttggtttagttattccttcccactgactttgtgattctatagtttttcattctgtgccttttttcctttctttcttcttttcttactctccagttcattcattgtagagccattaatggttttttcaccttgtattgtcctcttctttattaatacctgtgccttagggcctactagtggtgccagggattccctgagctcctttggtagcatcactgtccatgtcacatatctggacaagtcagcgaagaggtattggtcctctgtatcctttggacttggcatatgggcatccctgaagacttttacaaagccaagattcattgctactttagctttcctgtgttgtgtactataacaagttctgctccatgaaagcatcagatagcagttggatatagatggagaaaaaggttttgtacagggacttatggatgtagaaatctatgctggtaacatttattttttcttcatctaagtttctgtttttggagccaggcttctaattacaaataattgtatttgacagagaagaagaatatcagatcctgaagggccagaatgattcatcctctttaaggggaacatgtaacataactttggggaatagctatagatactaaaggggcaacataaaacagttattgattacaaagtgtatgaagacccagttgcttggcagagtgatatcatttagaaaagtggtagaatctcattcgtacacacttcatgactaaaagagctggttataccgttagatt

SEQ ID NO: 1182 - DNA, 1048 bp, Homo sapiens
attttgttgttattttcttacatctagtgtaccaccctgactccagcctctggacctgggagtcatttcattgtagctcaaagaaggctatatataccctgttagcccatactgcttactaagttgttaatgaaaaagttattgttcttcataagagatccgtcttttgtccatggtaaatgatgttatgaaatttttggtttatttggttgttctaggttaggaataattgaagtaggccagtctttggacagtttagttctcctgtgtttagcactttttgtatttcttctctgtgctggatgtatttatgtttttcagtctttctgtgagttaactctaggagatgggtataactgtatccatttttgtcagatgataaaaagaggcttgaaatgcttaaacaacttgttccaggttatacagcttataaactggaactggatcccaggtgagttttccagagcacatgttcataattgctgtcttttttttacatttcctgcttcccttactacctgagtattgggggaacaggctgtggaactgaagattttactgtaacaaatgatccaaggaagatcatctggcctgaccccttggcttccagcaggaagggtgttttctcccgtgatttcatggatgagatattcaaggccttgtttttatttattttttggtttgctgtttcaaaataaaaaggcttttagttctttgttattataaaagtaataaattctcatataaagaaaatataggaaataaggagaattaaaaatgacctttgtagttccctagtcagttgatgaagagtggattcagatagctgtatcccctcactagccatttgactttgggcaagttttatagccttttcatgcctcagttccctgtatgtaaaacaagaataataatagtgcctgccttatatagttgttatgaggattacatgggctcttatttgtgaagcatttagaacagtgactggcacacagcaagtgcagcacaagcattggttggataaaataaagggctgcccatgtagtct

SEQ ID NO: 1183 - DNA, 1030 bp, Homo sapiens
aagcagagacaggaagaggcggcctgggaacctcagtttctttttgcctccttagtgatcctaataacctggaatattaataaacttatgtccctcactttcaagatgctgaaaatgattatgcttcttttttttttcctcctagctttcagagagctcatggaaaccaagcctgtttatttgagatttttctgttgcagggtaggccagacatgaatttcctttcatgtgatattttctgtggtctgtgttatttagttcttcctttgttttcttgtgctttggtgtgaagaaagaagatgccctgtttataaagccttggtctttcatgtatcatgcattcttaaactaattccagttgctctgaccctttgagattttaaaattgctttgttccggtttttaagtacttttgaaatattaaaaatgttcatgagggagtgggtcatgggaaaaatttcccagggttgtttgttcttagaaaattgtgaatttgcatggagaggttttatgctgggttaaattctgccaggtgcattggtcacttgaacttgagtctggttcttttgatatttaaatccgtgttgttatggcataaagtgcagagctggaacctcttaaaactaaatgcctgctatgttgagctcttgccccattgtcccatcaaagaaaggtcttaaccagtacttgggtttgcattgaggcaccatgtcaatagtgaggatcaaaagattggtctgttctgttttttgtctttgaaccaagactttccaaaaagaacatagacttgttttgaatattgccgcctctgggtgtgagtgattatgcaagtcagtagcatttttgtttttttgttttgaaaaaactgttcaacatagatgcagaggtaagaaattgcaagaaaaacaaaaacactttttcaaacttgtacaaagccatctttgaatgcaggtggtcctcagtttacaaggagttgtaattcttccttcatctgatgaaagacaccactatccaccagttaccatttgaa

SEQ ID NO: 1184 - DNA, 1046 bp, Homo sapiens
ttacattgatttgccttttctaatagatttcaagccccataagggcataaatatgtctatcttgtttcccactgtatcccaatacccagcacacagtaggatctcccgtgtttttgaatgaatgtggtccagatcattcccttattattacttgtagtagtgcttagcacacaacctgtgaatgaatttcattcctttaaagggagttttcaaaaaccattcttgttgattactttgcttaattgtactaaatatgtataaacatgaaattatatatatatatatatatatatatatatactttctgtgcttatagtttttataaaactattaaacattttaaaatcgcaaatacaaataatatattaaaacctttgaaatttaaattaataagatgaatgcttttttgccaacactaaatcacttatgttgattttttaaaatatgaagttgttccattgggtccaaatatgtacttaaggcatatgagtcttttgactgatagtagtaatgtagagaatacttatttgcataaataagttattcagaagcacattatgaactcgaaagccttgcttgctagctcaggactatcagaacttatcagatcgtaaatctgccagtgaatagttctttagttacaattttaatgattttaatgacttacaacttttttgttagagctgtaaatgtcctgttcattcaaagatgatgttaccatttcagaattactgacatcaactccaaatatatatctaattcaactattggcagaatcaggaacaggaatatgtttgtaaattttagttcttagagatatggaaaatttttaaggttttcagcatgcagccaagtgtcagactgttgaaggaagtcaatagattatagaaatgactcattcagattattttgaaaacaacttgaacagaactttttgttatcattgcctcctctttataatttttgaattgctgaaacaaaacctttgctctacaatacctgcatgtgtagcacataccttcatgtcatttgaccttcccttggtg

SEQ ID NO: 1185 - DNA, 1202 bp, Homo sapiens
ttcccctcagaattcaacctgataatgcagaggctttcacagccatctagtcccaacattgtctataagatgcttcaagatagaactttaaggaaaacacatgtaggaggcagtgaccaggggtacttggaaataggtaccctttccaatttagctttgtgaacatttgttcaatttggtagtttttaagctaactaatagcattgtgggcattttattcttggatttaaatttgggtaatttctgtaggacgctgaaataccttctacctagacatagaattcaactttaaataatcctactttaagttggttcctgggatgaggtacttagtaatacagtattgaagtggtagatggtgaagttacttcctgtggtggtgtttcattcatgtctcaggttgcaaagttatgtaagttgtttacagcaaaatactagtgaggaagagttcatttgccactgctagaaggtacagactccccgcatttagtatgatgactatctttggtcttttcttgcagctgtcttgtttatagagtcaaattatcttatgtctatctagggttaaatgtcacagtctcatgggcaatgtaacaaagtttgtattttgtgctttgttaaagaaagctagtaggtgattacttgcggttgaatcggtatttggagactcattaatgattaattgaaaacacacacaagcacttttttggtaaccgcctgcgcatagcgttcttttggggttcagatatttagcagatacccccttccctctcctaaaaatatacattcattttatattgtgttagacttaaagtatatttgaacagaatatgaagtttatgattcttaaactatttgcatttacatatggtataattactcttaggtctctgacggtaatagatgtccattttttttcattaatactcttgtttctttctactgtttacaggaatactaacaaaataccttaactgtcatctcaaaagttaatgataaatgttaataaacttcattataaaactgttcggtgatttacaatttgaaaatattggcaacccatagtacctggtacctacggtttggaacatatggtgaatggatttatttcaataccttcagtggctcttttctgaaaaagtccattgaaaatcttatgaggccttttttgtacttttgcctgtttgtttgtttgtttgttt

SEQ ID NO: 1186 - DNA, 1058 bp, Homo sapiens
tctgcaacgtaaatgcaagttcttttgggacaagtgccatagtttaaacgtaaattattcattgacagtagcaagcgttgtgcaaactatgcagtgctttctcagtaagtgctcattgagttgccctgtgtgcatgatgaccagctgtgttatctggatgtggaacatagcgttctgctatctgttttcagaaatgtcgcatatcccttccagggcagaccactcattgccaaggcataaggtcgaaaactgcccagtggggtggaaagcaaaggcagttggttagctgttggtgctttctttactctctacgaggatctttcaatggcagtgaccaggacttcattctgttatttgttatagaacaggcaagacatgaaccaacccagtcatattctgtaccaaacacatctgtggtccattctgctttccccagctttggtttcttcatttcacacgtccaagagaattttcttaaggataaccatcttattagaaatatgtctaattgataatgaaatgtctgtatttagctatttaactttgttctgggttctctctgcttacttaatgtgactgcatttccctgagatgaatgctgtgggtttttgcagtctctccccaactttgcccctcccctcttagatgaaggtgcatcactagagaacctgcaccactgtgtctcctacactgtgtcaggtagacagtacatgattagtaatgtgtgtgcaaagctttcatgaatgcttttaagaagttgaactcttaatattttgcttaatttccacatgtttaggataggattaatgtagagttgaaattaagatagcatcttgggaattttagataggaatcgtttgtgacccaaagtgaataaaaattgatattacaagcaggcttttaatccagaaaatttacttattctgtccagactgtgaacagttgttttgttctcaccaaaggcaattttggtgaagtgttcttagaaacagtgtgtacaggcttctgtaattgtacaggggagagatcatagagatccagggaacatcaagatacta

SEQ ID NO: 1187 - DNA, 1041 bp, Homo sapiens
gaattctttccctgcctggttagagcagagaggtggcagggtagtgggagatcagatattaagggaaaatccatgtgaaaactccagagtcatttagaataagggttagttaaccgtggtctacaggacagctgcctgtttctgcaataaagtttctttggaacatagccacattcattggtttatgcattgtctgtggatgctttgcactacactgatagagtcgagtagttgttacaaagactatactgcctccaaagcctaaaatatttagcattcggtcctttatagacaaagtttgttggatagcttaccaaataactacatgaagattgaaaagtttctatctgctctccaatttggtagccactggcccttgaagtttggatagtgagcacatgaagtgtggaaaatgtgaccaggtaactgaaagtttcatattatttggttttaatcaattttaaaaattaatttaaacctcaatagccacatttggctgatggctaccatgttggataatgcagaactgcagaactaaagtgaagctttcagattgggattggctgtaaaatgtcaaatatgacaagggtctgctttaggcctctggaaagagggagtctaaggaaaggaacatctagataggatatattttagaagaaacttcaaacagttctttctctctctctctctttttttttttttaaatttgtgtttattaagagttacttgtagggatccagttctgccacttacagctttttgaccttggtcaagttacttagcttctctctgcctcaatttcctcattggcaaaacaaggataataacagtaccttttaaaatttttatgagctttaagtgtgtatgtgctttaaaaataccttgcacatagtaaaagctttgtgagtgtttgctgttcttaattattgttattattatttcatgattttttgtggcctaatctaagaaaataatccttacatatttgccccactcccccttttctgttttaaggaaagtggattctgaatttcagagtaa

SEQ ID NO: 1188 - DNA, 1034 bp, Homo sapiens
gttctacattctgcagagatttaggttcattatccataacatgagtaataaaatttccccatgagtatgtgaaagttccatgcttggtgccttatgtgtatataggaaggatgtaataaatattagtggatctaaatcagaaaatagaatttaaagcagcaactcttgcccaaccagctagatacccttatatatatttcctttgtatcactcttcaaccttttgaattcaacaccttatttcttcttgcatggactgttgtgctagtctttgaactgatctattcattctattccaaatacagaatgttagattaattttttcaagcacaacatgttattgctaacatacgtatgtcactgtattacataatacagtgtacatattacataatatatgtaatacataatatatttattacataatacatgtcactagcactggaatctaaagctcatcactctaatgccaatgtattttgcattaaacactttgcctcagatgatcctagaaatgactctggaaagtgaaatttttgatggcactccatttcctacagaatgaaaagcaagttcttacctatgggctcttaactattccattattaatctcttctttttactggcctatctcatttccagctccatttctatccctaatcctcccagttcaatgatttctcctttatggttctttacatctttggacatttttcatccagtcatctattcagccaacaggaaggctggtaaaagtgggagtatgtggaaattctccttcgattgcatattctttggaaaatacaaagtgcaaggttttccagctgagggtggggaggagatttctaaagaaaggagaatgtatgaaatagtcatctaaaaaacgaaagaatgatggacttgggaaatatgctaggattgctaggctaaactaaggacccccctgagattagtggtcataagtttaaaacagtacttgtcagtcagcatggtgactgattttctccaaacatgttcagcagcccaggtacagtt

SEQ ID NO: 1189 - DNA, 1090 bp, Homo sapiens
aggaaactagatggccgttccatatgagaaaagaagaggcatgccaaacaccagaaatagccacttgttaggcccaggaaaccacctggggttctggctggtaatgagcctagggcatatggagaaatgtggagagattaggagggaggacgagggcagatagtggatggggcttcaactgccagtcaagggagtttagactttatttagcaggtagtagagtttttaaagaggaattccagagctgggcatggtgatgcctgcttgtagtcctggctactgaggaggctgagacgggaggatcccttgaggccaggagtttgagggtatagtgcatgatcacgcctgtgaatagccactgcactttcaccggggcagcttagtgagacccccatccctcaaaatacgtgtgtaggcgtgtgtgtgtgtgtgtgtgttaagggacagtattttcagaaacttatttcagagggtactttgagaaactacttttgatagcaatgtagtgggcagattggagcagttagatccagttggatcaactaagatccaatctgatcttcgttggattaaaataggattttatttttgagaatgggggatatccaagcatgaccagagggtaaagggaaggaacccctgggttttctgagtgcaggatcacgaccagatggtaagggaggaggagatgaacagcacatctcattgggggcctggtcagcactggtattggaacctctcagtaaagtacctgctgaagagagatgccctggaggagccggcctaggctgtggattctgggcctttaaggctgctgttaaaatcactaactgtggggtttcagctaggtggggaaaccagaaagaaaaaacaggaggggctaatgatagaccccttgcatgctccagaacatctaacatgttgttcaagtggtataattgacatattgatgatcagacagaaaatgcagagcactgaacgttcgtctcttaggaccctaattacctcctttgtaaaacaacccttcagattctgttcagcactagcagcctgtgaatctgtcagtggagaaacatagggactttagaaa

SEQ ID NO: 1190 - DNA, 1062 bp, Homo sapiens
cagtatcatgaatttaaaatatgggataggaggagagccctatggcatggcattcttcttcttattttctttataatgttaccacctcagttatttagtttgttggctaatgacagattagggagccacagggtgggaggtttcttagaagaggggtggactgatcataccctgagtttattatctgatgccacaggagaaaacagaaaagatgtaaaaaggcaccaagggagacgtgacactgtgcatttgtcaaaacccataaaactttacagcacatatattgaacattaatgtatccagatttttaaaagccatttaggaggttggaggatcccaggatgaaattcagactatgacaaaagaatccaactgtattacaaagtacagaataaactcactgaagaaagtgaatgaaaaagggttaccgacttaaataacttaggaactatatgcaagcactatactctattcgataaagttgtttcccatgaggatataagttaatgattctgaaactattatatatgtacactggaattgaataataagtaaatggatagtggatgatgagggccttggtttctcactttggaatggaaagttatagataagcaaggagggaaatgatccatgtggtaatggatttgaattggagataccgatatgaattcatgtttagcttgatatagatacaaaatacaaagaaatatttatagatatgtgtatatacacaagttagtacgcacacaatttcttcgctgtgtcacctgagagagcctaaaagcagcaatatcccagcagcaacaagcatatctggcatccagatcttggtttctaataccattatcctgtgaaagccaccaggtctcctggccgaatgacagattccagattctagagcgggggcagggaatgtgcaagatgaacttggagcatcttgtagtgctggaaagtaaggaagagcttaacaaacccacaatgacgaaggtttatcagagggacacaggagttactgaaatagctcacagtggccaaagatgaaataatttgagcaacaaa

SEQ ID NO: 1191 - DNA, 1065 bp, Homo sapiens
ttgaagttaaataaattgattgcttaatgtgcacggggcactgtgctaagtgtggacatgtatgggctcactaaatccccaccacaacctctgaggtgagtgctgttgtttcccacttattgagaaagagggaaacagagatgttaggtaacacacctgacatcacacagctaataaatggcagagccaggattcttcgctctggcagtgtgactcctgtgtctcttctcttcatcattgcactgtatgttctctgagggtagagttgtgggtgtgctggagacagcatggggaaagtagtagcactctccatttgagttgttggactgattttgagtttctttctttcacagtgaaagttgtttgaattgttaatgagaggaaattttagaaaatgcttcacctttaatatattaggttatatctcttctctgtaacggcatcttttcaattctcttcatcactttttttgtttacctagtatgtgatcaaaattaaagttgtctgctgtggctgccttttcaatgaggtacacagtatcacattgccacatgtaatttccactcaggtgacactgttctcactgctgagagaaatggcaggattagcagaaagggtggtattagatattttatctcccttaatctacaagcaaacatggttacacatattggaatatgtcttttcaggattctggtggactcggttggtttattttaaggatgagagtttcctccagaaggttaagcattattacatctgctgctttaccacacctacttttggggtgtttgctgatgttcataactagcaataactgtgattcataaaaaggaatctcttatttttatgaacatttcaatctggtgtcttgagttgagcccagaaactttatagctggctctgagtttatttctcccaaaacataaatgtatttttgagatcctcttaatacctctggtatctgatattcacacatcattttatttaatgattctagaggcttggaaggctgctaaaagtcattgttttcgcctttgagaataattaccatcctggaatccc

SEQ ID NO: 1192 - DNA, 1066 bp, Homo sapiens
tactaaaaatacaaaaacttagccaagcgtggtggcgggcgcctgtagtcccagctacttaggaggctgaggcaagagaatggcatgaacccaggaggcggagcttgcagtgagccgagatcatgccactgcacttcagtctgggcaacagagcaagactccgtctcaaaaaaaaaaaaaaaaaagaattcagtaaatataccaaatcccctcactgagtaagaatcttggctctaatttaagtcccttagcccctcctttcatgttcttaaaatcatagctaaggtactattcttcttatagtgggtgatcagtacatattttgtacttacgaaccagtaggcctaagtgagttgtttattcttttaagaattatggttacactttaatgaattcagaataaaaaataaatcttcacagcctaaatttagtgaagagattataccgaatatttggtctgactttgttaacaactttttgaaggtaagatttaaaaactttgagactatgacacttactggaggactgttccagcacactggatgttgtagaagtctggaattctcatctccattctgccatttccttgtaacaagtttcttggctataaaataaagttgatattatttgtttgtctcatagtagtttgtgaggatcagattagttggaatccatggaattgtcttttaaaaagtgagattatgataaagaccttaggtaatattgttattaaatgacagttgggttgttgtttcattttttaagactttactccttgtgcccttaggcagcctttgactaccagcattttgtcaccttcactttaagggttccttctagtgattttttttaatttgtagaagcaaatttaatttaatttgagttaatctctagtttaaaataagctgagggggcaggtatgggcttcatagtgtcagtcagatctgggtttgaatcctggtccaccttgtattagctgtgtgatctcggtcgaattactcaaactttcaaaacctgttttctctcagtaaaactgaagcagtaataccactgctcaggatggata

SEQ ID NO: 1193 - DNA, 1032 bp, Homo sapiens
ggggttgcctcttttggcttctaggccaacattctcttcatagttcttgtcctctgacccacccttcttcctctcctctgctgaatgcttttcttctcccagttccctaaatgctagtgatcccctggattctgccattggccttttttctctgtgtatgctctccttggattatctcatcctgcatatgtggattagtcacaaatctgtaaatcccagatctttctcttaggattcaggacaaccaactactagataccttgacttaaatttattatgccactaccagctattccaactgaaaaattgaattgagtggaaatcatgttgactatagagtagttttctccttcatctccctgcctccagtctttcctcccttcaatcttgcttctacattcctggtagaattctttttaaaacggaatggtgacctcattgcctcacttgttaaaacccttcaggggttccttactgtccctttgtaattaggatcttacaatattgaactttccctgagttgtaccctggaaaatctccccatccttcaattttccaaccctcaccccccacccccaccctttggtgttctgggaaaccacaaaggactatcttgttctccaatattctgagattagacccatctctgtccttcctgactcccagatgacttccttgtttacctgcctctatagaactccagaccctttccttttctttgagacagccctcattagtgttttattccagtagcttgaagaaaatcacctccttaattgtctggtgcattttggctctcacaagtcttaccctgttaatttgttacagttatcattctatcatgttatgtttgtttataatataatctctacattgtattatttataataaattacaatatattgttcataaattgttagtataaaatactattttatgtttatacttccactttaagtccttagtgtttataaaatacttgtatttataaacaaggatgaattataaaataagtctgtccaaatctatttc

SEQ ID NO: 1194 - DNA, 1037 bp, Homo sapiens
gggtcgcacagcaccaggtgagcagtgggagagtgagcaaagcttcatctgtatttacagccactccccattgttgacattactgccttagctctgcctcttgtcagatcagcagcagcattagattctcgtaggagtgtgaaccctattgtgaactgtgaattcaagggatctaggttctgctatccttgtgagaatctaatgtccgatgatttgtcactgtcttccatcactcccagatgggaccgtctagttgcaggaaaagctcagggatcgcgctgattccacattatggtgagttgtataattatttcattatatattacagtgtaataataacagaaataaagtgcataacaaatgtgatgcacttgagttagcccgaaaccatccccctcccccgtccatggaaaaattgtcttccatgaaaccagtccttggtgccaaaatggttggggactgctgaccttggtgatgggatcattcatacatcaagccttagcaactagtttacccatgttacaaacctgcacatgtacaccctgaacctaaaataagtcactagaggatcataatgtacttaatatactatattatataaatatgtgttaaatatgctttatacacatacacactcagtatatatgaaaagctacttttgttttcaaagtgcttgtgcatctttaattcagtcgatggttgaaatacccccctggtaggaagggcatatgtcattatccccatttttggtgggtaaaatggtataacagatgcattaattcaagtcctgtggctgacattgctggaaagtactggctttcttccttatggcctgggcactttcttaagcctatacttaacatccatgctttggtttccatactttggcttacccgtgagatgtgatatctgtacaggggtataccagaccactaactgggatagcattaaagttatttgtagtttctctaacgcatcatttatctcatgctatgcctttgcccttgctatttcttcagtcaaaattgttttccctc

SEQ ID NO: 1195 - DNA, 1053 bp, Homo sapiens
attgttgtgtaaatatcagagtgtacttacacaaagctagatggtgtgtgtgtgtatatgcatgtatgtatgtattcatatggaaaaccaaattcccaacatcattactgaatatcagtcctttcccctacttcaggagtccccgggccccaggctgcagactggtacctgtcgagagctgttaggaactgggcttcacggcagtaggtgagcggcgggagagtgagcattactgcctgagctccgttttgtgtcagatcagcagcagcattagattctcatagtagcatgaatcctatcatgaactgctcatgtgagggatctaggttgtgcacaccttgtgagaatctaatgcctgatgatccaaccaagatgaaacagtttcatcccaaaaccatctctccccccaacccccatttctggaaaaattgtcttctacaaaacttgtctgtggtgccaaaaaggttgaggaccgctgccctacttgatctgtaatgccagtgattagtgctctgtatcaggtttctatgtacttcattataaaatggagtctcactctgtcacccaggctggagtgcagtggtgtgatcttggctcactgcaacctcctcctcctgggttcaagcaatttttctgcctcagcctcccaagtagctgggattaaagcgtgaaccactatgcctggctaatttttgtatttttagtagagatggggtttcaccatattcgccaggctggtctcaaactccgcctcaaatgatccacccacctcggcctcccaaagtgctgggattataggcatgagccaccatctcgtatcttatgggaccaccatcatatatgcagtccattgttgaccaaaacaccattatgcagttcatgactctttttaaaaagtaaagaaaaatcctatttgaaagaactattacatgcaaaaaaatctattgttcctattactcatgcagatggccctttaaagccatggtccccaggtatgactgttacgttccttgccagaaataaacctgtgcaaggtgtactctctagtctctg

SEQ ID NO: 1196 - DNA, 1035 bp, Homo sapiens
tctggaacataagactatccaaagtttaacggtatttaatggtatacacagacctttcaattttggcttatacaaaataagagtcatcccactccttgacctccaaatttcagtcttaacctttaatgagtccacaacaaatgccatcctgctgtcataccctccttcaaggtccactaagtaaccactatggacttggtgcagtctgtcataatttcttacctagaatgcaattcttactcattctttccctcttcccttgcactaggagagaaaagctgtatattccccttttagtttattttctactacatttatattggataaaaagataggacctgaatgagaaaactttagttaggagcaggcatagggtttttctcatttactcttttcatttgcatctctagaataatgtcttttgtcttcttgttttctaggaatgtttacccttgcggaagttgcatcacttaatgacattcagccaacttaccgaatcctgaaaccatggtgggatgtgtttatggattacctagctgttgttatgttaatggtagccatctttgcaggaaccatgcaacttaccaaagatcaggtggtctgtttgccagtattgccatctcctgtaaattcaaaggcacatacaccaccaggaaatgccgaggtcaccaccaacatcccaaagatggaagcagccaccaaccaagaccaagatgggcggacaacaaacgacatttcctttgggacatctgctgtgacacctgacatacctctcagagccacatatcctcgcacagatttcgcacttccaaatcaggaggcaaagaaagagaagaaagatccaacaggtcgaaaaacaaacttggattttcagcaatatgtatttattaatcaaatgtgttaccatctggcccttccgtggtattctaagtactttccatacctagctcttatacatactattattctcatggtcagtagcaacttttggttcaaatatcccaaaacatgctcaaaagtagaacattttgtttc

SEQ ID NO: 1197 - DNA, 1853 bp, Homo sapiens
ttgaaaaactcaggcagcacatttcacgcaacgcccaggacaagcaggagttgcatctgttcatgctgtcgggggtgcccgatgctgtctttgacctcacagacctggatgtgctaaagcttgaactaattccagaagctaaaattcctgctaagatttctcaaatgactaacctccaagagctccacctctgccactgccctgcaaaagttgaacagactgcttttagctttcttcgcgatcacttgagatgccttcacgtgaagttcactgatgtggctgaaattcctgcctgggtgtatttgctcaaaaaccttcgagagttgtacttaataggcaatttgaactctgaaaacaataagatgataggacttgaatctctccgagagttgcggcaccttaagattctccacgtgaagagcaatttgaccaaagttccctccaacattacagatgtggctccacatcttacaaagttagtcattcataatgacggcactaaactcttggtactgaacagccttaagaaaatgatgaatgtcgctgagctggaactccagaactgtgagctagagagaatcccacatgctattttcagcctctctaatttacaggaactggatttaaagtccaataacattcgcacaattgaggaaatcatcagtttccagcatttaaaacgactgacttgtttaaaattatggcataacaaaattgttactattcctccctctattacccatgtcaaaaacttggagtcactttatttctctaacaacaagctcgaatccttaccagtggcagtatttagtttacagaaactcagatgcttagatgtgagctacaacaacatttcaatgattccaatagaaataggattgcttcagaacctgcagcatttgcatatcactgggaacaaagtggacattctgccaaaacaattgtttaaatgcataaagttgaggactttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagatcacctttttgataccctgccactcgaagtcaaagaggcattgaatcaagacataaatattccctttgcaaatgggatttaaactaagataatatatgcacagtgatgtgcaggaacaacttcctagattgcaagtgctcacgtacaagttattacaagataatgcattttaggagtagatacatcttttaaaataaaacagagaggatgcatagaaggctgatagaagacataactgaatgttcaatgtttgtagggttttaagtcattcatttccaaatcatttttttttttcttttggggaaagggaaggaaaaattataatcactaatcttggttctttttaaattgtttgtaacttggatgctgccgctactgaatgtttacaaattgcttgcctgctaaagtaaatgattaaattgacattttcttactatatcaccttttttgaggggtcttaatttactttgcttaattggtgcaatattgctttaactccgttcactaaagacaaacacatcaagtccaaacttgtaaatttagatttgctgaaatactgatttatttcctgttttaatttaaagtgcctcaagtaagcacctctcacaacagttgactggtactgctgctcctgagcacctcgtgtcatagattttatactcttacagacttggaatgcagtagaggtatgtggatttttaggggttttgtttttttaagaataagt

SEQ ID NO: 1198 - DNA, 1032 bp, Homo sapiens
gatttaagttaatcagaattttggcacagcaagcatcaaatgtccttcacatttagacctgtacacagccttgtaagtgtttgacttacggattaaataaactgtattttagcaatacttttcagttgtctcagatactaattctttaaaccacttttacagggtcacaaagtaatattaatttggtcttcacttttgttttcaaaccttgcttggaattggtgtcaagataaagtggtatgtagtgacaacattagggagacatgggaaaggacttatgtgattaaactggatttaatcctgagtaaccaggcatgcttaagtaaaaccagttcactaagtaggctgtaaacttttaaccccaccaaaaaaatgatctttaaatgaggtgtgatctcagcatatgtcttactcgatgagcttttgatttttcataacatttcatgcaacaaagaattaaagctttcatatctaggtacagatttgtgaaaggggactggaatagccctcttgtagatacttttcagttactttgaaatagtaagttcagctcttaagagtagcacactctcgtggttttgtttgttttggttggactttaactcattttgatgtagatacctttaaactatgaatatttgggctgggcacgatggctcacacctgtaatctcagcactttgggaggcggaggcagaagaatcccttgaacccgggaggcgaaggttgcagtgagccgagatcgtgccattgcactctagcctgggcaacaagagccaaacttcgtctgaaaaaaaaaaaacaaaaaaccaacaacaaaacaaaaaactatgaatatttgaagtggccagagttgggagtgaaaataaaaaatatattattgtattttcatgctgtagtttgatgataatgccaacacccaaggtatagcagaggctaacaaagtggaggtggggcagtagaaacagttctttccactccccacccaaggcaataagggaatccatttctatggagaattgaaaaacaataa

SEQ ID NO: 1199 - DNA, 1050 bp, Homo sapiens
atgttattgaaaatattatttatgaagctttttcttaataattaaaaaaaatcttttctaatgtggggtgctatgtaaattagcaaagcagtctaactagaatggattttactgaaccagtctaacatttactttccaagaaacattcaggacatattcctttaattctaattttaaaggaagagcatattgcaataataaaaatatttttaaaattatgttcaggttatttattgacaggtactacttacaccaaagcacttgtgctctaggctagaagcattgtattaaagccatgaatactatacctttgactagtcgagattgtatttatattttcctgttactactgtataaagcttaaacctacttaaacaactacaagctttaaggttgaccatatttcaggagaaggggtgtctactttttgaggcacaaaggttcctgctgaatataagtaaaactagttagtagacatgtgaaacagtcatccttctgcataaattgaaggatccggattccttaatgatggactgaatgatgcttactttccttctttctgcttccagtgtaccactatggtttatagtaaagaaaaattaagaaagtgaacagttgcaactattttgcttatgtgatagatgttttgaaaaatgtagttggaaataggaataatttttatatggttactaggattcagaagtaaatctatttagtgatctgtaaataattgaagtaatgtaacacttaatgttttaatatgtcagttattgcccttttatattgtgaatgtaatgtgcataagctatatccgtagatgttattgttttatctcatgtgtaattgtgggcctttataaaattgtgttgtaagatatcaagcaacttttgtaatccatgctttgggtttgtgagaaggaagatgatttatttcttctgttaactctcttaaaacctcgaggagactgtgtgctcccttttttagggtagttttatgtgataatttcctgaaggaaataattttgcaaataattgaatatattataagatg

SEQ ID NO: 1200 - DNA, 1049 bp, Homo sapiens
atttttataaccagagataattccccaaattttgactcctacagacacaatgaagcagtttgtgatatagattattgggagtgcaaaaggatctctctgtgtcacaaataacctacatctaagtagacttcaatttgtgtccctattgaaagccaaaatattgtaaatgttttgtaatttttaatattagggatagattcaaaaaagtttgaatagtttgtgaactttagcaaatgaccttttccaagactagggctgggcttaaataatgacagacaaatcttttcttcttcataaaatagaaaagctgctaagaagcagattttaaagctaagttttactaaactcaattcatatttataatctgactcagatagctttctatctggtctcacgttgaactgcccagccctaatcaaatgtgaacaaaagtagaactgtgcaaaccagtatggtataaatgaattttagttgataaatgtcatctgataatttgtcttttgaattgtctaacattagtaagcttacttttgttttttccctcactgtgcaacttttccaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggagtaagtacaacagaatcttttcagattcttttcactagtcactcttttaaaccctttcaagaccatcgttttcaactagaa

SEQ ID NO: 1201 - DNA, 1200 bp, Homo sapiens
actgatacattacagttccactatacttcatgatcataggttaattgaaaatagttgggatgataggctttgggttttgaattgaaaatccattctagtttgaaaatttggaaaacacttaatattttccatgctgtatattattttagacaaagtgtgttttcttaatgaggcttcaaaagtaaatttcgttttcataataaacaagtattcctgtactttgtatttaccattctagtctgaatggacttttctttctttcctcctgttagtgaagtagatgagccaataggacctacattttaaatcttcacttgtacaattccccttgggtccttctcttcagattactcctccatctttatcttctaaaagtaagattagcagaataaatttctgtggacatgtggcctcttggtgtagtagatttggataatgacaagagaagaggaagggacacaaagagtcgtttggttgcatgactcttcatctgtaaacttttgtttcttgggcttctgggtcagaaaatgtttctctaggtaagaatgtgaatggaacgtcagatgcaattctttatctgaagtgtgtcttggaagttgatgcatggttatgctttaactctcctatttcatactaatgttccatctcgccttctcattccctttttcaacagggagaatactaaatgatttctggatcttttttacttcaaactacaaatatggtcttctttgtgtatcttagttttagtaaaataaagatttcttttagggtcttttcatgggaaaacatcaattaggaactctgaagaggagttgtcagagagttgtacaagtggtaacatttggacaggcacatatgttgtctataatctcaagtaattttgaaatgtaaaagtaaaaacatagttagcaaatattcattatttgttctactggaaataaaaatactaattcaatggatttgagtttatgtaataatttacagagtttttcaatgtgttttttcagaatggacatgtaaaatttagttacattccagggaattttcaggtgaaaattagtagatagttaacatgaaaattttatatgaattcatattttttcttggacaatatgctaatatttattgatttcacaaatttacagcatatgggtgattttggaagcattcatagacccggaattgttgttgactatc

SEQ ID NO: 1202 - DNA, 1043 bp, Homo sapiens
aggagatgaggaggatgaagagaagattgatgaacctattgaagaagaggaggatgaagatgaggaagaagaagcagaggaagtgggggaagtagaggaagtggaagaagtagaggaagtgagagaaggaggaatagagggcgagggaaatatacagggagtaggggaaggaggggaagtaggggtagtgggagaagtagagggagtgggggaagtagaggaagtagaggaattagaggaagagacagcaaaggaagaacctgctgacttccctgttgagcaacctgaagaaaattaaatataaggtattagatttaaaaggagctttacatttcggttctaatgtaaaaaagggtaagaaatttaatagcttaaaatatgaattaacacccatgttgcatgcattccacatattaaaatttgttttatataatttctaaatgtttaacatttgtttaataaaatgaaggcaaaactattttagtttagtttttatagctaccagacttagatccgataaattgtttgtataatttttaagcttaatttttattactttattggtgttaaggataacaaatgtgtattgttagtatatctattctaatcattttatcttaaatgctgctcttgggagtgaatattcaagtgtgcatcaattttttgaatacttaccctggaagatataaactgggcaagtattttgtgctctgtgtatttttttactgcattagacattgaatagtaatttgcgttaagatacgcttaaaggctctttgtgaccatgtttccctttgtagcaataaaatgttttttacgaaaactttctccctggattagcagtttaaatgaaacagagttcatcaatgaaatgagtatttaaaataaaaatttgccttaatgtatcagttcagctcacaagtattttaagatgattgagaagacttgaattaaagaaaaaaaaattctcaatcatatttttaaaatataagactaaaattgtttttaaaacacatttcaaatagaagtgagtttgaactgac

SEQ ID NO: 1203 - DNA, 1071 bp, Homo sapiens
tcccacagataatttatctttttgtgtaaaataaggcttttaaaactagactttctgaaccaatacagttttttttttttgaggtgaactaggtttgcctagctttaagctagcaatatctgatagatacttgcatctaattttagggatttggtgccaaataagagaagggtagttgaagactagataaatttggatactatctaggagtctgtatttacttagcaggcttttgaaagccgttttgcttaggagttcaaattttaaggataataggacttgttaccctcttatttctcctttatttttaaaaatatttgtggaagggctaaggtaaaagaataataaattcctctaggttattagtatttggttcttctgatactaagctgagtgattttttttaaaacaatgtctctggtagtctgattgagatatgaaacttttgggaagaaaaccattatgtaacaagaatcctatgtaacaactgggtaaatgttttagaatgagagataggaaagaacatctaaatagtacttttttgtgggacgcatgagcctttatacagcctagctaatttgcaaggtaatgataaataaaagtgtattttgttactgtgcttaattcagaaattcaaattcatgtatttcctattggataatttgtaggcgggcagtttactttatagtcaggttagtttttgtgatccttagtgtttatatttgcattgcttttgtaataaggatgtatataagatcttaaacgcctttcaacttctgttttcaagtatcacttgttttctctattacaaagtgagatacatagttctaaataaccaaagaaatttatttataacctacacagttgtttcagctccatgcctagggactatcctgtattattcgctttttatcactttctacctacagtctaccaaaaagtctgtctgttctacttccaaaatttatctgccgactcttctacctccactgcaaccaacccagttcaagtcatgataatttcttgttaactaatcttgattccacccttaccatgatagattcagttttc

SEQ ID NO: 1204 - DNA, 1029 bp, Homo sapiens
aaaagttaatcagttacttttgcttgggaagtgagtaatgaccctgaagctcatctatctagtaacatttaacacatgtattaatttattcaaatatgtattaaaacacatgcagtgtattctgctagatattatgtatgagaggggcataaaatgaatgaaatacacataaatgtaaaatttcatactgcatttatgaaattttcagtctggaaggaaaagtaagacttgcacagaaagagaatacaaattggaaagtggcagatattagactgttagatccacgaggatagggattatgtctgttttggtttgccccaattttgcccttaccaggcatattcctgtacacagcagaaattgagcacatatttgttcatttgaacaaaagaaaggaacagatagaatgtgattagacttcagagaaggaaagatatattccaatggaaggaattaggcaaggctttgcaatggaagtggtatttaacctaggacttgaatgatgcaaatgatttggagctaaagaactgaagatgatgggagtggtagaagaacagcattcacggaagaagtatcagcaggagcaaggcacagaagaaaatcatgcactgtctctagggaacaatatgtgccttatatgcaggtcacttgaatgcagtagaagaatcagtgggtggcaggtcatggagagccttggatgctagcctagagggtttggatttttgtctgaggcatgagggagacaatggggtgaaatgagcagagctgtacttcaggaggatgaacctgccagcaattttaagatgtattggaatgaagacaagctggtatgaggtggagagtgcagttagaaggctagtgtaacattccagacagaaaaggtgacgccccaaggaaggcctaaacatgggtagctggagaggaggcaacaggtttaaaagatgtgcatagaagaaggcagtacctgccattcatttgaagcaggaggtcagtgagatggaaaaatatcaaagatggaatacgattttt

SEQ ID NO: 1205 - DNA, 1134 bp, Homo sapiens
gaccctcggagccaggtgagggatataatctcgtggtgcgccgttttttaagcccgtcggaaaagcgcagtattcgggtgggagtgacccgattctccaggtgcggtccgtcacccctttctttgattaggaaagggaactccctgaccccttgcacttcccgagtgaggcaatgcttcgccctgcttcggctcgtgcacgatgcgcgcacacactgtcctgtgcccactgtctggcactccctagtgagatgaacccggtacctcagatggaaatgcagaaatcacccgtcttctgcgttgctcaggctgggagctgtagactggagctgttcctattcggccatcttggctcctgccactcaactatattattttattatttaagggcaatgttttgagtagtccatacgctctatcagactatcaaaggggtccatggcactaaaacaaggttcagaaattctgagaaagaggaagtgatctgtaggtcagatactaacgaaaggtcaagtgagatgaggactgcaaaggagacatcagatttggctgccattacaataattatgttagagagtccctattttaggggtgaaggtggaggcaaaatctggattagagtgagatgagaagtgaatccaatagagggcatgcaaataaggaagtcaactatttatttggcagtaaagggaaataactggtagacaaagggagtaacaggatcaagaagaaaatgaagaaaaaaatgaatgtacttataagcagaaggcaagaatctggtggaaagggaggggttgagaggagaggagagaggatgatggaggacatgaggtcttagacaacacaggatggaagaaaatggagaacttggagggattcgtctcagaccagggttgatgggcacaatgggctcaaatttagataaattagaggaaaaaggaaaaggacatgaaggactttcaacttttgctggcttctcccccctctccaacccccatctcccaaaaatgttgagggcagggatgatttatgggctttgtgcttaagagtatgaaggtgtataaaagctggtgtggagtatggtaaggttgctgagtagagatgaggaaaggactgcagagcaggtctaggggat

SEQ ID NO: 1206 - DNA, 1025 bp, Homo sapiens
cagtccccttgtgggtgaaggtctgagtcactcttagatgactcctaggttgctgggaggcaccctagaccagctgaggtgttggtaaagggtgaggcaaaactagaataggggtggaagatgaaggtgacaaatattaattatggcattgagatcagttgtagcagtgaggactggacctcattacattaaccttcctttatgaagtcttgaaggctctgtgaagaaaaataaagcagagtagggagacggagaatagcaggattgggtgactatttaaaaagaatggtcaaggaagctttctccgattaggtgacatttgagcagaaacctaaatgaagtaaaggagcaagccatatgagtacataggacaagagcattccagagagagaaagtagcagtccagatgttctgaagtgagagcatgctcggtgtgtttgaggagggtagtgtggctggaagggggcgagcaaaggagggaagcaggaagagaagtgatcaggaaggtaacggggctcaaaccatgatgggctttgcaggtagaatgaggactttgggtcccattttgtgtgaggtagggagccatcagtggattctgagatgatatgatttattttacattatatagagtcctctgctgctctgtggattggctatatgaagtcaaggaggggtgcggggagatcagttaggccactactgtggtagcgtgtttagatctcatttcagatgggtttctgggtgcatagggtaaaggcatggggttgctggacatcaggtcttgaattaagagtggtattactgttcttcagggttgactttaagctactcctgagtaaaaactaactcttctacttcttataaatctttcctaatacacagcacagccctatgtgtgtagtggtgaatgcgcagaaaatgcctgtgattttctcatttgaacatctacttagtctttgcgaagaatccatagaaacaatctgtctacattacaacacataagtgacatgtggtttccaagatca

SEQ ID NO: 1207 - DNA, 1065 bp, Homo sapiens
tttctcattctgctgcttccccagtcacaactataattacctcgtttgaattattatagtaacttcaaaactggtgccatttttgttttaaaagaaaactttaacacgagaacacaagtcacttgtgtttatattatgtgatgatgatttaagtcagttttctagcaatatgtatgcattgctaaaattgcggtttttaaaattaggcataaagtttcagtccctctgacctttcttctaaaagttccttgtgcatttttccactagggggcaagataatgtcatgggagttaaatactgctttaggaagaatgatcatgtagttattgctatgccatatctggagcatgagtcgtttttggtaggttttaatatttcttgaatttttattagctaaatatttaattgcaaacaatatttgtaactcatttcatttgtaactttgttttaggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtaagtatgaagagttactagaaaatatttatcctatttcttttaaaaaacaattttattgtctatatttaaggtattgaacatgatgttatatatagtacaaaagttactattgtgaagcaaatatttatctcagttacccatcttatttttgtttttacggcaagagcagctaaaatttactcatttagtatgaatctcatatacagtacagttttattacctgtaatcttcagagtgtgcattaggtctagatttatttatcctacatatctgctactttgtatcctctgacttatatctcttagatataatataacatactgcaatagccatgcacagattatttctgtttcagtttctttgtgattggaaagggaaatttggtgatgaagaagataaaattgtattagtggaataatgtacattattagatgtactatggttcagtggaaatagcatgaactaaca

SEQ ID NO: 1208 - DNA, 1059 bp, Homo sapiens
ctgaggcaggagaattgaacccgggaggcagaggttacagtgagccaagatcgcaccattgcactccagcctgagcaacagagtgagactcagtctcaaaaaaaaaaaaaaaaaaaaaaaggtgatacagtagcccaaggaacagagagcagataacctggtgatactaggaagtcaacaattaagagagatgtcaactttaagaaaaaaaaaaaagagctttttaacatcaagttgagctagtcgtaatctttaactaccagaattcagaagattaaagtttctatagtgggaatgtaaattagtacaaccactatggaaaacaatttggacgttcctcaaaaaactaaaaatagagctactacatgatccaacaatcccactgctgggtatatacccaaaagaaaggaaatcaatgtaccgaagaggtatctgcactcccatgtttgttgaagcactattcataatagccaaaatttgaaagcgacctaagtgtccgtcaacagatgaatggataaagaaaatgtggtacttacacacaatggaagtactattcagccacgaaaaagaagatcttgtcatttgcaacaacatggatggaactggagatcattatgtcaggtgaaataagccaggcaccgaaagacaagagttgcatgttctcactaatttgtgggatctaaaaattaaaacaattgaacccatagagagcagaaagatggttaccagaggctgagaagggtggtgggagggtgtgggggatgtggggacagctgatgggtacaaaaaatagttataaagaatgaattatccagcactttgggaggccaaggcaggtggattgcttgagctcaggcactcgagaccagcttgggcaacatggtagaaccctatttctaccaaaaatacaaaaaagtagctggatgtggtagtgtgcatctgtggtcccagctactcaggaggctgaggtgggaggatcacttgagcctgggaggcggaggttgcagtgagccgagatcacactaccacactctagcctgggtaacagagccagacccc

SEQ ID NO: 1209 - DNA, 1050 bp, Homo sapiens
caaatttgatgggaagaggttccagaatgttgtcaaggaaggaatgaagtttgataaaagtgagaaaactaaggagagtcatgaagcagttgagaaagaatttgagcctctgctcaattggatgaaagataaagcccttaaggacaaaattgagaaggctgtggtgtctcagcacctgacagaatctctgtgtgctttggtggccagccagtacggacggtctggcaacacggagagaatcatgaaagcacaagcataccaaacgagcaaggacagctctgcaaattactatgcaagtcagaagaaaacatttgaaattaatcccagacacccactgatcagagacatgctttgatgaattaaggaaggtgaagatgataaaatagttttggttcttgctgtagttttgtgtgaaacagcaacgcttcggtcaggatatcttttaccagacactaaagcatatggagatagaatagaaagaatccttcgctcagtttgaacattgaccctgatgcaaaggtggaagaagaacccaaagaagaacttgaagacacaacagaagacacagagcaagatgaagacaaagaaacggatgtaggaacagatgaagaagaacaagaaacagcaaaggaatctacagctgaaaacgataaattgtaaattatactctcactgtttggatcctgtgtggagagcgaatgtggaatttaagtcatttcttttgggagagacttgttttggatgctccccacagtccccttctcccctgcactgtaaaatttgggattatgggtcacaggaagaagtgggttttttagttgaatttctttaacactcctcatgtatgttaaatttgtactattaaactgaccattcttgatgtaaaaccttgtcatgtgtataaaaaaaaaagattcccctcctaaaaaaaaattacagcgtgaaatcgcaaggggcttcaagatagtttaaaatcctctccactatttaccccatctttaaaaaatgcttcagactgtgggaaaactaaagtggctctctgtaattcct

SEQ ID NO: 1210 - DNA, 1045 bp, Homo sapiens
cattaaccatacaaagagtatataaagacttatgtatgtgcagtgcaaaaagtagcttgtttcctttttgaaaagtattggatcaaaagtaacagcattagaaaacagaaatttggccggatgtggtggcttatgccggtgatcccagcactttgggaggctgaggtgggagtgttgcttgaggccaggagctcgagaccagtttgagcaacatagtgagaccttgtctctacaattaaaaagaaataaatatttttattcaaaaaattttttaaatatatttaaatttaagtggcaaaatagtgagttaggttagtattgtattttaaaacatggaatgttggacatgaagcttttaagtagattaagtttctctttcaaattttaggaaagctgaactagaagcagctgtgagaaagaagattgaatttgagagaaaagctctacatattgttgaacagcttttagaggagaatattacagaagagttcctaatggagtgtgtatgtgttaagttgacaaattattagttttgtagtataacatctttaaatctgtgcagcatgaaacttctttgcattattagaatctttgaatttgttctgagtcattagatgcagataacaatccatataattcatgcatttaaaaataaacaactatcatgcattccttgtataatgactttaaaatgcactaatgaaaaataagtacgtaacaaggtgatgacacgtaatgtatatttcaaaattaataagagtggatttcaaatgttctcaccacaaagaaatgataaatatgtgaggtgatagatatgttaattagcctgatttgctcaatgtatacatgtgttaaaacatcacatactaccccacaaatatatacaattattattgtcaattaaaaagcaaaagaggccaggcacaatggctcatgtaatcccagcactttgggaggctaaggcaggcggatcacttgaggtcaggagttcgagaccagcctggccaacatggtgaaacctcgtttctactaaaaatacaaaatt

SEQ ID NO: 1211 - DNA, 1060 bp, Homo sapiens
ataattttaaacaaaagaagtggctaggtacggtggctcacacctataattccagcactttgggaggccagggagagaagatagagaccagcctgggcaacaaatagagaccccatctctacaaaaaaataaaatagccaggtgtggtggcacgcctgtagtccaagctactcaggaggctgaaaccagaggattacttgagcccaggagtttgaggctacagtgagtgagaccctgtccctaaaaaaaataaaatttaataagtgaatgaagtaagataagaatgtataacaatattattccattcaaaaaaatgtttaaaaataggcaaaactgaatattttttaatagggatatgtacacaggtgctaaaactgaaaggaaatgagggaatgattaacaccaaatttatggtagtggttacttctggggaatgcggagggtgatgcagttgggaaggggcacatagaggccttcaaaggttcagtatcttatttcttaccttgggtggtagatctgtaggtttccattttattctttgaacgatacatttatgttttatactctcaactgtatgtaggtaatgtttcatgataagaaaaaaactagatttataatgttcttttcagtctttttgcagcaatttttgttatcaagcatctaagttttttgaagcacaaattcccaaaactccagtatgggttcgagaagaagagaggtaatttaagtcattgtgtatatacatttgttcatatattctaataatttgtttctgctttttgagattagctgagagtaagtctagttttctgtaaaaagttaccattttatatactttatggggaaatggttatattttaagcatagctattaaggattttacacttaaaatcagaaaatgcatacatacaaatgttatttgtttgttgttttagctttaattgcaaaatcagaactttaactccagtgtcctgtgatgctagttatgtctgtgaatcctgttaatataataatcctggaggaagaatgttaaattttttcagaagttactgggtcttag

SEQ ID NO: 1212 - DNA, 1031 bp, Homo sapiens
atttgcaaagcgcagtaaaggaaagcacagttaaacaaggtatgcttgtgtaaatttatttaccagattttataataccaaaaccaaacaatatcccttagaatttataagagtaatatctttatatcacagtaagctcactacctcattggtatagatgtttaaataaatttaagatttagacaaattcataaattctacctccatacttttataaggttttggagtcagaaagggccttggaggttttctagctcctcatctttaaggtatgtaaaatatctggagtagatccgtaatgtcatggagactaacagtggttctcacaaaatgtctcctgataccctgttagagacaaaacattgacctagaatggtctgggtcgtgacgcactgtgatgcttctcatcttgtgagttagaaatttttcacccacttggtggccagaaacagaccacatagagttttgatgctctgagacagtgtgctcacataggtaattatatagttgcagttataaatcctgtttggctaaatgtaggctctgacaagcctttgaaggtgggaagtctcctgcattgtaatctaaaatcttaaatctaagaaggacaaatgtggaaaatcaaattatgattttaaagatgaaattggggtgaatggttaatgctgacagagctaaaagcgccatcatctggtccagagtaggggatttcacacgttgcttcttggcagtaaacagtagaatctcagaggtgcggaagccaaaaacctctgcagaacaactataacctcttcctgaacagccacctctgttgcttggtatgcagaataaaagctttctgaaacagggtttgacatgtctcaaaatagatttgaaaagttctcaccatacctgctgcttctgttggtttacatataacatacatattccaagtgatatatatgcacatatatataaatatgtacatatatccactaagttctttggcataagttatttctagttttagatttactttgctaaaatgaaaa

SEQ ID NO: 1213 - DNA, 1059 bp, Homo sapiens
agttgaaaatgatgagggcagacttctttaataaaggcttacgatgaaatgagtaggggctgtatgatcaaaggattgtttgtttgttttttttaagagattgggtagatttaaacacgattacatgctttaaaaaagagaaaaaagggagaggtttgtagagtaaataccccagagtggagattcaagggattagcctcaaatgcctttatatacagactgtatccatctttataagcccagctgaaatgacacctctctgaaactccttttgattggctcagaagcaagtttttctctgatttcctgtagcagcttatacatctctcatggcatttaacacatattgtcttgaataacagtgtagttattatgagctttactgtctgggtttgattcctggcttcaccacctactagctgtgtgattttgggcaaattgcttattctctctgtactcagtttccttatctataacatggggataatattagtagctacatcgttgttatgaggatcaatatctgtaaagctcttagaacatgcatttttcttctactaaattttaaggtctggcaggcgcggtggctcacacctggtaatcccagcactgtggaaggctgaggtgggggcagtggggagcgaggggttgttactactccaatgtaactgctttctcagaaattaaggcaaaaagtcttactgaccatgtaaaggaaatccaacaattataaacagtctctgcctttaaggagcttatagtctagttaagaaaccagacttaaacatatgaaaagttaaacattggccaggcacagtggctcatgcctataatcccagcactttgggaggccaaggcaggaggatcacctgaagtcaggagttcaagaccagcctgaccaacatggagaaaccccatctctactaaaaatacaaaactagttgggcatggtggcacatgcctgtaatcccaactacttgagaggctgaggcaggagaatcacttgaacccgggaggcagaggttatggtgagctgtgatcacaccattgcactccagc

SEQ ID NO: 1214 - DNA, 1035 bp, Homo sapiens
tttatatttatatatatactttatatatatatttatatatatatatatatttgcaacaacaggcaaatccaaatagtgcagtaggatagcattatcaagttttttaaaaagttttgctgtactcctgtaacaattttaaaataattgggggaaaaagatgaaggaagaatacagaaggagaactatatcaaaaaatatattattaacagatgtactgaaattataggcttcttctgaaatttatatatcagaacctagaaataaggttttgtctggggaataaaaatttctaccttgaaagttacaatgtataaatactatggggtactttacttttctattgttttcgggttttatttgctattttttatttagttattttatttctctttcattctacagtggccattctggagaagaagtacagttatgcagtaaagccattaaaacatcagatatcgacaatcctagccactttgaaaagcaatatgaatctagttcttctagcactcacagtgatagtagcagtgacaatgagcaagactttgtttcctccattctaccaggaaacagaccaaattcaacaaatattagaccacagctgcaccaaaaaagcataatgaaaaagaaagctggtcacaaagctaactccaaacacaaagacaaagaacagacagtagtagatgtcactgagcagttaggcgattgcaaattagatagtcaggagaaagatgctacatgtgaacttcctttacagaaagtaaatactcagagttcttcaaatagcactttgcctgaaagattaaaagcgtcagaaaattctgaaagtgaatacagtaggtcagaaataactctagtaggcataagtaagaaaagtgcagagcattttaagagaaaatttgccaaatcaaaccaagtgtctaggtcagtgtctagttcagtgcaggtgtgtcctgaagttggaaagagaaacttacttaaagttttgaaggagactttgattgagtggaagacagaagaaacattgaggttttt

SEQ ID NO: 1215 - DNA, 1287 bp, Homo sapiens
tgtcttcagctaccggagtgggtagggaaggaccgtcatgggggcagggctatgtgcgtctgaactcaagactccttgggcagggcttgctgtggctgttgtgggggatgggagtgtggttcccaggtcagtggagctattccaggaagattatggctgcctctgctgtgtcatgcaggttgtcagggaagtgggggaaagctggtggcaggcctcacccagctcccatgcaacccaaaagaccagtttcactcccaccatgtcccttcaaacagcaccaagtttgtttacaggcagtgggcaggaagggctgagaacttgccccaggctaccagcctctcacctgtgagaacaagtagggctttcacatctcccagcctgtggagtctgcacaccagattcacaccctcccttgagttctggccaggagacttcctgttcatttggaattgttacaaagttcagctggcctatcatatggtctatctcggagactgttccatgtgctgatgaatagaatgtatatcctgctgttgttgggtagaatgttctgtaaatatctgttaaatccatttgttctagggtataatcaaaattatatcaaatattctctcagaccacagtggaattttttaatttctacttagatttcattgttgacctagtgatcattcaggaacaggtcttgatgacctgtctagtgctgtcagtggagtactgaagtcccccactattattgtgttgctttctatctcatttcctaggtctcgtagtaactgttttataaatttgggagctccaggtttagatgcatatttatttaggattgtcatattttcctattggactagtccttttatcattgtataatgtccctctttgtctttttaaactgctgttgctttaaagtttgttttgtctgatataagaatagctacttctcacttttggtgtccatttgcatggaatatgtttttccaccctttaccttaagtttatgtgaatccttatgtgtcaggtgagtcccttgaaaagcagatacttggttggtgaattcgtattaattttgccattctgtattttttaagtggagcatttaggccatttacattcaatgttagtattgagatgtgaggtactattctattcatcgtgctatttgttgcctgaacagctttttttttttcattgtcttattgttttataggtcctgtgagatttatgctttaaagagattctattttggtattatttccaggatttgtttcaagatttatcgctccttta

SEQ ID NO: 1216 - DNA, 1031 bp, Homo sapiens
gagagccaaactgcagtgattgttattgttcttgtggatctagccacccagcagagctaccaggcttctggcgggtactagggagtgtctgcaaagggtcctgtgatgtgatccgtcttcagctgtggataccagcacctgctccagtggaggtacaggggagtgaagtggactctgtgagggtccttaattgtattttttttaagtgcgctggttttgtgttggttggccttcagccaggaggtggtgctttcaagagtgcatcagctgcagtaggatagggaggatacaagcttgctctggggtcaggcagtgggtagggccatagagctcccaagagattaagtcctttgtcttcggctaccagggccagtagagaaagaccatcaggtgggggtaccattgtgtgattcccaggccaatggagttatgttcccaggtggattatggctgactctgctgcatcacacaggtcactagggaagtgggggaaagctggcaaccacaggcctcacccagcttccacacagcctgcagcctaaaaggccagactcactcccaccgtgcccccacaacagcaccaagtttatttccaggcagctgatgagcagggctgagaacttgccccaggctacaggcctcccagctgagaaagcaagctgactcacagttccttgccttttctggtatgtttctgcggtagttcttggagcaaaagttcatgatgggagtctccacatgccgctctgtctgaccaagtgggaactgcaagttagtcctgcctcctatctgctattttttcccagacctaacatttatttttaatattaaaccaactttgcattcttataataaactcaacttgattgagctataatagcctttttatataatactggatttggtcctcctaatatttgccttagaatttttgcacatattttcagaatgagtgacattagcgtatgaattggtcatggtctcatcataaatcacatggtacaaattaagtaatctgaggaaagtttaat

SEQ ID NO: 1217 - DNA, 1041 bp, Homo sapiens
atatttttattttctctaaatttcaaatatattgcaagattatttatagccaatactcagctggatttattcaattaattactctttcattgtttttcattccttcttctatccccattcttccatctgagatcatttgccttgtgcctgaagaatatacttctcttagtatcagttgataaagaattttctcagtttttctttgtcagaaaattattttactttcacttttgaaagatatttttctatattgaattttagatgagcagttattttctttcagcccattgaaaatatcattcccttgtcttttggcttacatttgtatctcttattgctactcctttgaaagtattgtgttttcttcctctagcttcttttaaggtttttttttgtaagttttggaatgttcccagttatctcttagatattgcttctattccattctgcctcttctctttagtctttttttttactgtatcttgtaggtctcttaatctcctttgtgctttacattatgtgtttggggagtggtgactgtgcttcattctggatattttcttattcagcattctctcttcagccatttctactatgcttttatgtctccccattagttcttacttttaaataccgtatttttctattctagggttttcattttgttattttatgtagtttccaattatctgtcaaaaattttcaacctcataatttttctttgaatatattaaacatgtattttaaataatgctgataacttcattatttagattccctgaggattgatctctgtaggctgtttcagatttttatcatattgtcgtgttttattatatgccaaacattgtatattaaaaattacagagataactggagactcaggatgatgttatcttcctctagaatagatttatatttgcttctgacatgatttgtagcagttccatgtcactgtaatgtaatcagagattaagatgatttcaaggtgggattcactccctgaaagaactagtctatttcctattcttactgttattc

SEQ ID NO: 1218 - DNA, 1344 bp, Homo sapiens
ctcgttagctctctgatgctaacaaatgtgtttcaaacaaatgtggattgttttcccccaacttttttcagttctcagagagagagtcggtttgaattatcttgtctgccatttctagaatggttaggggtcaaatgacataatgactgaactcctcataatatatttatagtatttgctaattttaatattttaatcccctacatttgtacagcacttagcagtttacaaaatctttttgtttacattttattatttaataaaggaggtattaatatcccaattataaagatgagaaaactgactctccaaagagggcaaatgactcaaagaagttcacaacagcctaacaactgagttgatactcaaatttaaatctaattctcaagtctagttattttcctactgtgccacagatacaaacttttgtgttttaatgtttattgttctgcttatcaaagaaagaatgtaaacttatgattctgttttgctttgtttaaaaatgtgattcagcatgattccacctttccactgatagactcaagttcccagaaccagattagaaaacgcatcgtacttgaaaagttgagtaaagtgtaagtatgtaattgccattccagctttgtagtagttttaaattaacttgacatttaagctcataatgtgtaagtattatcctcagattttgaacattttgaaaaataatgtgaaaagttcacatggatttcttcacttaagaaatttggatttttaagatattttatccaagaaatacaaatttttgtgtagaggacacagaggcacatcataaagaggaaggttgagattgtgggtttagaagaccaaactaccttactcccacctaatcagtgaagtcagggaaaaaatatcaaagctagacccatttaaatactgatttgcggtaaatgtgtcacagcagtttcagatgcaaataagatgttattacaaagttttaagggtctgttaagtcactctgcatgcatatccttagaaccatttcacactcagcaacatgagtttttgttcaactcaacgttgcactttagctttaaacttcccgtggtggaaattattgttcttgtaattagcccagtcataaatgacatttaaaaattgctatcttggtttttctttcaaaaagaacttgaaggtttttttttcccagaggtatgagggctgtgttgaacttttcaacctgcattttcttattttagcagaaaacatggaaaagtgtgtcagtcattatttaagggttgtgaatatgaagttttattttgtagcagtttgaaaatacagaaaacatttcacattaaccaaggcata

SEQ ID NO: 1219 - DNA, 1057 bp, Homo sapiens
aagtcccttctagttactttctgcattatttaaagacttgattatatgacatctgagatttgcttcaaaattatctagattagcagtagtgttgaatatggggttgtacagaagaaacatgattagctgggagttggtaactgtcaaagttgtgatgtgtatataggaatttattttatattctctctacttttatatatgtttgaaatttaataaaaagctttgggaaaataagcccaaaaaagtatgctttattttggtaggaggtgttataaaattctgttccaaaaaccttggtgttaattacttttgaaaatctttactccttagtaactgtaagtcaaagtctgtagctttgataaaaattgcttaaattggcttcactgtccttcagaaaagtgtcagttgcttagaatacagaatgacctctgataagacagctgatttgaagtcttcagattccagattctggacaacgttggcaggtctgtgacagtttgtaggctagggctgccaggtgaagcttctggaaaaatgccatattgatgacagtaactattgttgagaaatcttttcaatcaatactgatagtgggaaagagttgacataaataaccatatccttctctctgaagtgacaatcaataataggaacttgtagaacagtgattctcaagccagttgtgcatcagaattacctggggagcttttaacaactatagatgtccggctccaccctagagattgagtttcattcggctagggttgggctcagacattagtattttctaaaagccccccttagataattctaataggtagccagagttaagagcctattttgggacctaaacataaagcagctttttcggctctatgagaatttccccagtgaatagagctgtcttttccactgaattgcattacaaatctgctatctagaatgttacattggtttacctgtcgtagtgtaaagcagtttccatcagaatctgcttgataatgactcactgtcatcagtgttgaatcaagatatttttctaaatttgaattaaaat

SEQ ID NO: 1220 - DNA, 1051 bp, Homo sapiens
acatgggatgtgagagagtcaagtttaaccataagatttgtggcctgagcaactggattctggaaggatagggtaagccatttactgagataggagtgtcacaccatccttagttttgggggaaggatgaggagcccaattttggctctaccaaattttgagatgcctattagacatccaagtagaagtgtcaagtggacccttagatacagaaatctagaattcaaggaggaggtccagactagagctaatacatttgagagttgtcagcatatagtttctaatatttaaagtcgtaagattggataacatcaccaagggaaagagtgtttgtttatacaggagagaagagacctaaggccagaggccctgggacactccagtattaaaaggtccaaggagagtgctcatgagaggtgggggaaccaggcaagtgaaaacctggtaaagaaaatgtttcctggagaagggagtgattgtcaagtgctggacagattaagatgagggttgcgaaatgtccgttggatttggcagtatggctgtctcttgtacagttaatcctcacaagaaccctgtgaggtgggtgatattattgtccttattttaccaaagtaagtttcacagccatcaaacaacgtgtccaaaataaaacactactgaggacagatctggatattaaacccatatctttcagactctaaccattatatactgtacttcctatcatctaggcttttttaaattttggaaaatgatggggaaaattcagattaatgtaacaaaatatatcctccactcagaattaatagattttaatattttctaaaatttgattcaggtatatattttaaagaaaacattataattaatttattcaaaaagtattaattgaatgcctactgacggccagccacttgttctgtaaacttggaatagtgaagtacacaaagactcttgccctctgacaagaaaaaacagaaacaacaattatatattagaaggcaataagtggtatggaaaaaaaagaaaaacatatagcagaataaggagg

SEQ ID NO: 1221 - DNA, 1054 bp, Homo sapiens
gcactgcagcccaggcaacatagcaagaccccgtttctttaaaaaaaaaaaaaaaaaaaaaagagagagagagaagaaagaaagagaggaaggaaggaagggagggagggagggacagagggagggagggaaagaggggaggggaggaattgcttggttaggggaaagcatagagaatattatgagtatgtttgttggggatatgtgtgttttaatcaagcaatttagtttcccacattgttcctacatgcttatcttgtctagtagtaatattattaaaaacatataaaagtggggctggaacacttccttttgagatggccattatcagatagtgactattgagccacattattatactattgactctttcctgtcaaatataacaagtattttaaaaaaaagtgcttctttggcacattattataaatctgatgttatctagaaagaaatagaaagtttatttaaaggtaacactccttggataaattttatctatctttcaggttaacaaatagaaatattatacacaaacctgcggaatggactttaattgctatggtgttgctgtcattgtaagtactctctcagattttaactctaaatactaaatgtgaagcatattgattagggaaaaacaaagtgatccactgattttgtaaactgccttggaaaatatcatacctctattttgtgccttattttcctttcctatgtaagaaaacaatttttatttaaagtgatatgtaattattctctatattttttaccatcttttcttctgaataccttattctttacaaatactatttgttttcatctcttttttgttttttttttttgagacagggtctcgctctgttgcccatgctggagtgcattggtgtgatgtcagctcactgccacctctgcctcccaggctcaagcaattctcccacctcagcctctctagtggctgggactatagtcacacaccaccatgcctggctaatttttgtattttttgtagagacagtgtcttgctatattgcccaggctggtcttgaacttctgg

SEQ ID NO: 1222 - DNA, 1076 bp, Homo sapiens
taagacttctgtctcctgccccatattattttcttatttcctcttttctcagaaattcccctttagcttttcatatttctgcccccactggaaatctgtggctcaactgatagactttttttatctccaactttgtccatttgtcacctttttatagcaaatactactgtacaagttagggataaaattaaaatacatattcatcatgttaaaactccattgacttctataaagtataattatactttaatgtgtatttccacccctcttctcccccttacagttttcacaattacattttagagaaggcattttgtcactggggaaagcaaaaacaggcatgaaggccagcattggataaatagccttacagtgaaaatatggagactttagaaacccagagacatgcacatataaagagaaaggacgaaacacatgcacacgttatttgtggagaagtaaccccacctttcagccttttagcttattgccactaacattgactgtaggcatacatgggtgtatgtcttttttaaaaataattatcctattattcagaaaattttcacatctactctcaaatttccaatggaatttttaagtcacaacttgtagacatttctggaattcatgtttaaaaacaaactgcttataagtctttatagctaggcaaaagattctaaatggcagttgtcacttaagatgaatataagataatatgttcagtagaactgttctttatatatgaatattgctaagttttattattactataatagcatttgtttaatccatgaaagctgttttcagaattcctcatgtgaactcttagaagaggatacatacatacacctatatataattgtattagtatgttgctataatgccacaagtctaactcttgttaaagggggaaaaaaatcaacattttgaccaaaacatgatagtccaggataacataaataaaactgagtcttgaattttcacacctttattcttaaaggaaataaggagttttggtagtaagccatcttctcctggtgactttcattgttctttcacagatgtattaacat

SEQ ID NO: 1223 - DNA, 1028 bp, Homo sapiens
aaagaatcacttttaatcatggtcacagtattcagaatagcttttttgagatttaactggtattttgagaagattttctagccataggacacatcgctcagcttctgtcccatttactccttccctcttccctttgctcttggtcttccccagtcttctgtgacctctgtcagtatatttgagcctgtaacacaagaggtcactgtgctgatggtgacctaaaactgagaaatacagggaaacgtccagaccaaaactggcagccaaagagaagacatatagaaggctatcgagaagcagcttgactggcccgagttcctttatgtgcagcctatgtgccagaagtgggaatcaggtttcctcaagtgtttatacttaaaatgtaacttttcctcccaaatttaatataaaagctttgtaaataagccactactttgtattctgatggtctgtggtcaattgtatcataggagtcaaatgtctcttggtggccagggagagaggtgtgtgttgtgttctgtgtgaattatttggttatccaatgaaggagatgagtactttgtattactcagaaaggatagaggataaagtgacttgtagtagtctaacatggatacatgctattcctagttctatgcccttgatgttctctaatggaaagctttcaagaccatctccaaaaatgtctgctttcattttatttatctgaactggctgtttccagtgaactgtggcccgcttcctaggcagagaccatacaatagtttattctctctaaaagctttgagtattcctgtcgttcagggagtagcatgcaagtcctgggaaatggtatttaaacaagctcaacttgaccatgatcgctaaacaaaagccatcactggacataggcagccactttaggtaaccatcatacagatagatactctggagagtcacttccctagggctaccaggcctgaatggaaagatgtgagtaaggcttttgcctcagcaggctgtttttttttaaagcctgcctatcacta

SEQ ID NO: 1224 - DNA, 1028 bp, Homo sapiens
agctggagacactattctgagagaattgttacaaggcaacaatgataaagaaaagcttttccagcattcatctgccaagctgttctatagatctgtcacaaacaggaattagatataaagttgtaaagtcactgtaacccagccctttaaacaaacctatgtgtaatatatcaccacaaagtgagttacaaagaacttttttcttttgaattagaaatatcagtggaaagcatccctgcttccttattaatgggtaaacctaaagcattaaatgcaaacattaacaggacataaaccatctgttataagaaaaacattttattttatttggctatcatagtttcttataatcaaagtttttatctctgttttctagatagtagttctgaaatggaaagttcatagtgacatacttcttaatattatattcttcttgtctactttttttgtttctcttggaagtcctttaatggtactaacctcacatgcctcttggtttttcaaatttggggacattagctttgtgcctaaaattaaataaatgcaattttaatttatgtaaattattattattattattattattattattgagacaggttctctgtcacccaggctggagtgcagtggcacgatctcagctcattgcaatctctgcctcccaggctcaagcaatcgtcccacctcaacctcccaagtagctgggactacaggcacatgctaccatacccagctaattattattattattttttgtagggatagggtttgaccacattgcctaggctggtcttgagctcaagcaatcctcccaccttgtccttatgtcattaatttttatttaacattttttttaatataattattctaccccatagactacctttaactatacaagggtctcttgaaaccctaaactcagtctcattctggatatatcctatttttgttcctaactatcagtgtagccttgtacaagttacttaacttcattgactattgttggcagtatgagggattggagtaaa

SEQ ID NO: 1225 - DNA, 1882 bp, Homo sapiens
ttttgaaaagctggggaaagtcaaacataattttaagatattaagacaggtggctgtgaagatactgatgccttctgggaagtaggtaggaagaactgattggaagagatgatgcatttgtttttattttatatttatttatttatttatgagacagagttacgctcttgttgcccaagctggagtgcaatggcacaatctcggctcaccgcaacccccgcctcccaggttcaagcaattctccggcctcagcctccgaagtagttgggattacaggcatgcgccaccatgcccgtctaatttttgtatttttagtagagacaggattttaccatgttggccaggctggtcccgaacttctgacctcagatgattcacccgccttggcctcccaaagtgctgggattataggcatgagccatcgtgcctggcaatgcacttggttttatacctgttttgcaagtgctgagacttcctgttcaatttaagatttaggcagattatcagttagatggctccctgacaggagttgaaaatgtggaactagagctgaagaatggtgatgaaaatcagagacctagattttagtgtcagcattgggatggatgaaatggcaagaggcagaggatgttaaatgcagagtcaagatgggacagaactttgtgggacagctggatcaaggccaaggatgcctgaagaatacagagaaagcagaaaaggggagggaggggaaacagacactttgagcaccaactaaatgcaaacactgctagactctacattattttatttgattctcacaattcagtctggtaatttggtagtgttccactcaccaacggaagaaataggctctgtaaaaacatatactttgcccaaggtcagagctaagattcagactcagaccctatctgacttcaaaatatgtactttgcactgcagtgtgcctcagacaggtatgtaatcaaccagaacactgttaaagagtccaaagtaagtttaagtgtcaagaaaaatgtagtaactacctttctagagatgaagtagttgctgtctgctaaacgaaaatgagaataaggactaaggactgtggtcctggcaattaggtggtgtgggtaaccttcaagaaagcagtttctacagaatgataggagtggagaccagattgcaaaggctgctatagtattacatatggtgttggggcactagacggagcaaatgccgactactcttttcttatggttggcaaaagcagaaaggagagggagtttataatccaatatgatatgataaattgtcagaagattctcaggatagtggaagtttgagcattttggtagcagaggggaaggagacgttagacaggcaaggctggaagaactagagggtaactggtggaatgtggcccatgaagagactgggaatgacatcaaaggtgtatttgcctctttttctttcctaactcctttcacccactttcctacatatctgcaacatatttctctctccttgccttaaatgtcagtgttatttggtaacattttgcctcctgttcttaatttcaaaagtgcagaaaccaaaccttgtatatttcagctcccaaaaacccatattgttaattttcattactgttacattcattactgtattattagtttcattctggctctgattgattcttacctccctttctccacaggtcaattattcccctaggagaattaatttaggcatttctgagcttgagttgtacagccactatgtttaattatggtgactaacctttattttctcatattcatgacttttaccttcccctgccttctcaccttccatgacccacaagtcggttttaggaacataaacatgtaatttaccaaaa

SEQ ID NO: 1226 - DNA, 1049 bp, Homo sapiens
ttcttactactgtatataataattcctgttaaccagatgttgtttgatagctcagtaataacaaatggagggtacttgtcctaacctgatttacattctttccttttgatgtgtagcatatgtggagcagtcagctaaataaaggtcttatcaataagatgcagtttgacacttggctttttgcttttgttgttacgccacttaccatatggtaaagaattgttatagaaggatatctgtattttcagaagtgaggtttgaattggtggaggtttcatgagcagtttcctcatttgtgatttatacattgtaagtttttatcatgtgagttgttttcaaattatattcaccagcagatagcctgtgttaagccatcttaagtgtcaccttttgaggtttttattcatacttaaaagcaattgaaagaaataactttcaacagaaatcttttgtttttacttacagccaatcacattctctgctgattattttaataagtatttcctgcataaaacacattaaatatcagctgtagtataaattactgttttttatttacatagaagttatttgggcccaccatgttattatggggttttgcttgtttgttttgtttatgttttagagacaaggtctgtctcgctgtttcatccaggttggagtacagtgacatgatcatagcgcactgtaaacttgaactcctggggtcaagtttacaagttgtgggaaccgatcctcccacctcagcctcttgttgggacttcaggcgtgcacctccacactcaactaatttttttatttttagtagagatgggatcttgctctgttgcccagactggtctcaagttccaggcctcaaacagtcttcctacctcagccttccaatgcactgggattgcaggtataagtcaccactcccatcctggatttatttgatattcactattagaagttgcaagattggaatagaggcttgagtccctttcattgtgtattggggtaggagttgttcattaatgaaaaaattaaacaggtaagtaattagtata

SEQ ID NO: 1227 - DNA, 1048 bp, Homo sapiens
aattaaaatattcagggaaagaaaaaactgcatctgctttgaacacctatggacattttttcttgtcattttccccttaaaaatacagtataactatttacataacacttacatagtattagatgttataagtaatgtagaaatgatttaaagtatacgggaggatgtgcataggttatatgcaaatactatgctattttatatcaaggacctgggcatcctcagaatttgatttccatgggaggtcctggagccaatccccgacagatactgagagacgactatattatatagatctataatcatttatattctgttagggactggtgggggaggagtcttttcagttaaagattaaaagggaaatacaagggaataaataagattaaaggaaatcttatttccttactgactaaactttccaagaatataattatgcagcaacagttaggggtcacgtgttaagaatagtcaggaaatcctgtctccagatgcctgaggattgctatctatttgtttgatgacttgctgtagaaatctctaggccccaagttgatattcttgtctccaccagacaccagactttgtgtgatttctctatcagcacttccttctgcctcccaactacttgccatttttacatctgtagtcctctagttctctaaagcaaatttaaatcattctattccttctgtatgttcattgagggatcagtacgtatgagtcaggcaagtaacaattaaatttatagcactttatagcctacaaagaatgaaagctagcatattagctaagagtttgggctttttgagataaattgtttaggttcaaagccctaacctgctacttactatctttgtgaacttggggaagatacttctattttttatgcctttatttccttgtctgttaaatggaggtgacaactacatccttaggatctctgtacatttaaaggagataattcatgtttagaacatagtacatggtaagtactcataagtagcacatggtaaatgttagttgataatataaccaatactataat

SEQ ID NO: 1228 - DNA, 1059 bp, Homo sapiens
gggccactctgacaattttttttaacctcatttgattgtgtaagggtctaaccacaacaaaaaatcatagtgtaatagaattaatcaagttcagcaaggtcacaggctagatcaatatacagaaaatcaattgtatttttctgttcagaaaactccaaaaatgaaataaagaaaattgtgttcacaatatcaccaaagagaattaaatacttaggaataaatttaacaaaataagtataagacttgtataacgaaaactataaaacattcaagagggctgggcatggtggctcatgcctttagttctagcactttggaggcagaggcaggaggactgcttgagcccaggagttcaagaccagcctgggcaacaaagtgagaccctgtctccacaaaaaataaaaataaaaataaattgaagatggccgaataggaacagctccagtctacagctcccagcaggatggacacagaagatgggtgatttctgcattttcaactaaagtacctggttcgtctcactgggactggctggacagtgggtgtagcccacagagggttagccgaagcaaggtggggcatcgcctcacctgggaagcgccaaggggtcgggggatttccctttcctagccaagggaagccgtgagtgactatacctggaggaggggtacactcctgcccaaatactgctcttttcccacagtcttcgcaactggcagaccacgaaatcccctcccatgcctggttcagtgggtcccacgcccacagagccttgctcactgctagcgccagcagtctgaaatcgacctgggacgtgggagcttggcggggtagaggtgtccgccattgctgaggcttgagtaggcggttctatgctcacagtgtaaacaaagcagcagggaagctcaaactgggcagagcccaccacagctcagcaaggcctactgtctctgtagattccacctccaggggcagggcatatctgaacaaaaggcagcagacagcttctccagacttaaacgtccctgcctgacagctctgaagagagcagtggttctc

SEQ ID NO: 1229 - DNA, 1049 bp, Homo sapiens
tcagcgaatactataaacacctctacacaaataaactagaaaatctagaagaaatggataaattcctcgacacatacaccctcccaagactaaaccaggaagaagttgaatctctgaataaaccagtaacaggttctgaaattgaggcaataattaatagcctaccaaccaaaaaaagtccaggaccagacggattcacagccaaattctacgaaaggtacaaagaggtgctggtaccattccttctgaaactattccaatcaatagaagaaaagggaatcctccctaactcattttatgaggctaacatcatcctgataccaaagcctggcagagacacaacaaaaaaagagaattttaggccaatatccctgatgaacatcgatgcgaaaatcctcaataaaatactggcaaaccgaatccagcagcatatcaaaaagcttatccaccacgatcaagtcagcttcttccctgggatgcaaggctggttcaacatatgcaaatcaataaacataatccatcacataaacagaaccaacggcaaaaaccacatgattatctcaatagatacaaaaaaggccttcaacaaaattcaacagcctttcatgctaaaaaccctcaataaactaggtattgatggaatgtatctcaatataataagaggttatttatgacaaacccacagccaatagcatactgaatgggcaaaagctggaagcatttcctttgaagaccagcacaaggcaaggatgccctctctcaccactcctattcaacatagtattggaagttctggccagggcaatcaggcaagagaaagcaataaagcatattcaaataggaagagaggaagtcaaattgtctctgtttgcagatgacatgattgtatatttagaaaaccccatcgtctcatcccaaaatctccttaagctgataagcaacttcagcaaagtctcaggatacaaaatcggtgtgcaaaaatcacaagcattcctatataccaataatagacaaagagccaaatcatgagtgaactcccattcacaatt

SEQ ID NO: 1230 - DNA, 1077 bp, Homo sapiens
gcgtttaaaaccttttgaaagcaatataacaataattttatacctgttaaatgtaataaattggggcctgcattttgtatgtttcttttattccatatttctctaaggattcatttttattgttttatgaaactactagtctgtgacatggaaggtagaggaaaaagattcttgaccctagttgcttgtgaaacctgggattctacaagtgacagttgtctgtttactcttgaagttcaagtgttactttgttacatggttaatttatgtcaaaagtatcataggctaagacatcaaagttttaataacattcttttttctttaaggggtttgttaaagttgttaagaataaggcctactttaagagataccaagtgaaatttagaagacgacgaggtactgtcacctttttgtgtttacaatattaatctgctttgcagatgcagtggagtatcctttctacaattatttttttctttcagagggtaaaactgattattatgctcggaaacgcttggtgatacaagataaaaataaatacaacacacccaaatacaggatgatagttcgtgtgacaaacagagatatcatttgtcaggtaagttgtattctagacagtcccctttttttattgctagagaaattgtgcttgggaagcaaagcacatggtgtgtgtgttagaagggctgtctagcacctccaaaagcatccagtgaataatttttccttttagtaggtctagaattggaacctgggaacttggtactttaaaaaatgctcttggttgcgctcatgcctgtaatcccagcacttcgggaagattgcttgagcccaggagtttgagaccagcctgggcaatatagtgagagtttgtcttcacaaaaaatgtaagaaaattagctgggcatggcggggcgcacctgtagtcccagctactcagtgggaggattgtttgagccccgaggttgaggctgcagtgaagtgagatcacacccagccctccaacctaggtgacagagcaagacactgaaacctagtttatgtgtgtggggtggggagattagaagtaagtaagaa

SEQ ID NO: 1231 - DNA, 1073 bp, Homo sapiens
gaaagcaacagattactaacctagtttctctcttactatagattgcttatgcccgtatagagggggatatgatagtctgcgcagcgtatgcacacgaactgccaaaatatggtgtgaaggttggcctgacaaattatgctgcagcatattgtactggcctgctgctggcccgcagggtatgtacaagatgattttaattgatgtagtttgtggctgattgcttggagagttttctgcaagatgtttgtacatggataagatagcttaagttgtgcttcaggagagtgcttgcttccagttttctgctttgttaatggatctatctaggtcagctctttccaataaaattttctgcaatgacacaaatctgtaatttgctgtccagtggttttgccactagcgacctgcagctgttgagttccagcagtatgtaaacttgaatttgaaaatccacttgtagctagtgtctacttaattggacaatgaagacccttgctacttaggtatacattctgaatgttggcaaacattaaaaatgcagactcgtgggaactccactctagaccttctggaatctgtattttgatagtatgtaccaagtgatttatatgcacattaaaactggagaatcttggctaggcgcggtggctcacacttataatcccagcactttgggaggccgaggagggtggatcacttgaggtcaggagtttgagactagcctggccagcatggtgaagccctgtctctactaaaaaagtagaaaaaaaaaaaaagccaggcatgatggtgtgtgtctgtagtcccaactacttgggaggctgaggcaggagaatcacttgaacccagaaggcagaggttgcagtgagctgagatcacgccattgcactccagcctgggcaacaagagcgaaactgtgtctcaaaaaaaaaaaaaaaaaaatgagaatcttagtgttttggagagtggccattgacgggaagattcatttttgttttaaacatttttcctggtagatgaagatgggattttgccttgtttttattatctgagttttttaccttgttttgcaa

SEQ ID NO: 1232 - DNA, 1091 bp, Homo sapiens
gaaaaggcttatgaaagatttctaaacctgcaactaggaataagattgtaggccattttgggaagttaagtaggttaatttgtagttccattggtttaatgatattttttgttgttgagtctgtgcatcttgatttattaacttcttaggaatattttagcatttggtgatttaaccaagaaatagtaatttttggtaagcctaaaatacaacccaactgaaattttgcttttatgatgtggaggtgggtggggggagttagttgcaagtacaccaagagcattctcacttgacaatttcattaactgtgatcttggacaaatcacttattcccatgtacccactgaaaattaaaggatttagagtataagttttgaaactccttcctgtgctgatgtgctggatgactaattttgtagtggtggaaagccttggtaatggcttttaaaggtttttgtagcatgaatttcttttctgtcctggaattcagagatgagctgctgaatgatgatatcccactaactgagcagtcagtagttggtcctttggttgcatatgatgcgataattgtttcaagacgggactgatggcagctactaaagtaaattcttactagtaaactaagttaagtgagtctatactaaaatatgaataactttattttagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatggtaaaacatttacctaaaaatgcctatattggttaatttatggaaataggtttattacttgttttgggggcaggtaacattcttatataggtgtgtttcttgacaacatgagctagacttgtcaacattcttttagtaatcttttagatgctcaagtgtgggagacttcaagcatctgaagatttggctaccttttatgctttggctgttctgtatttgtagatgtcatttctgtaatcatagttgt

SEQ ID NO: 1233 - DNA, 1088 bp, Homo sapiens
cttagctggtctcaaactcctgggctgaagtgatcctcccacttcagactcccaaagtgcttgagattacaggcatgaaccaccacacctggcctgatttttttcttgagtaagatggagttctgtagtgataattcacattgcataaggtgaaaattgggaatttgttaggaaaaggtgagttacatttagaagttaaagtgtttaccaacattgatttagtttagttccttttgagaatctggcttagaaggacaagataagttatggttgcattaatatagtagggcacatgaaatgaaaccaagtactgtttgctttcctttgtttcagatggaggagatgtataagaaagctcatgctgctatacgagagaatccagtctatgaaaagaagcccaagaaagaagttaaaaagaagaggtatgtcgtctttttttttgtcttttcaagaaaacaggttgggaatggttcccacgtggggcagactgttggtgtaattgtgcaaactcgatcactagctctgcgtgatgtggcagaagcgaagggaaccaggtttgcaaaagtaactgtggtgatggaaatgtgttagcctcagacactactgaggtggttctttctatcctagtacagtctaagtactggttactgcatttttttattggctgacaagttgctttttgttgatctttcatgttttgatctttaaatggaatagaaagtaatacttaatgaacatgtaagcataaagtgatgtgatggcccacaaatacaatgtatagtaattaaatcaatgtatttaacatattcacctcaaatacttaacactttgtggcaacaacatttgaaatttattctcttaattgtgaaatgtacgatattctatattcatcatgctgtgcaatagaactaaaaacaaaatcatactcctcctgttggagattttatacttgactatcatctgcccattctttgcacccaccagcctctgtaaccaccattctgctctctgcttctgtgagttccattgttttagattctatatgaatatgaagtatttgtctttttgtgcctggcttatttcactga

SEQ ID NO: 1234 - DNA, 1051 bp, Homo sapiens
tacataattcacatgcattctttgaaggtgtacagttcagtgattttttttagtatactcacaaagttgtgcagccatcaccatacctaatttcagaatattttcatcatcccaaaaagaaaagaaaatcttaatccattaacagtcagtccccttcacctatccactatcctctggcaaccactaatctaccttctgtgtctataaatttgcctgttctggacatttcatgtaaatggagtagtacaatatgtggccttttatgtctggcttccttcacttagcatgactatattagtccattcttgtactgctatgaagaaataactgagactgggtaatttataaagaaaataattttgatcggcttacggttccacaggccatacaggaagcatggctggggaggcctcaggaaacttcctgttgaagtggcccccttgaagtggccacagcaggaggattagagatgggggcggctccacatgcttttaaacaaccagagaactcagtatcatgagaacagcaggggggaaaatctgcctgcatgatctagtcatttcccaccaggggcctcctccaatgttgggggttacaatttgacggaatatttgggcgggcacacaaaatccaaactatatcgttaatgttttcatggaacagccatgttgtagcatttatagtcacttcatatctttttagggtcaaataatatttcattatatgaatatacctttttttgtttgtctagtcatcagttgatggacatttgggttgttcccacattttgactattgtaagtaatgctgcagtgatcattcatgtatagggtttgggtgaacatgttttcatttctcttgggtacacatatctaggagtgaaattactgggtcagatgataactcggattagtgttttgaggaactgccaaactgtttttcaaagaggctgtgccattctacaagctcactagcgattatctggtgagtgattatctcaccagtttatccacatcctcactgatacttattattgtctatcttttgattat

SEQ ID NO: 1235 - DNA, 1044 bp, Homo sapiens
aacctgttaggtggttaagctatttttaattctagggggctcaggctgaacttgaggttggggaggagaatttgcctctgcttttagttgcaattttcaagtgaggtgaaattaagtaaaatttgtaagagcttttttggctttttaattctagataaatacataaataaatttgggtctctgtaatagaatatgtgcttttataggatagtgatatttgcttgataaatggaggatttacttactagtgtgtgtattgataaatacagactttgattagtttattcaagagagatttttaagtccctactttatgccataccttgaaaagttttagagttccagtgatgagcaaaatgtttactttcaattgtaattcaaaatgcaaattccacttgtttacatggagttattagattgtaaatttctagaaaattgtttgattctgcctttaaaaaaaaagaaagatggagcctctcaagagtgcagtggtacaatcacagctctcgtacttcactgtatcacggtagcgtttgaactcctgggcccaggatatcttcacacttcagcctcccaggtagttgggactacatgctctcaccgctatgcctggcttaatattttcattgttttagagattgtgtctgtgtatggggatctcgttatgttgcccaggctggtcttgaactcccagcctcaagggatgttcctgtctcagcctccccagtattaatagcttgattttcctttttttttttttgagacagagtctcactctgtcaccgaggctggagtgcagtggcgcaatctttgctcactgcaacctcagcttccagagtagctgggatctcaggtgtgcaccaccacacctggctaattttttttcttttttgagatggagtctcgctctgtcccccgggctggagcgcggtagcacgatctcggctcactgcaagctccgcctcccgagttcacgtcattctcctgcctcagcctcctgagtagctgggactacaggcacccgccatcacgcccggctaattt

SEQ ID NO: 1236 - DNA, 1528 bp, Homo sapiens
gtctttatatcagctgtaggttattcacttggtgaatattagctataattgttagtttatctctgatgactcagtataaaactttttcttttttttttttttcttagattttatacgtttatatgctctgtctgcagttctggaccagaatacctcaaacgtctaccattacagtggtaagtgtggacctttctgttaaaagaaagaaaagccattttcttaaacctacaagttgaaactttctatatacatttacttggcttaagtaaaaataggttatttatgcttggctttatttcttttatttatcctcatgcctgatgtcatcttcactaagtaacatccacttgtattgctaaattaataaggctgttcagtgttgaatgttataaatgaaactttcagatatcctttagacctaaattcttactcatatttctagttcttttgaacattcagaataccatacagtagaagagagataggtataacaaatatgctaatttctgcttcaatgtagtaattcttgtgtgttggaagtgtgatgaattttagaggtttactaataaaatgcttacagtaagtacttacaaatctttgttgtattttacatattttatcaacagataggatttaacccatgaatcaaatagtttggttaagtatggtatattctgtagcttatatccggaagtgaaaacacaaaaatcttgattttaagttatatttttttaaagccagaccctctttgaatgcacttgaagaagtaatttgtggccaggtgcggtggctttcgcctgtaatcccagcactttgggaggccgaggtgggtggatctcctgaggtctggagtttaagaccagcctggccaacacggtgaaaccacgtttctactaaaaatacaaaaaaatttagcctagcgtggtggtgggcgcctgtaatcccagctactcgggaggctgagggaggctgaggcaggagaatcgcttgaacccacggggcggaagttgcagtgagctgacgttgtgccattgtactactccagcctgggcaatcagcgaaactctgtctccaagaaaaaaaaaaaaaaaaaaaagaagtaattcatatatcttctagtttatagttgctattcagaataagtgaatgtttagtcactattttctagttatttttatgtgtagtgatttattgtattgtgaatatgactatccacctaaatatttctctttgcattttaattactgttttataaggaaaccgtgattttttaacagtaaccaaaaacattgttttgtgtatttgattattttcggattccagggtagatatagcacacctatgcctttacaacctaagtgttattcataagaagaaatactttgattctgaacttgagcttatgacatacattaatgaaaactgggatagattgcaccctggagaggtaggtggtctgagaactaacttcagtagctacttgatgtcttttttgttttgttttgtttttcaaaaaacaactgagaca

SEQ ID NO: 1237 - DNA, 1032 bp, Homo sapiens
ctacatcaatacatcattatcatccaaagctgtgacttcttttagtaataaaaagaagtttcaaaaatattacacttttggagataatatcctgtcatactgaaaagccaaaatgtaacattcatgtatcatatttttttcttagttgaatacggtataggattgttatgaagagaagataaaacttttgaatcattttagaagataatggtagtattacattgtttccttatgtagtttttgtacttcttttggcttggtacctaatgattatcatatagattgagtgtagctgtttgaggaactactatgttttggattattttctttgagatagtaaaaatacttaacatttgaaaccatgataaactttcttaaggtttttatgtaaaatgaagtctcatctgttgtatcagattgttttggggagtttaaaatgagatattagtactttttgtaatcgcttattgtcatttgtgtttgattcttaaagttatttgaaatcctagttctgtaataaccactcttctgtggtcttaaattttagaaaccctgaggttgataccagaataatttatggagtgctacttcacttctgagggaggtagggagaaaagcaaagatgaaactcaagaaatactgtggtagaaatgatactagaggaaaatatacaatagaggtggaataatatttataagtggaaattataagaaatctgaacaaaaattccttggggcttagagtgttataattagcatatagtatggtggttagcaacaaattacctaagttgttgggatacttaagcccaggtggcttggaacttaatattggtagttgaaaggaagagttatactgtaagtattagtgtgagattagtatctggagaggggggagcaaaaaaaaaatattcttttggagatttatataataaacctcatggtcagatggaaggtgtagaatatgatgctcttctaatgtagattatctgatttacactataatggttgtacttttagtttgcaaaacact

SEQ ID NO: 1238 - DNA, 1875 bp, Homo sapiens
cttagatcttctgactaccaatcagtacacttttcctctgcatcacattgcctctatctagcacctgtatattactaattgatgaaattgtagtgcgttaaattgtttcttgatacttcacagctggcagacacaccaaaatctgaaagatatgagcatgttctggaggcattaaatgattacaagaccatgtaagttgatttattttatgtatccctatgagggagacatttagtaagtataaggaataatggcattgtttaagaattgtgggattgatgtacagaagaagtctataccattttaaactttataatgtcctattctattttagttagattaaagcagtgattctcaaggattggaggagggaggagtaatccttctcctgggaatggtgggtgggagacatatcggtatctctgggagaatttagcctgttccattgaaaaagcatattcagtaataacttccttctataatgtaatgtactgaaagtaaaataaaatcttgttagctggtgggaatattcaaaagatagagaatattgtagggaatacgggtttttaaaaagattgagatctgtggttataatagttaacaccattagttacagaaaataatatttctagctgagtagtctaagataattaagtgatattatttgatatattctcatacagatctacaggtcttccccctaccttatttttactttttttttaactcaccactatactaacaaggattcccttctttttaaaacaatgtatctacatttcttagaaacatttttaaatgcaacaaattttataaatgtatgtgttgactccagtgaaattttatattataaaatttttgttggcaataagttggtgttttgaaattgatagtatttcttcattaaataatgtaattaccagtggctggatctttacaccagctcaaaaagccatgaggtacctgatatgaccttgaagtataataaaaaggaaaaaagactgtaaaaaagtcataaggtacctgagcagttattgtgctggtaaaaatgtttcatgggacagtgaattctgaatttcagtttagggtaccagaaatatatctgttcctgttatggtagtaatgagggatcccctttcttaaacctgcaaaaaagtagaacattttggttgggcgtggtggctcacacctgtaatcccagcactttgggaagccgaggcaggcagatcacctggggtcaggagtttgagaccagcctggccaacatggtgaaaccctgtctctactaaaaatacaaaaatagccaggcatgttggtgcacacctgtattcccagctacttaggaggctgaagcaggagaatcgcttgaacccgggaggtagaagttgcagtgagccgaattgagccactgcactctagcctgggtgacagagcgagactctgtctcaaaaaaaaaaaaaaaaaaattaaaaagagagggagaacattctaaacaactgatggaggttcttgtggccaggcaagtttcagtagagctgaggtagatggagttgcttgggaataaggaccatagagactaaaagaaaggtctaaggagcatattttgcagaggcccaagtccataataaactggaataacccttctttgccccaggttatttccatttccagatccggcactctagatactccttttattttctgggcctctaggatttatctcctgctttctttttcaatgctgtcacctattatttctgactaaggtttttctctttataaatccactctgagatggaattcttttttccctaaatcccttttgaaatatttctaacagatgacactaaatatgggaaagcatattgggaccaa

SEQ ID NO: 1239 - DNA, 1050 bp, Homo sapiens
aaggcagcctttatgactactacaatgttaacatagatatttcctgactccatgaagttaactgctaaattcatagtcatttttagtagtaaatccttgaaacatcctccaagttgtaaccacctaaaattaaactatataattgagcttttaggagttttgaaatcttccatccagtataattgtctggtttttgttgttgtttttaaatctttaagtggtatatattgttcagaattatattaaagaggactttctttaaacctttcataatgtaaatatctttaaagtcaagaaatatttatttggattagaatatattatctgtgcacttgactaaacttgtggattcaactaatatttactttttattaccattaatataaaataataaaatatatgtatatgtgtctagttacatacatagagtcaatgtctttgttttctttatgcagagattaaatgcataatggttttccatttcagggaagtaagcaatggcatagaaaaaaaaggaaagaaaaaatctgtaggtcgtccacctggcccatatacaagaaaaatgattcaaaaaactgctgagccacttttggtaagaggatatgttggtatatgttctcaagaagaaggatgcatgaaataactgagaagctagtatttttttcagcttactttagagacatgctttaagtatatatttttattttccaggataaggaatcaatttcagagaatcctactttggatttaccttgttctatagggtaaatagaaagttattttctccctttctaggttttgtcttttgagtagatattaatatttgtttgttatataatatagtcgttacacaatttaaattcttttgtctcaggagaactgagggaactgcacattcatccaatacctcagatgtggatttcacgggtgcttccagtgcaaaagaaactacctcgtctagcatttccaggcattatgggtagatattttacattcttattttttttactttttttactctagatttcttttctttgtaaagtgttgatt

SEQ ID NO: 1240 - DNA, 1072 bp, Homo sapiens
ctgagttttgttttcaaaagcagtgatggattgtcctaaatgtcttcttccaggcctcttactgattttgcctattaactgccactggctcccttatagatgtttatgtttgatcctaaatgctttttttgagaattaaataaaactagtttatattttattatttaattctataaaggtaattcagcccatcattaattatgccaagtgctgaagaaaaaaatgaataatatctgaattaccagtaccctagttaaaattagtttcccatattagcgaaagttaaaagcagggccaggtgcggtggctcatacctacaatcacagcgctttgggagtctgaggcaggattactgtaggccaggggttcgagattagcctgggcaaaagtgagaccttgtctctacaaaaattaaaaaattagccgagtacacacctgtagtccaagctactcgggaggcttggttgagcccagtactttaggctgcagtaagctatggtcacaccattgcactctggcctgggcaacatagtgagaccttgtctttaaaaaagaaattacatttaaaagaaaaagaaaaagcctacttaagaaaaaccagtgacatactcagatgtttgctgctcttacaaaattaatatagctaaagataaaagctttgtttaatgtttaaaaaacagatttgtaggccgggcacagtggctcacgcctataatcccagcactttgggaggccgaggcaggcagatcacgaggtcaggagatccagaccatcctggctaacacggtgaaaccccgtctctactaaaaagacaaaaaattagccgggcgtggtggcgggcgcctgtagtcccagctactcaggaggccgaggcaggagaatggcgtgaacccaggaggcggagcttgcagtgagccgagatcgcgccactgcactccagctgggcaacagagtgagactccgtctcaaaaaaaaaaaaaaaaaaaaaaatttgtaaatctggtatagtgattaatagtgagttggactgcctgaatgtatatcctggctttgccgttcactagctgtgtaa

SEQ ID NO: 1241 - DNA, 1034 bp, Homo sapiens
gcagtatttcttaaaagaatccttgtaagaacagaaagtcattgatgctgggctcttaagctggttgtacaattatgtagagccagtttactttttctcctgttttaggaatccaaaactttgttgataatgtgaaatgctatgtcagggattttgaagttagatttcctgtcttatataattaaacagggagcagaaatgcttttaagacagtagggctgtccttccctaccatttactgtgagacactaggaaagttatataacctttttgtgcctcagttacctcatctgtaaataagaagtaataatagtgccaaccatataaagttgtgagtgcctggcatgcagaaagtaggtatttagtaaatgtgagcaggtattattttagaattaagcttcaaaaaattttaaaagtgagattaaataaatatgattaaaatgaatgcatatatattttattttcatttttattctcttttcttcataggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccagtaagtatgtgtgattacgtaatggaaaagaagaattttactaaagtgttttagaaaagactatcattttgtggttgctttattagcttctaatttctttttctctatacttttagtcatgaatttctcttctgtctaaatctctattttttttcctgcacttaccattctacacttttccccagtttctcagatgccatatataagaatggcacagaattttttttaaacagctttgttgaagtatcattta

SEQ ID NO: 1242 - DNA, 1029 bp, Homo sapiens
ttaaactagaacataagatcttagctcctctgatatctgctttcccaggatgctgtttatttgcttggatttttaatgtactgtttgcttttgaaattagaaagtaatcatatacagataacaattttaatttggcattctcatttgtgtatcaagaattatttcatatatggtcaggcacagtggctcctgcttgtaatcccagcattttggcaggccaaggtgagaggaactcttgaagcaagagttcaagaccagcttgggtaatacagtgagaccctgtctctacaaaaatgcaaaaattagctgggcatggtggcgcatgcctgtggtcctagctactcgagaagctgaggtaggaggattgcttgagtccaagagttcgaggctgcagtgagctctatgatcataagctccagtctgggtgacagagtgagaccctgtctctcaaaaaagaatcatttgagatatgattccgaatgtggtaatgtatgcttgatcgtttgtttcttgtagtgctaagaatgacacgattagaaaatgtgatttttttctacttctaggaggtgtgattcggttatagtttgaaggtagaagtcattaaatgctaaccttgctcctttttataactgtcttttaaaattctgtattatccaaacatacagaaaggtgcatatgctagtgtagcaccttatttgtaaaatttgggacacatattgtcttatcaactctatgtttttttagaataaaattttacaggtaaatcttctttgtgtaccttgtcagatcccaattatcttcctctctcctcagaaatggcaattattctgaaattcatgtgtatccttctcgtccatgttttaaatattgtcacatatcgatgcatctagaaatatatatatgttgcttagtgtttttatgaaaatactgtttgccactataatttgtttttcactcaatattgttatgagatgtatccatactgatttatgtgactcaggtttatttcttttaactattgtagttttc

SEQ ID NO: 1243 - DNA, 1035 bp, Homo sapiens
gaacctgcttctgtgtgcagtacataaaaatgttcttaatgatctcaaactgtccaaataaattttatgattaccttcagtttaaggaaacagggcaacttaaaaaaaatttttacaatgatttctattaaaaaatggaatttaaaaggtggagaaggattcttacatttctggtacaaaggaatagtcttagctacctagaaaaatgagtgattcagaacttttctcctctttgttacgtatttaatttagagagcacattacttattctttgatttccttaatgaatgtctcattctctgtcccttttagtactctttagatcagaaactaaactttgtttatgactaaatctttcaactatttaagtaggtttttattcttgaagtcctattcagaacaattttccttttatgtttattagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaagtaagcttggaattagcttggtatatatgttaatttttgaactagaacaaaaggtattattttagggttttataaaaattatatgtttacatccagatttaaagtttttaaaaaatggtaccacataagttataaattgttttaaaattatatttggaaacctttgtattttaacttattaaaagttaaagttattaaaagtaggaaaaactgtagtgggtaaaagtctcaaatttggtggaaataatattgcattgcagcctattatttcttccatagtataagttaatatggttaatatacatttataaataaagactttggattatgctgttggaagaaaaggagtgataataaaggatttcaaattttagcaaaccccaaacc

SEQ ID NO: 1244 - DNA, 1050 bp, Homo sapiens
gtagagaagccaaacagtataccacagtgactcagagattattataagcagggacccgctaccattgttaaggttagaggaacatcaggaaaagatggtgtgatcatagtctagaagcagggctgcctatctggagctggggccaaagaaaaaaggtctgtccaataggaactggggcaatagaggaggagcactgcagctactggccattcccattggccaaacctatttgtaatctagagggcaaaggaggccaagaaatgcagtttcctgcaatacacagagcagaacaggggaaagccataggtaaatctaagagtaaataatgtagttgaccagcactccagacttaggtgcatcaagtaattatatagccttagaagtttaaaaaaaaaaaaaaaaacttcagatttaatacggtcatgtcttcttctgtctaccttcccttatgaaggtttttatagcatctttgacaggcatatatttttctactccaatacatagaaactaaatcatctaaactgtatgtacttggatttttaaaaataggaatgtccttttttttttttactatgatcatctttaaagtagtatacaaaatacattattttggcatttattctactgcccatacccacactccgcttcataataaatagacttggcagagatggaatctacctggaggtaggcagcatttgtaacaggagaatctgttgagctttagactttgcattcatagaaacaacatcagagactagggtggataacagatatttacacacaaaataaatagaacgattttttttttctttttttgagacagggtcttgctttgtcacccaggctggagtgcagtggtgcaatctcggctcactacaacctctgcctcccaggttcaagcaattctcctgcctcagccttcccagcagctgggattacaggcatgtgccaccacacctggctcatttagaatgatttttacaactggaaatacatacctaggctcaaactgaattagaaaccagaagtggtaatcaggtatatttg

SEQ ID NO: 1245 - DNA, 1045 bp, Homo sapiens
ctgtatatgatttaaataaattacttacgtttagtgctaataaagcgttttttctaatacggcaagggttgcaaatatttatgttaaactccattcaagggagtttggtgacatttttgtgagtgattggtagggcttgtggggaccatgtcttgcttaaatacatttagaatcatatctctttgaaagcattgtgcctgccaaacaaaacatatttacaagctgaatctaatcctaaggctaagaatttgcaacctttgatctttagcgacaaacctgaatgaatgctgttggactcagcataattatataattgttattaacagctcagcttagtaactatcagtaataattaggcgctttcaagtgtttgcccttaactactcattacactttcattatatggcctctgttctgtttttaagtataattatccaattgtttcttttagttttataagccacctgaaattataaatagattgtacataaaataaattgtaaaattagttcagtattgctatctttttaaaaaagtgatggggtctgtgttgctcagactggcctcaaattccagagctcagataaccctccccactcagcctctaagtagctgggagtaaaagcacacgccagccgggcgcagtggctcacacctgtaatcccagtgctttgggaggccaaggcaggtggatctcttgaggtcaggagttcgagaccagcctgaccaacatggcaaaaccccgtctctactaaaaatacaaaaattagctgggtgtggtggcgcatgcctataatcccagctactcaggaggctaaggcagcagaattgcttgaacctgggaggcagaggttgcagtaagccaagatcgcgccattgcagtcaagtctgcgtgacaagagtgaaactccgtctcaaaaaaaataagtacatgctgctgcattttaatatttaatattactatttaatatttgatactaatattttgtctataatattgaagtatatatttttacctgtttggaagttgataaaaatttacttt

SEQ ID NO: 1246 - DNA, 1070 bp, Homo sapiens
ttgttaattgtgattttaagaatgtgaatgtaggatttacaacaaaaaattggcactctagccactttaaaccaacaggctttaaaccaacaaagatcaaaagagaccaagaaggccattacataatggtaaagggatcaattcaacaagaagagctaactgtcctaaatatatatgcacccaatacaggagcacccagattcataagtcaagtccttagagacctacaaagagacttagactcccacacaataataatgggagactttaacaccccactgtcaacattagacagatcaacgagacagaaaatcaacaaggatatccaggacttgaactcagctctgcaccaagcagacctaatagacatcgacagaactctccactgcaaatcaacagaatatacattcttctcagcaccaaatcacacttctgccaaaattgaccacatagttggaaataaagcattcttcagcaaatgtaaaagaatagaaatcaccacaaactgtctctgagacaacagtgaaatcaaattagaactcaggattaagaaactcactcagaaccacacaactcatgaaaactgaacaacctccttctgaatgactactgggtacataacgaaatgaaggcagaaatgaagatgttctttgaaaccaatgagaacaaagacacaacataccagaatctctgggacacatttaaagcagtgtggagagggaaatttatagcactaaatgcccacaagagaaagcaggaaagatctaaaattgacatcctgacatcacaattaaaagagctagagaagcaagagcaaacacattcaaaagctagcagaaggcaagaaataagtaagatcagagcagaactgaaggagatagagacacaaaaaacccttcaaaaaatcaatgaatccaggagctggtttttagaaaagatcaacaaaattgatagaccgctagcaagactaataaagaagaaaagagagaagaatcaaatagaggcaataaaaaatgataaagaggatatcaccactgatcccatagaaatacaaactaccatcagagaat

SEQ ID NO: 1247 - DNA, 1028 bp, Homo sapiens
ccctccatggttaaaaatagcttggattggattttctttctttttttttttttttttttttttgagacagagtcacgctgtcaggctggagtgcagtggtgtgacctcggctctctacaagctctgcctcccgggttcaagcaattctcatgccttagcctcctgagtagctgggattacaggcgtgtgccaccacgcctggctaatttttctgttttttgtagagacaatgtgttgccatgtgggccaggcttgtctctaactcctgacttcaagtaatccccgtgccttggcctcccagagtgctgggattacaggcatgagccaccatggtcggctggcttggatatccttaatgtctagtatagtaactatggtattttgaagggttgtctctccattgtgttgatttgttaattttataaatttgatattttataaatatgcttgtccagcttgtatttaaatatgatattgtatagctatacatttatttaggtcctgtacacttatgagggtactcttttaaatttaaaataaaaaatacagatgagaaatacatagtctgagttggttaagtgattcttaggtgctagacactgtcaaacgccttatattaattacctgttgattcctacaaccctaaaactaataacaatatgatatttattgcttcatttttaatttttaagaggcagggtcttgctttctcacccaggttggagtgcagtgccacagtcatagtttactgtggcctcaaactcctgggcacaagcgatcttcctgcctcagcctcccgtgtagctgggactacaggcgcctgccaccacgccggccaattttttttgtatttttagtagagacagggtttcaccctgttagccaggatggtctcgatttcctgacctcatgatctgcctgccttggtctcccaaagtgctgggattataggcgtgagccaccgtgcctggccatgttggtgaatttgatatacagaacttagaataatgcctttctgaagtttttag

SEQ ID NO: 1248 - DNA, 1062 bp, Homo sapiens
acctgtgtagttagaaaaaagcaatctctaattatatttacctatagagtttatgttctccagatgtgtgacaattacatagtacttggacagtatccaagtatgataataaactgtctgaaattggcctaatctacatttaaccaaagtgtatatattgtgggtttgtaaaaaattgttatttttttttatgttttgggtgtttaggctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataacttcaagtttataaaaatacagtgaaatttctacaaagctctaaatctgcatttgcatttcctctgcccttttaactaaactaaaacttgtgaattttaaattattaaggggggggtgctgtgtgaatcagtagacattggattgggttggtgaaagagttcagttctgtagtatctgaatttgtcttttaaaatgagtacatatataggcaataaatatatatgctcagatcaatatacttgtttagaaaaacttcaagacattcaaaaactaggaaggagtatgtttaatagtatttgtataaatttggtggttatgtttttttattttgtttctgttttgtgtagaggtaaaaactatagttttattacagcataattcattttgagctccactatgacatttcaaaga

SEQ ID NO: 1249 - DNA, 1335 bp, Homo sapiens
ttgttatacatttattaaatatacttcccccatgaagtgaaaaggttaattttgctgaatgttttaagttgaagttacttcatggatgtcatacccatgaagtgcatttggatgagatagaagaaattgttttttaaaaagtttaagtaccaaaggtagtctagtctagaacgataagttaatacgtgttggcttttctaatttgtactgtaacatccttatactttctattttaagtatatctgtttcttaagtaaacaacttagatattttccacacctttttttttttttctgatgcagagttcaggttaatattttactgcatctgataatgtattatacgtttgaagcctagtgacttttcattttgacattcttgtgatttcatatgctgtattcttcaagcaataaaattgtgatgtgttttataaatggtttttatatttaatgttctatagagagatttctattattaccatttttactattttcaagaatcttaggcccaaaagacattttggtcatttggtatgtagtacctgccttttgtttttgtttactgttatttcaaaaaatgtggttttacttgtatttttataatttacagtcctaagatcgaggcataacaaagcttacttatgcaatattttatttttaggttttttcttttttttttttttttttttttttttttagcatttaagagtcactattatgttttgccagttaaaattttttaaatcttttgaagagagaaacaaaatcttcagcgttcttgagaaataaaattattgttcagtaagtatttttccatccccttgaatatatgttatatattctttttcggcagattatcagattagtaagtgtttaaaaggcatcagtttttaaaactgcatataccacacacacacaaaacagtacacaaataaaggttttcacaaattaaacaaactcacatactagtcttcagatcaaaacacagagcattatgtgtaccccagaagccctcctctttccccatcttaacactgtcttctttcttgctgaaagttactatcctgacttctaaaatcatagattagttttgcctgttttttattttatgtaaatgtaatcatacataatacactttttttcattcatcatttttgtgaatattttagtttcttgttgccactgtaacaaactaccacaaacttagtgacttaaaacaacacagatttattcttttatagtcctggagatcagaagtccaaaaatcagtttcattaggcctaaatcaaagtatcagcagggttggctctttattgaggttgtgagggagaatgtt

SEQ ID NO: 1250 - DNA, 1048 bp, Homo sapiens
aatttcgtctgtctttattataaacatgttgtaagtgaggaaactaagattccaagaaattaagtactgttggccctctgtgtctgggggttccacatctatagatcgaccaaccatggactgatggattgaaaacatttggggaaaaaacaaaaaataacccaacaatgaaatagtataaattttaaaaataatataacaatatttatatatcatttacattatgttagatattataatctagagatgattagcatccttggattttggattttggtatccttggggtatcctggaaccaatccctggcggataccaagggatgactgtaatataataacatctaacaagtgaaggatttgaaccccaatgtaagtaattatgaaaactatttttcttccactagaacttttttccccaaaaatactctggaaatactggaacaaatactaaaataaatgacctttatttgaagatcttttaaaaaaattataagcctgcctgaggatagcaaaattgtgtgcttttgcaaggtaattgtagaactcattctaaggaagcagaggtaatgtctgttactattttcagctccctttttctgtccactgttgtctaaatgattcactcagtgttatgcagaatatgagaagttattttataaagttgatttgtggtataggctttacatatgtcttttcttttggtcaaaatactaaagaaagcttatagaaaaagtgacctggtgtcaggttttagtttcatccttatccaaatgttgcagaattttggaatcttttggagtacactttctctttaaaacaagcccatcacctttagtatagtggtgagtaaaaataaaataaaaacaaggccaaattgcgtttttctaaattgcaagttccctgttttccatatcccagtaacaaacctactgttgtgcaaataggaaataacatctagtagctactttagcaatggacgtggcaaaataaataaattagtagctatggctcattatttaggatttaaatgagccataactactata

SEQ ID NO: 1251 - DNA, 1425 bp, Homo sapiens
aagacaggaaggaagaaaagaaggaagaccagaaaacaaataacaaaatggtaggactatggccttacttatcaataataatattgaatttaaatggatgaaaccctccaatcaaaagacagagtaacttaatggattaaaaaaaaaaaacaaaacaaaaaaaacaaaacaagaccaggctggttactgtggctcacacctataatcccagcactttgggaggccaaggctggaggatcactggagtgcaggagtttgagactagcctggacaacctaatgatacctcctctctacaaaaaatgttaaaattagctgggcatggtggcacatgcctgtggtctcagctgcttgggagactgaagcaggaggatcactggagcatgggaagtcaaggctgcagtgagctgtgatcacatcactgcactccagtctggggaacagagcaagaccctgtctcaagaaccaactcctgccagccccctcccccaacacacacactagcaaaaaagacccaataatcttttgcctacaagaaggacatagaatgaaaataacgatgcacatagactgaaaataaaggcaccataggctgaaaatataaaggcacacatacagtgaaaataaagggatgggaaaagatattttatgcaaatggaagccaaaaagcacaggagtagctatacttctatgagacacaatagatttccagacaaaaactataaaaggagacaaagaggtcattatataatgaaaaagggtcaattcagcaagaggatataacaattataaatatatatgcacccaacactggagcacctaggtatataaagcaaatattattagagcttaaagagagaccgcaataaaatgatatctggacatgtcaacacccccgctttcagcactggacggatcatccgacagaaaatcaacaaagaattattggacttaatctgcactatagacctatggacctaatagatatttacagaacatttcatccagtgcctgcaaaatacattcttttcctcagaagatggatcattcttaaggatacatcatatgttaggtcacaaaacaagtcctaagaaattcaaaaaaattgaaataatatcaagcatcttctctgatcacaatggaataaaactagaaatcaataacaagagaaattttggaaatggttatacaaacacatggaaattaaacaatagtggccactatgaccaactatatgccaataaattggaaaacctagaagaaatggataaactcctagacatatataacctaccaagattgaaccataaagaaagtcaaaacctggacagaccaataacaagtaatgaaaccaaagccataataaaaagtatcccagcaaagaaaaatatgggatccgatggcttcactgccgaattctaccaaa

SEQ ID NO: 1252 - DNA, 1671 bp, Homo sapiens
gtatttgatagcacaacagggtgactgcagtcaacaataattatacatttaaaaacaaaagagtgtaattgtattgtttgtgacacaaaagataaatgcttgagatgatggatacccatttactctgatgtgattattacatattgtatgcctgtattaaaatatctcatgtaccccataaatatatgcacctgctatatacctgcaaacaaaaacaaacaaaaacaaaaacaggaaccctgccggcaacagagtctaaggaaatttctgtgttgcctagcccctgcaatacagtaaaagggtaggcggagatgatgctgaacacatcacaatatctggaacacagcattataaatatagtttatgaaagaaatatagagacaaagaaatttgtctctaatgcttttaaatatttcacacaataaataagatcttaggtaactttcagccttaatatttttactaataaattagaaaagctagagggaacttcctcaacttggtaaagaacatgttcaaaaaaagctaacattacgcctagtggtaagaaacctgatcctttccactgagatcaggaagaaggcaaggatgttccctctcactacaccttttcaacattgttatggaagtactagctaaagcaatgagacttttaaaaaattctttaaaaatattagaaaaggtacctgacaaggcagtctttcaaaggtacaaaagtagatctttgagcctatttgacagaggaggaaagtgtgtatgtgcacatacacatatgtgtgtgtgtaagtgaatgatacacacacattatatatagtatattgtatgacaaaaagaatactgtggtttgtgaaaatggaatttgtttgtttttgccaaccaatcactctatgattttgatagaacactggtagaattctgaaagttgaaatacagcttcattaatgtgtattaggcattggcactgtgctggaaactagggacacacagatgcaaattatacacctcaattcagtaaatgtttattaattatctctgcactaggtactgggtctaccaagatgaattaaggccagatttctttctgcgaggtcctcataatccagtgagaaagactgataagcaaatgattataagattgtgataagtatatcgataaattgaaagtatgaccacaagaaaaatattgaacggtaaaattttaaaatttaagtgacaagaaacttggaggttacttaaaattacccaagaagatgtcatatccaggagaaaaaaacgtttgctctggaatgaaaaacatcttgggcagttacagttgagggatttggggttcttaagtgtgtatagaatggtcactttgggaaatacagaaagatttttttttaaaaaaactcatctgtaatctcaccacacagttccccgtaacattttgatatacccctttcttaatccaacggcatctctttttaaaaatggaaataatgtaaaaaaacagaggcctaaaagtccacaaaaaagtgacaggttgcatgttacatgtatgttagaagttattcagggaaaaaaagagagagagagacccatttgggccaggtgttttaaacttcaaaatacacacctgaatgcaatagcttttcccaattctcatttctttactattatttgcccttcacc

SEQ ID NO: 1253 - DNA, 1038 bp, Homo sapiens
aaggtagtggctttgatttataaactagcagtactcttaccagctagcaaagtaatgaagagtcctgtgattctgggatattttctatttgcatctaatacagaatacagaatgtgaatgtgcttagagaaggataagaagtgagacaatcagggtcttgtattagttacagggaaatactctagctccagttctttagaactatgccaagagctaccaagattgagtagaagagataaaaaacatctggaataaatggaaagattgtcacatctagtctctaacacataaccatgattctaaaaataatacatacaaaattcagtcattcaccttaatagaattatcttgtaggccacggataatttttcatcatcatactgtaaacaatagacacctttactcttttcagagtggcactgaatcctttgtaaggtgtgtcatccacactgccagttagattctatagtctctataacctggataatctttgggtataatgacctatgaaatgaattgggagggccatctgtgggtctgtttttaaacaggtgctgtcccaccctttttctgaaagtcccttccatagaggataagcgtgtaccattcgttcaatcagcttcttccaaagcattcattctgaggtcacttgctgccattctttacataccagctctgctgcacacagagacctggcatcgaaataactttttctgctatgtgatctaagccttgatctggtaagtggtaaagtcctgctgcaacatgggctttgggtaagagttaatacacccatactgatagtgacaaatttgtgaactaagatgttccaaatagccttagttggttgggcctttaatctgggacctattaatccactcagagttttaaaaaaattggtagaacagccgctgtcttaaattgatacattgcctccaggctaaattttagttatcctttgtcattccaaacatttctcaaatttgtctttcactatttgaggttgagaagaagtagttgcctctttcaactctacaa

SEQ ID NO: 1254 - DNA, 1070 bp, Homo sapiens
cggccgggggtctagggggccgctagtccgtgctcccgcctttgccgccgtggtgcagctcgggcggcgcccgggacggccgggggagcagcccgcgggctcctgcgtgcgccgtgatcccctcttgttccttctccctcctccaccttcacttttcccgacgcctggcttcgcgcccggcggctcctctcttcctttgtatctctcctcccggaggcgggggagggggcccattgtccccaaggggcgctgttcgagggcggggaggggaccggccgcgattcctcgcccgggccaggtccgcggggctagggcgtcgcccgtctggggcggcgccgcccagagccctcgccccaggtatggggacccaggcggctttgttcggagcccggcctcgggccagccaggcccagcccacacgcacatttctctctccctgcctcagtgcttcgggcgggcacagcttcgagggactccggtttggccacccccggctgcagcctttgggctggtgggttggttttgggggctgaattaaatcgagtgatcgatgaggaagctaattttaccaaaaggagcgtacggtctccctgttgctttacttccctttccgttctttattctcacttgttctttctccttcgttctctcctttcctttcctccttgcctttctttggcacaggaggctccagacaatgcccagtgtctggccaaggtacgggcggagggtaataggtcggagaatttgctcctggcgccggcgcggaagggtcgaggtgtggagggcagtgatttctcaggtgcggagggcagtgatttctcaggtgcggccgggagaactgggggcgtgggggcgctgtcccgagagccgcctggcctcagccactcccctttttattccacctgtgcctgttttccgtgccttttgttcgcgaggatctcgtgaaatcactgcagagaaaggggagaaataacttttgagtatgtgtgtgcccagctagggtgggagtgaaagccaatgggttaattgaaaggcaaaatgttttcttatttttcacgtctactcat

SEQ ID NO: 1255 - DNA, 1046 bp, Homo sapiens
acacttaccatattagttcgtttaatccttccagtcatttaagatacataaattgacatctctccattttactaatgatgaaacaaggcagagaagttaaatggcttgcccaaggtgacacagctaataaatggcagagtctatatttgaacacaggcagcctagatacagaatcagtgcccgtaatatttgtaccatattgcctgacatgctcacttgcattttgaaaagatcactttaactacaatgtgaaaaatagattagaggataattagaaagcacactgagagatcagtcaagaggctattgcagtattaaacaaatggtaattgtagcttggagtagaatgatggcaatagagatacagggtagtagatggctaattattacaaagtgagtgtatcctgtgtgaataaatgaaaaacgaatgaatgagctgagacacatgtataatatggcagtgtgctgtcttactgtacagtgtttataagcaacaactgctgaattatctgttggaataaaaacgaggtgaatgtaaacctatttagatttgtgttaccaccaactaaggtttttgtcttaaatagatggtagaaaaatgtgttaatctataaaatagtagcttgtatatgttcattctgcaaactttcgggtgcacttgatgctgtaaagctcttctatttctcattagacctttaaatactcttcagcacaaaaatgaattgtagtacaaagctattactgcttctcagaaaatgaagaatgctctaaagataaatataaatgaattaaaaggaagagattattcactctaaaattgaaaatcataaccttcctgaacagtaaaggcagataagcagaataaatacttgagtctaatttgaaaaatccatatttctatttcagatgtcctactataaccataccctgcattagtgcattttgtggttaaaacatttttattccagaaagctaaaagatgtaataagatacaataattgtttttaattctgccttttctgtttctttaacagtcctcttacttt

SEQ ID NO: 1256 - DNA, 1066 bp, Homo sapiens
ttatagacctccccccaggaatgcaattcttttccttcctagggtcttagtgttatattccttgctaggaaaagaatttagcgatatctctcctacttgcacattgatttataggttctctgcaagaagaaaaatatggctctattctgcccaaccccgcaggcagtcagaccttatggttgtcttcccttgttccctgaaaatcgctgttattctgttctttttcaaggtgcactgatttcatattgttcaaacacacgttttacaatcagtttgtacaatagtggtcctgaggtgacgtacatcctcagcttacgaagataacaggtttaagagattaaagtaagacaggcataagaaattataagagtattatttgggaactgataactgtccaggaaatcttcacaatttatgttcagagattgaagtaaagacaggcataagaaattatgagagtattattagggaagtgataaatgttcatgaaatcttcacaatttatgttcctctgccgcggcttcagctggtccctctgttaggggtccctgacttcccacaacaatccctttccccacaaagcatgcagttcttcattttatgattttactgaacctcagaacaatttagtgaagagaacaatttaacaaagagaaatgagtaaacctctagtggccacttgttccatccgcataccaacctaagtctgaataccttggacacatcaacaatgctgttgtctttttcttgccatagcgagtggaaagactctccaaaaattttaactttcacaaatgacttaatcttttgagaacccattcctctatctataaaaccaccaacttcatagggttgttgtgggtgaagattaaatgagaaatgcatggaaattttctctagacattgatgcattggagtgtgcttcccttcaagtgtcttcctactttcttgctgatgactctaggggtcctgtaagttgggtctcttagagtctcttaatttttttttttttaattttttttgagagggactctgtcgcccaggctggagtgcagtggcacaatct

SEQ ID NO: 1257 - DNA, 1031 bp, Homo sapiens
ggggagctagtagaagagcctgggtttttccttttatacctcattgcttctctgtacaaataccagaagctgttaaaaatatctgtggataaaattttagacttttgaaaatgcatttttatcttccttttccaggatcagttcgacagcttagacaagcatacacaatggggaattgacttcttggaaagatatgccaaatttgttaaagagaggatagaaattgaacagaactatgcgaaacaattgaggtaagttaatttttttttcagtttttagaatgaaattacatgtttaaacagttgaatattagaggaatgtgatagtccagaggttaaattctatgtttttcatcagaattagattgaattaggtaaccggtttgttttaatgattaattaagtcattggctagtacagtaccacaaggaatattgactagctggatcacaaatagctttcattccagaaagacacttaaaaatctgaaaactggggagcaaaatgccgggaaaaagaaatatctgcgtgttattctgtgttttatacttttattcctctctaactttttgctttagtcatcttttcaaagtattgaatatttcttcagagtttttttcttcagagtttgtaagacttggaaatagagtgtgtgctgagctgagtttctttctgtcagtattcagttacatattatgaatgaatgtgattttagaatatgttttggaagataaaagttttaaagagaaaattttagtcttaaaactaatggactttgttgacaagtagttgctggaacttattcagtaaaaatggtgcttgaagtctgaagactagacaccagtataaagttttagctgtagggtttaggataaaaaagtgtcctgaagtgacaaaaaatccaacctaaacaggcatacatgactacaaagtccaggcatattttgattcaggggtcaaataatcttcaggccccatttcttggctgtgctccctcttgttctttttattctcaggttccattcataccat

SEQ ID NO: 1258 - DNA, 1048 bp, Homo sapiens
agtctgtatgataactgtaggcatgcctataatcacttctaaaagctctgaacacttgtttgaaagactttgagaaatcatatttgggatttctattgcctgagttacaaggctagaactcattcccatgttgcttccctatggcagtttatttattacttatttttaatttaaaattgttttaaagagatgtggtcttgctctgttgcccaggctgatctcaaactcctgggctcaagcagtcctcccacttcagcctcccaaagttctgggattacaggcatgaaccactactcctctggcaatttagactacactaaatattatattgttacataaatcatgagaaattactatgtagtagtcacgtttttgtaatcatttgtatatcctatataatgagtctaccaggcccagttaaaatagtcatattttacactatatagtcatagtcatattttccacatgtagtcatagagatgcgaggtaagtgtaattctaaggaaaaaaaaaactcaggcaattagagctatgaaccctggagagaagcttaaatatgtgtcatcttattttttttttttttgaataagtttgtaggtagaattttataactgtaaaacttaaaactatttgcttattgtttctcacaaattatagatattcataagttatttacgtaagatagcataagttatttttgtagggatctagttttagaaggctgaaatcccctcccagatttattattagctataccactccagagaagaaagcagtgtgaaagagaaaatatgacaaaccaactaggggtttagaggacagagcagggaagaaagtggattacaacttggaggttgagaaatttttttcttttgattaccgtttggtatttactagatatttatctcaaaaattaacctatagagattttttttccacataagaattttctcaatatagaaaaattcaaaaagaagaaggtaagctttagtaagcctgcttatatgtttttacatggaattttcagtctattaagattacaaaataa

SEQ ID NO: 1259 - DNA, 1047 bp, Homo sapiens
aatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttt

SEQ ID NO: 1260 - DNA, 1139 bp, Homo sapiens
taacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaattt

SEQ ID NO: 1261 - DNA, 1058 bp, Homo sapiens
acctcaggccacccgccttggcctcccaaagtgctgggattacaggcgtgagccaccatgcctagccaccacattttctttatccagtcaaccattaatgggcacctgggttgattctgtgtctttgctgttgtgaatagtgctgtgataaatacacgagtgcagatgtgtttttggtagaatgatttcttttcctttgggtatatacccagtaatgcaattgctgggtcaaatggtgtaattttagttttttgtttttttttttttttacttttcagtagccattctgactggtgtgagctgatattgtggttttgatttgcatctctctgatgactaatgatataattttttcatgtttgttggctgctagtatgtcttctgagaagtgtctgttcttgtccgttgcccactttttaatgtagttattttcttgctgatttaagttccttatagattctggatattagtccttggtcagatgtgtagtgtgcaaatatttgctcccattctgtagattgtccgtttaatctgttgatagtttcttttgctatgcagaaactctttggtttagttgggtcttagttgtcaacttttgttcttgttgcatttgctttagaggacttagtcataaattctttgcttaggccaatatctagaagagtattttctaggttttcttctaggctttttatagtttgaggtctttcagttaagtctttagttcatcttaatttttgtatattgtgataagtaggggtccagcttcattcttctgcatatggttagttttcccagcaccatttattgaatagggtatcctttccctattatttattttgttgactttgttgaagataagttgtaggtgtgcagcagctttatttcaggggtccctactctgttccattggtctattgtgtctatttttgtaccagtaccatgctggtttggttactgtagccttgtagtatagtttgaagtcaggtaatgtgataccttccactttattctttttgcttaggattgccttagctattccaactcttttttcgttc

SEQ ID NO: 1262 - DNA, 1050 bp, Homo sapiens
cgtctcgcagcccgaggggaggccgctcggcctcggccgctcacaggcgcgacgtaaaggcccggcgtcaccggcccggcttaacggtgcaacggctggcctgggcctgcaactctggggtcccggccgggctggagcggccgccggagagacctggtaggcggggcgcttggggcaggaagggagccggggagggaaaagcgcgactgtgattcgtacggctgggcccggaccgtgaaggggaccgggttgcggctgccctcacaccgaccaggtgggaccgtcggactgcggccgcccttggctcaactgggtcgccgaccttgttgaggggcgaccactgcggggagaccgagagcctgcggctggcgtttgaggcggatggcagtgccctgagcgcggcggctgggtctcggtgacactgacgacgggaggcgcggtcggaagagcgcggggccgtcgcctctggcttaacatagcagatgcgctgagactccaacaggtggctccgtggcgcaatggatagcgcattggacttctagaggctgaaggcattcaaaggttccgggttcgagtcccggcggagtcgtaacgcttttttccctcccccctacaatttattttctgcctccatcatgtctcttattttttttttttgctaaacggtttaacttctctctcattccctgctctcgcagttcactgcattcggttcttgcggtcctttcttaagcggctcgcagggtcccgagcccctcagctccccgggcctcggtggcccagggcccagctcagccgactgggcagtcgatgtaggtcctgagaagagcggcggcggcggcggcggcggcggcgaaggaaaagcgacactgaagcgaaggctcgcggtttcggcctaaaggaaagtgcaggggaggcccgggtctcgggtgacacccccacgccttgagcgggactgtggttgcgagggagggacgagaaaacacgcctacgccctgcgtgcgctgtgctgactacctctccagcatggaggcttccagatgagcagac

SEQ ID NO: 1263 - DNA, 2078 bp, Homo sapiens
tacacagtattttgttggaggagattgcagattctgagcagataatcatgaagtttaaattgttgaggtgaaatgattgaactattttgaaaccattaaaaatggtattgagtgtatttttgtagatattgtacttccagaagcttacaaatatcttttagtcaccacctttggtatcacagtttgaagattagaagattctaactttatatttgagtgggcttttgaatatctttggtaacagaactgattaattttaatatctggtgcttaattaaggaaactgtggctacttggccttcttttgtctatgttgttaatagtaggttggttttagaatatatattcccttagaattggataggtaatagagctagtaaaatcactttaaaagttacagtgtaacattattccaaacattgggagaatgagtaattaaatgttctgggttacttttaatttttgttaatgtaatttttttcactcagttaaatctcatatatatgtgtgtgtgtttctgaccttttattgtggaaaatttcacacatataaaaaataaatagaataatacaaggattgcccaatgcactttacccaaggagtaccaacaacattctatattcttgtttcatctatttcaacctgcctgtcaccccttatttttataggttttttaggtaaaatttatatacattgaaatgtacaaatattagttgtacattttttaaacaaatggatacactatgtaacacatccctatgacaaattagaacatttctatcccaccagaaagttcctttgtattcattcctgatcagcttgtattcactcctgattccagcactgctaagctaactttttcaccttagtttgcctaatcttaccttttattttattatttatggggaaaagaagaatctttttactcatggataaagagggctatttaaaggaagtgtctatttcagaatgttatattactgtactgggagctataagatgtgtgtgtgtgtgtgtgtgtgtgtgtgtattacaaaaatatatgacttgttttctcagggagcttaccttcttgttagggaaaagaaacttaaacactgatagcagaatgaaatgtacagatagacatgtcttagaagttttgagaaagacaagattaatgtgtttgggaagggttggggaaggcttcatgaaggatgtgtgttaagcctagaaagggggtaggagtggataactggaataaagtgactgttacagcatcctttatcagatttttgttgcatttatgttagaaagaaactttgtggtgccctttcaatccatcttccactgccaccagagctctttttaagaagctcagatatgatcataatattccttcattaaaatcattaatctactctaaaatacaaactttctgtattcatggtgtggtccttccctacttttcccactcatccaaccataagtgctgggattacaggcatgagccaacttgcccagctgatacttctttttcttcaagactcagtcaacactttgtcttaggtgttttctgtctttttctgatttccaaactgatgtaagtgtcctctgcttttatgatactgtaggccaggggtccccaacccccgggctgtggactggtacaggttggtggcctgttaggacccagctgcacagcctgtgcaagcgagcattaccacttgagctccgcctcctgtcagatcagcaggggcattagattctcataggagcgtgaacctgttgtaaactgcacatgtgagggatctaggttgcacacttcttatgagaatctaatgcctgatgatgtgaggcaaaacagtttcatcctgaaaccatcccccaactcaaccccaatttgtggaaaaatcgtgttccgcaaaactggtccctggtgccaaaaaggttggagactactgctctaggtatcccctactctagcacttaccattctgtattgtactagtttgttttcttggcttttgcctacatcagatcctgagtttcttgagggcatgaactgagtcatctttaattccctagttcggctctgt

SEQ ID NO: 1264 - DNA, 1034 bp, Homo sapiens
tgtacatgaccttcataactatacttttaaagaaatacgtaaatattcctctgtgtgacaatatcttagtttattttcctgttagctattgaggatctagactgtctctggaatttttatggattatactggtgtatttttgcaagtgaacattttcatctctgctgaataacttccttggaataaattgccagaagtaggattaatgaatggaggcttatgaatttccttagtgtttgtggaaactgtgggcattcttaaactacacaggttgatgtattacttttcatgagttgtgccaatttgcagtactatgaatgaatgctgacttaattacctactcatcattaggggatatttaaatttttttctactttacggatgcaaaatagtcttgaaagattattttaatttgcacgtattttataatttgcaaaaatgaacatttttttgtgcagctacttgatctttattatggaggtagtttggcatagtgttaaagaatagtctttagagtcagatgtaggttcaatttttcctttggccgtttgtcagatctgtgaccttggtcaatttacttaacctctttgaacctcagtagaacagggatagtagtatttactcactcactcagcagttaagtgaggattaatggagaaaacgttttaacccagtgctcagtaaataaaaggtagctctcatttctatgcttgctaaaagaaaactaaaaggacaacaaaacatacctttgttagcttcttaaaaactcccgagccttcctaatttcctcagatacacccatgaaaatctcccaaaggaagcctttttcaattgatagaatcatttactttcagagttggaaagtatcttaagttagttttatgtgacatggttttaggtttctgtattttttcagttgctgcttcctgaatatgacagtctttatttctccaccttttaaagaggcattgctaaatggaattcggcattcaaagtgtcttctcactggcacactagcagagaactgtgaccta

SEQ ID NO: 1265 - DNA, 1065 bp, Homo sapiens
tacctcggcctcccaaagtgctgggattacaggtgagagctaccgcgcccagcctgaatttttttttttttttttttttttaaacctgggtgcaggtctttatacttatttttggttgggcacattacttcttccctctgaaactttttgatctgcacaattaattactattccttctgtatgttttcctaacaaacttaaaaaactgattggacaggactgagtatagaacagtatgtttacaccactataatctttctattaattgacaccctttggttattgtattggctctcatttttaacttaccagcatcttttcacacatttccttctggtagtagacctggcattctgacagtatccataacctgatgcatactgggccagagtcctcttttgggatgtttctgctggagctggtgtggggaagggtctttctttcctgtcacagaggtgtgaaggtagaccctagaactgtattagccttggtctcttacatggaaagggcagaaaccctgattttgtttatcatcaaatgctttgtagcatagtgaacaaaatttacaaaaatttcgtggtccctttcaaagaaaagaatgaccttagtctgacatagttttttggtgaattcatattttctcctaaaagttaccacttccttctaagtacccatgccatactgcccatttagataagtaagttgtaacttttttcctaggatcaacatcacactcatccatgacctgatgaatatcaccttctaatctgtttcaatgtaatatgaacttgaattatgaaggagaaagataggatcttcctacattttctttggaattttatctgctaaattaagtaaaattttacgggaaatggtatttcactatgttgaccaggctagtctcgaatttctggtctccaagcgatcgcctgccttgttctcccaaaagtatcaggattacaggcatgagccactgtgctcgaccctattagttcttttggaaagatttttatgtaactgttgtttaaaatggcatttatattatttctacataaaattaggcat

SEQ ID NO: 1266 - DNA, 1049 bp, Homo sapiens
aaaacaaagaacccaaagatcatgccaccaagtcaaagtcgagtgcttgctatgtaccagatgctgggttttcagatgttaagctaaaaagtaaattagacaagagttttgctgttaagaaactcatagactattgaaagagagaatgttgtatcttgacattttatatgaaatttctagttcaaaaaaaaccaacaaacattccctgataatattttatttaaaatatggtttgttgttgctttttgagacagactcactctgtggcctgggctggagtacatggtgccatcatggctcactgcagccttgacttcctgggctcaattgatcctcccacctcagcctcctgagtagctgggactataggtgtgcaccaccatgcctggctaatttttaatttttttgtagagatagggtcccaaagtgttaggacgatataggcgtgaaccaccatgcctggactaaaatatagttctttatttacctgtgaatacagttatgttgcatcaggaaattagatttaagatattttcaactgtaggactcgtgactttttaccccatcaacagtgcccaagatatattgtttagtaaagaggtggggtggaggaagcaagcatgggacagaataaatgaggtgatcccatttcttaagtatcatataatttctaatttaactgttactggttgaatacatttctgtatgtattttatgactggttcaagaaaatatctattctctcttcccccactggaggaaacaggaatgtgagaggaaataacaacatttatccagtacgttctgttgagcgctatatgtcaataggctaggctttgagataccaaattaaataaacgttatttttaactccagtcttgtggcactattactacaaatgcatagaaaatttgtacaactgagtatgagtagacctgtggtagtaacacagtttaattcttctggttgttacctgggagggtttcatactggagcttgaccttaagaaatatatagtgttttgctaaggggtaaaaggcattccaggt

SEQ ID NO: 1267 - DNA, 1038 bp, Homo sapiens
gtcattatgaaccttttgatttaattatttgtgcttcagtttattacagctcttgtccttatttttgctcaattgtcccatcttggaccaatgggagcctctttaagctggctccttagtgcttttgacatggctttagtgatctttgatagcttccttgctgtctgtagtaatatgttccaggctcctcttagacatttcctgacccagatctagaatcagctttttttcctaagaagaggttgcttccttttattgggaaatggtatttcaagatcacaattggaatttagggatgctcattgctactaggttggcagttgtttctaggcttttcttatggacagagccacgatatgcatactgacacttccaatccacatacaagatttcaagattttttaaattatcatcttctatttacatctgtatctccttgtatcccaaactgataatcctgattctcaaagacacagttgatggtcaaattagagtatcacggaaatattcagttgcgttatcccactttacacactcagtgttctccaaataataatacaaatatctctactattaatatgattactgaaaatagttaaatttttttcacataggctctttccattcttccttattttttggttgtactgtatctgtgttgtcagagcatattgatataggcatgcctcattttattgcactttacttttttgtgctttggcggtaatgtgttttttacaaattgaaagtttgtggcaaccctgcattgagcaagtctattgaagccattttaccaacagcatgtgctcacttcatgtctctgtatcatattatggtaattctcgtgatatttcaaactttttcatttatcatatctgttatgatgatctgtgattggacatctttgttgttactattgtaattgttttggggtgccatgaaattcaaaagctaggtttcttgtgccagttagccaagttgtgaatgcaaaggaaaagttcttgaaggaaaactgctccttcagtaaacacaagaatg

SEQ ID NO: 1268 - DNA, 1049 bp, Homo sapiens
cagatagaatctactcttggtgaagatgatgtgaacattgttaaatgacaacaaaggatttacaatattacataaacttggttgatgtgacaagatttgagaggattgattgactccaagtttgaaagttctattgtgtaaaatgccatcaaacagcatagtatggcacagagaactctttttgtgaaaggaagagttaatcactatggcaaacttcagtgctgtcttattttaatacattgccacagccaccccagccttcagcaaccactgccctgtttgttcagcagccattaacatggaggcaagaccctcaaccagcaaaaggatgaacattttttagcaataaagtattttaaaaaccaaggtatgtccattgattttttttttagacgtaatgtcattggatacttgagagactacacagtatagtgtaaacataacttctatgtgcactgggaaaccaaaatgttcacgtgacccactttattgcctgttagctttattgctgtggtctggaactgaatgtgaagtgtctttgagggtacactgctatgtattctttcccttttaactctcatttattcctagttctgcaagtaaatccatattgagtgctcactacctctttttaggtcactggctttatagtcattcttcttgtccagagcttgttctgtagtaaattcctcaggaagagctcatggaacaataatctctgaattgtttcatgttgcaaacagtttgtctgtgacctttgtacttgaaaatttgtctggatgtaaaatcctaggttcacattttctcttcttgaatatcttaaatatgttactctattgttttctgacactgagggttgttaacaaagtctgtggctaatctcttttgcttttcccttttaaatgacttggtcttttgtgtatccaaaggatttttttttcacattaaaaaaaaattctaggctgggcgcagtggctcatacctataatcccagcactttgggaggctgaggtgggcagatcacttgaggtcaggagtttgagaccagc

SEQ ID NO: 1269 - DNA, 1034 bp, Homo sapiens
ttatatcaggacaacagatgtaaacaaggaccattctgggcaaacttaattcagatggccactccattccaggaagataagtgctgaattttaaagacgagtagtaatcaaataagttgattgatgaagagtcctttaaagcaaaagagatagtatatgagcaaatagtggggtgagagagagcgcagtattaggttgaagcatgtgcagttgccattttataagtgagaaatggtcaaataattcagtttcacatagtttaacctgatagatgaaggtaacttgagcacagagtgtgcctcgtggcaggagatgaacctgaaaagaaggcaggagccagatcatgaagttctttgagtaccattttatggaatttggattttattctgaaagtcattatgtacatatttatttttaaattttaatgataaggtatttatctaatttttgaataggcagtacattcgcatggtctgaaattttaaaaaaatgttggtgtaagtgggaatagtttgtagttttctttgtggaatttgattttggtgtcaatggttttttttgtttttttttgtttgtttgtttgtttgtttttggagacagagccttgctctgtttcccaggctggagtgcagtggcacaatctcagctcaccgcaacttccgcctcccaggttcaagtgattctcatgcctcagcctcccaagttagctgggactacaggcatgcaccaccacgcccagctaatttttgtatttttaatagagacagggtttcaccatgttggccaggctgttcttgaactcctggcctcaagtgatccgcccgcctctgccttccaaagcactgggatccacccgtctggccttccaaagtgctcggccttccaaagtgcaggtgtgagcccgcccaagtttgggtgtcagtgttttacttgcagcaaaaataatgtggaagcttcttttacctgtgtcctaaaacagttaaagcattggaattatctgttcactgggggttttgttagaactccccggtaaa

SEQ ID NO: 1270 - DNA, 1043 bp, Homo sapiens
aatactgccatcttgctgtgaaatgtgcacaccgattttatttccaacactgtatttttgtgctcgttgttccttgtgcttcactccctcccctctgctacccactttaaataatcacatggcttttttttatttatgtctaagcttaaatgtcaagagacttttcagaccatcctgtgtgaactgttcttttttttcccctcatgaccctgtctagtctgtctgtaataatttatttattggtttattttttgtctatgtttctcccgctagaatgtgagctgcataagtgaaagaaccttgtctgtctttgaattttatgaggaagagagagtgaattgacagactgtatattggaaatgttaaatggtaaatctaggaatccaaaagtttcctctatttaatatcaggcaaaattctgttcaggattttttttttttaaatatggtgttaatcaggaagtggctaatacaaaactcagtaaacccttgaccttttttcagctgtctctctgacctcgtcctctgtgatggtaccttcctcacagctccagccaggttggccattttgttcttcctcaagcacgttgcaggtgttcaccttggtattttgcagttgctatttcttctgcttgcagttttcttcacccagataattgtgtggttccagaactcacttccttattcagtttttagataacattgttttctcaaaaacatgtttgaatatgaggagcagtgtaagtatgcaagtctgtgttttgtaaattcagtttttatcttgatagctgtttatgttgacttagatgaaacatggttctttaattttatgatatgtttgttatagctatcttaaaagggcttcttttttttaatgcagaaagaggggaaaaaggagcgagctgtggtggacaaggtgtttttctcaaggctcatacagattctgaaaatcatggtccctagaacattttgtaaagaggtaagtcttatgaaattataatcttaagtatattgggccgttctttaataaaatacctgaggctg

SEQ ID NO: 1271 - DNA, 1097 bp, Homo sapiens
ttaaggctaaaatgactcagttcaggaggagaatcctcacctcatcttcttccataggcttaggtgtggagaggagatagaaggaagtttttttaaaaagtaattagaggtatagaattgtaggcttcttatactcttgagtctctgtcattgtgtcaaggaaaccatgaaacgcgtgacaaatgtgtcatatcttatgggaagttaattttacttgaagtggttgaggtaggtggtaccttgtttttatgaaaaacgcaggtccatttcaaaatagaaatataaaacataaattgtttaggggaaaaaagagactttaaagaaatatttcaaccttgccttctagacttctctataaatatttttctctgccataagaggtactttgctgggaaagcttacatcattcctgtgtaatagaaagactataaatgttagggtcagataggagttatgatttcagctccctgacctgctggctctgcaacctttacaaatttacttaactacactgaacttctcttcatctataaaataccttttttttctagtcgtgatccctgtggcccttgtggacccatgcacatctgctcaggaaacgtggaattgttgtgaggatatgatggggttccagggtttcctcctgggagctggcactttgaagccggtgggacttagcctgcttttctgtctttaaaaggctgtatgtcaagtcatcactatccatctttttctagctgttgctttttcatctctttcttgtttgggcctgtactttaacttgaagtctgcaatgttggtcccagccctgcctttctgtacatcacagcaacttctttctctaatttcgaatttctgagaattcgtgcagtatgtcttttgcagccaggatacctatgccataggttgcagtccagcatatgattcagtcaggagtgtattcctgtgctccgatcagctgagctaggaacagaatctcaggtatagactgtggcttgagatgcaccagataagctcttagtcacaaaatgtccatttaaatacaaacattcagccatcatatactgtatttcaattattttccaagcataggtaac

SEQ ID NO: 1272 - DNA, 1066 bp, Homo sapiens
aagggatagatatgaagggggctattgcccagctactttagctggaatggccaagatctttcttgaggaggtgacatttagtcagaaatccacatgaaagtgaaggagtcacaaaatatagataccttagaagaatgtattcctggcagtgagaagagcaagaggaaatccttaagaaggtacatgtttgagaaaccgttatttctggagcttggtgaggaggagcaaagtagaagcatatgaccttaaaaatagagctcagtgccagatcatgcaggaccttgaataatctggtagatggacagtttgagaacactacaactccagaataaaaaagcagttttagacttgtagttttaagacaatgcgtgctcatgttaaagctaaaactgaggctgtgtggcactgatttacattagcactcagttcagattgggtgtaatacaattcttagataaagcacagaccatgtgtctccactgaaagcaaagcattcagtgccaatccggacagctagtgtttcactcaaactagttaatctctgttctttttgctttcgttgttgtcctcttttgggatatgtgtatccaaaagcatggtgactacaatagcattgtgctattgcatgcaagagaaacagcattgttaaaattgtttatgtaatttccatgctgtttgcataaaaatggtttcatgaagtgtttgtttggcacccgctctgtgaagagcattgtcctcggtggtgtgatgtacaatataaacagaatataaacagaaatcacgggcactcagtaaatatttgttgaataaatgaactatacagtttgttttatccttatagtagattcagttttttatacagagaaaaagatggttttttgtttttgttttctgccaggtggaacacctacataatttcattttgtttcggttttcaatgggcttcattgatagtattattgccaaatgtaagtatattttgaaagagatgagatttgtggaaaaggtgaaatactgttactgttttaaatcttacctgtttggtttcagaccttgccactgttgt

SEQ ID NO: 1273 - DNA, 1034 bp, Homo sapiens
ttataattagccaggagctattaatatttgagtctaaggaaatgttgattaagtatatgttaatttgatttaattacttcacagactgatttttttttttttttcaggttcgatctggggctaatgttctaatttgtggtccaaatggctgcggaaagagttcacttttccgtgttcttggtgaagtaagtacaagttggcctcaaaattttgcagtcttattttgccatactgtctaccactttgtaaattttacaattgttcttctcccttctctctctttaatagttatggcctctttttggaggacgtctaactaaacctgaaagaggaaaattattttatgttcctcaggtaagacctagcttgagttatctttgatctaaagatctttttgtttatttattttttcatgttgcttctaattgacttttgctctactactgtcagagaccttacatgacccttggaacacttcgagatcaagtgatatatccagatggacgagaagatcagaaaaggaagggaatttctgacctagtaagggaatgtttatatcctagatccactgaaaatactccagattatttattttaatcaattaagtattttaaatgccaggtagtttatcttaagctgtaaagccttccaaagctgtaaattgtgattttctaagctgaggtaagatgttaatcccttggcttaaaaagagtttaatcttaacctttacaccattgtttgttttctcattgccatcatccttttactgtgtacaatagtgttattctctttaagctactagacatattttgtcaagtttggtgtagatactaggagctgaaaggttcagggctaccttgtgccacattcttttctgaaatgtatcttttaagtggtacagacaatagaattatagtgattccagtttaaaaaataaaccactattaagaatgttggcttatattaagtttaatttcatctttaatcattttgctgaaaggtactgaaggaatacttagacaatgtccagttgg

SEQ ID NO: 1274 - DNA, 1052 bp, Homo sapiens
ccttcaccagatatatactgagccccccggcaacttgatcttggagtcccagcctccagaactgtgagaaataaattcctattgtttataaattacccagtctcagatattttgttattgtagcataaatggactaaaacaaggaaaaaaagaaacaggaaaaaaaaaacttcaagaaacttagctacttaattattttcagaaagtataatggttttatatatacagttgattcttgaacaacatgggttttttaactgcatgcatccacttacacatgtggattttcttctgcctctgccactcttgagacagcaagaccaactccccttcttccaccttcccaacctactcaatgtgaagatgatgaagatgaagacctttgtcatgatccacatccacttaataaatggtaaatatattttctcttccttataattttcttaaggacattttctgttatttagctttctttattataagaatatagtatataatgtacatcgcatacagaatatatattaattgactacattgttggtaagaacttcaggtcaacactaggctattagtagttaaggttttggggagtccaaagtgatgcatggattttcaactgcacagggggttcacactccaaatccccatgttgttcatggatcaattgtacatatgatttatttccctctgacatcgtgttctctggaacatattcttaatgaaagttttgaaatacagtaggcagtacagggtagaagttaagaaaacagccttgagtttgtctgctgtggaccttaggtagattatttacatgatctttgtaagcttcagctgtttcatttgtaaaataaggttgtgtgggatttaaatgataatatgttattatttctaaatatatcttcccaaggtgaaattaaacttgctttaaaaaaaactgtgagctaactacacgtattttcttcatattttatccagtctgtagtattctgttatagcaacagaaagatgaagtttactgccgggagcagtggctcatgcctgtaatccccaaa

SEQ ID NO: 1275 - DNA, 1028 bp, Homo sapiens
ctttaacttgaactctgttatgtactcttggaggagtaagggctgaagaaataggaaatagagaataaaaatataaaggataccctttttcaaagttcagtattttagtcgacagggaggaaccatagagaaatcttttctatagccatgagcaattccttgttaaaccttaagtaatatcatttatctttgaaagggagtgtaacaggccaggcgcggtagctcacgcctgtaattccagcactttgggaggccaaggccagtgggtcatctgaggtcaagagttcgagaccaacctgaccaacatgttgaaaccctgcctctactaaaaatacaaaaattagccgggtatggtggtgggcacctgtaatcccagctactcaggaggctgagacacgagaatagcttgaacctgggaggcagaggttgcagtgaaccgagatcgtgccattgcactccagcctgggcaacagagtgagattctgtgtcaagaaagggagtgtaacttaattatatgaacatagggcttcttcacctttcctagcttggtcttcttttcctcccatttggttcaatttaaaaagcagtaccatgaatattagaggatttatagaaattgggttgacttttatgcagctggcttcctgtagacttttacactcacgataatggttctttaacttgatgctcagaaaagaaaaagaggtggaacattttcttcatattatcctcctaagtctttttccctatatgtctcttcacatacaattaaaacaacaaaaagcaaaaactataactgcagttagctgagagctttatatacattcttttagatgcttaacaatttttacatgatggaaaagtcgaaaatgagtagttgacattctttttctttattttatttaatttatttttttttgagacagaatcttgctctgttgccaggctggagttcagtggtgcgatctcggctcactgcagcctccgcctcccaggttcaagggattctcctgtctcagccttccgag

SEQ ID NO: 1276 - DNA, 1039 bp, Homo sapiens
aggtaatgggggaattaacctgttgacagagctcagagaagacagctgaagaaccatggatgtgaacttgggagtagaggggtatggaagggagttagggaataggatgtgcacaggccttgtggaagaagggaacatggcatctttaaggaagagaaagaaggccatgttagctggaatgcagtaagtgagggcaggtgccaactgaggctggagaagatggagtcctcgtaagagcattgagaaacaaatgaaggttttaagatgagggtgggtaaggaagtgacatgatcagagatggcttttagaaaagattctcctggagccctccaatttgttcttcactctaaggagaccagtttggagacagtccagaaatgtgatgatagtagcttgagaagaaaatgcatctttttgatagttatttaagaagtataatccattggacttggtggtagattgaatatggtggcagagttggaaggtgcagaaagcaggttatcaagggtgactcctgggtttctggctgtcagatctgaatgtatggtgcaataggttgactatggtttgtccccatcaaaactcatgttgaaatttgattcgcaatgtattgatgttgggaggtggggcctagtgagaggtgttagaatcctgggggcagatccctcatgagtggcttggtgccattcttatagtagtgagttctcattctggcaagagtggattagttcctttgagagtgggttattataaagctgggacgccacccaggttttgtctctttacacatacctgcttccctctttgaccttctccactatgttatgacttagtacaaaagtttttgctagaagccagggccatgcccttgaacttctcaacttgcagaattgtgagctaaataaacctatttttcctttataaattatacagtcccagatgggcgtggtggctcacacctgtaatcccagcactttggaaggccaaggtgggtggatcactagaggccaggagttcgagaccagcccgaccaacatag

SEQ ID NO: 1277 - DNA, 1039 bp, Homo sapiens; identical to SEQ ID NO: 1276

SEQ ID NO: 1278 - DNA, 1033 bp, Homo sapiens
aattttaaaaattactaaaattacaagacatatttcttaaaataaaaaaattactctaggtttattatgagacaacaatttatagctgtcatttatcttaacaggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaaggtaaagcatatgaaaatgtaattgatgacaagaaactagtttatgagataaaattatttaaaatatttcaaaaaagtatttcatttaggatctaatgtaaggccaaatttttatttgatcttagaaataaaaggaaaaacaagtagatgatctcatgcaaaaaaaagtttaagaattcatatattgaaagatgttaggagaaatttacttaagtttctgaggaagtgtgtgaagatgaagtagactccagctgactgtggatgaatactagtactttcgtgttcttctttgaaatatttataacaaacatattctttggaaacaaagatggaagaaaaaattagttgtacttttgagtagcttataccatacagcattggccaacttagccagacctggggcagttagactctacacatcagggaacaaagtgtacagtcagtgcatatgaatcttttaatgaactttgcattataatttagagccctccagcatttattattttgttatataattttaaagtaaaaatttctttttagttttttttttttaaacagaaaagtaaatggagaaagaattagacatctattgatatagaaatctgctggagttttattttttatttttattttatttgtttatttatttttttgagacagagtcccgttctgtcgcccaggctggagtgcagtggtgaaatcttggctcgctgcaacctctgcctcccaggttccagtgattctcctgcctcagcttcctgagt

SEQ ID NO: 1279 - DNA, 1061 bp, Homo sapiens
caataatattttttgtttattttaactctggaaacaagttattcatttatgctttcaacaaatattatattacatatgattaggttggtacaaaagtaattgcagtttttgtgattaaaaataatggcaaaaatcacagttacttttgcaccaacctacatgccaggccttgtgctagattctgagggtttaaagatgctcacaacctggcccttgtcttagaggagccacaggagtgtggatgagacaggcatataggagcagagattttatggtaaagtagataatcagactaactgagggatgaacaaagtgctgtgggctcagagtggacagtgatgagttggcaggagaaagagttcaatacatttgaaaaacagtgcaactttcttcttatgtaataccttactcacttttctttcttacagatttgtccattataattttgtattggaaagtgattggtgacaaattttttataatgcatcattgtgcgtccctgtatgcatactaccttgtactggtgagttccaggattttctgtagcctaactagcagacaagattgggaatagtgatgtaaaggtgaacataaatctaaacatacaattcttagtttttaaagaccatctccagatgcattcagggattgcttttgtggtatgctatcttctgtattaactaaaataatacctttatgtgtgtctgtgttggtgttggtgtgtctgtttgtattcatagattttgagacagacaaatgaccctaattctttgaatttccatttaaaaccttcaggattgttgtagctatagatatttgtctgtatttctagatgcatttatgatttaacagcaaagagtatgagccagcgaaaatatttcttttctgtttaattccatgtgcaattacatatacataattacatttaagtaggttggagcagtggagaaatcttgctcagactttttcagaattccaagaccaaggttaatagaggattcttccaacagatctcaggcagtaaagcatattaaattatatatctaaaatttctacatata

SEQ ID NO: 1280 - DNA, 1081 bp, Homo sapiens
ttaaggtattataggttatataatgtcttgattgctatttttgtatctttctactatatttactgacgttttgaaattctctggcaaagtaatttagagcttaatgaatcctcttctgtctatatagagaggtacaaatcctacagccttttttcctgatactcatctttcacccctggagcaggatactaattatcaaataaacctgacaagctgatctcttattctaagagaaatgaacacatttatgctttaatcctcaatttttaaggacaaactaccatcctttgtacaccctttctgactacattgatagccttcactttttgtgtatgtgttccttgtgaatcacttctttctccaattaaaccatgcctttagataatgagttagaatatatttggaaaacatttaaacttgaaaatcattcaatatgcatcaatttccaagcccaccatattattattatttattttcttttttttttgagatggagtcttgctctgtcaccaggctggagtgcagtggtgtgatcctggctgggcagaagggataatggggaattactgtttaatggtacagagtttccatttgggaatatggaaagttctggagatggatggtggtgatggttgtataacaaaatgaatgtacttaatgccactgaattgtacacttaaaagttgtcaaaagggtaaattttatgtcatatatattttgccataataaaaatgttaaagcaagcttatgagataactgaaacaaagttaggaaggagaactaataacatattggacaatgttattacatttttagaaaggcttcatcctaactataaactgaaacaaatgggtggaacttaatagtgataaatgttaagttttgcatttaggttcaacgatgcataaggataaagaatgacctggaggtggtagatgattgcatctcagttatgccaatttatcacatctgctaaaacagaaagctttttcaaatttagattctattagaggaggcctggtatccaattcacacgtagtttgcccagtcagaccacatccaagaccatcatcatctgaag

SEQ ID NO: 1281 - DNA, 1081 bp, Homo sapiens; identical to SEQ ID NO: 1280

SEQ ID NO: 1282 - DNA, 1081 bp, Homo sapiens; identical to SEQ ID NO: 1280

SEQ ID NO: 1283 - DNA, 1081 bp, Homo sapiens; identical to SEQ ID NO: 1280

SEQ ID NO: 1284 - DNA, 1016 bp, Homo sapiens
tttcttgaataggagagaaaaggataaagtaacaaggaattatgcataacctgaatcttatctaatggccacctatgctgatggacgtatgtgtcacatgtgatgctatctgtcattggattaaatgggcccagagtcattgatatattgacgggtacaggatcagaaaatatagactcaagattactgaagcatagttctgcaccccagtgtgactcacagaggttttttttttttttttaagatttttttatttttctttttttcctactggcaggatcaaccaggtattacagagattttgagctaaggagggtgggggataggggataacaataggatagaatgagtggtttcaattagggatgtaagatttaaatataagatactatttaaaaattaaagtgtcatccagggatcaatcagtaatactgtagtaatttaaggaatggaaagatcattgtgttaatttctgttaatttttcttctgaatatagatgttggtaaaaaaaaaattgagtttgtagaaatactgggcttagtaagtataatgttttctaggtctgattctccagagataactactgatagtacttgatgtatattcttgcagtttatataagttttacataaatgttcatatgtatatttatgcctttttgaattttctaagagagcttttgagatagatgggatttaaacccagccttcaaaaatatgcatatttaggttggaaaaaaaagtagggaaggctttctaggtcagaaaacattttgaggaaagtcactgaggagatgtcagatcttcatgggtgatactgaggacttggggtgtcagggtatgggatttgtgtagacatgggtgatggttgtacatatggatgagtaagatagggccagctgataggtggagtgaaaattcagactcaccagccctgcatttttgcttttcacggaatggttgtaggatctttggccagaaaataacttgatacaattggcatgttagaaaaataa

SEQ ID NO: 1285 - DNA, 1016 bp, Homo sapiens; identical to SEQ ID NO: 1284

SEQ ID NO: 1286 - DNA, 1016 bp, Homo sapiens; identical to SEQ ID NO: 1284

SEQ ID NO: 1287 - DNA, 1016 bp, Homo sapiens; identical to SEQ ID NO: 1284

SEQ ID NO: 1288 - DNA, 1050 bp, Homo sapiens
tcctctgataccaaaaaaaatcacggcagctatgatttgcagttcacaataatggatcatccactgatgcaacttaagtgtgttgtaattgtgagcagtaacagtctatcattgacattgcccgttggattaactgttttgatttgtattgacatagtgttagtttaacctaccacactgtgaatactgtgactgtattttctgagagttcagataatgaaaatgagaacagttatgatatcaacaccagagtgtcccagacatcactgagaaggaaagttattattgtatatggaaatctatgttattttatatatattagtatataatgatatgttatagacagagggaaagacacataaaatttaattagggagataaaacagaacatattgcacaataggcaggaaagaatttgggattgggcattgttacagtttgaattgtgtcccctccaaaattcataggttgaagtcataactcccagtaccttagaatgtaacctcagttggaaatagggtcattgtagatgtagttagttaagatgagtttgtattaaaatatggtgggcccctaatccactatgactggtctccttgtgaaaaggggaaatttggacagacatgcacacagggataatgccacgtggagactggagttaggctgccacaagccaaggaactgcaggaagctggcagagagtcctagaacagattcttccctagttgcctgcagagagctcatgaccctgttaaacccttgatcttggacttctagcttccgtaactgtgagacaatacatttctgttgcttaaaccacccactttttggtactttgttatgacagcgctaacaaactaatacaggcttggtgaaggagatgtgtaagcacctaaggagactgtgtctctcaagtctgggataagacaggcaagcacatctaaattaatctgcacttcttccatcttgtttaaataaaagcatttagtataacagaaaactagtatagaataataatttcaaataaatacctattcttcatatttgtgt

SEQ ID NO: 1289 - DNA, 1050 bp, Homo sapiens; identical to SEQ ID NO: 1288

SEQ ID NO: 1290 - DNA, 1050 bp, Homo sapiens; identical to SEQ ID NO: 1288

SEQ ID NO: 1291 - DNA, 1050 bp, Homo sapiens; identical to SEQ ID NO: 1288

SEQ ID NO: 1292 - DNA, 1699 bp, Homo sapiens
aaagcaagcggttttatcttgttcttacctttttgcaggaaaagtggctttaaaaaaatttatataataaaactattttggaaattcattcttttagaaagagaccttgagataaatattttttgactctggatatttctatagttctgaacacagattttaaacccactatcaaaatgaaaacaatataaagctatattagtgagtctccatgtagcagtttgtttttatagttactgtttcatgcttaaaacttcattcttactttcattaatgttacccttcactggtatagccactcactaaataagtatatttaaaacatcaaaattttgaactaaagtttgtgattctcttattcagcaatccttatcttatgctggctgcatgagttaattcaacatccagattaaatatcctgaagtaggttctatatatttcctcatacaacagacatggaatggaaatgccactagaaactgccctgctacttttaagtctgacctttgcaggaggtacactttgctgttctatgattgtattcacctacctaaaatacaaatgaagacagaacatatcatttactgcacgatgaatttttcatttattaaatgaaaaacgtttgctagacattttaaatattaagtattttgactacacggattaatttaaatgattctatcaggcattctgatatttaacaactctattaaaatatttatagaaaaataaaagcaaattgatataaatttttgagcaattctatttttgtagaaaaaagataacctgtaattataaagatgttttttgaatgtgtagtatcctagaaaataaaagttcttgtgaaacttaaaaaatgaatgaaaaccaactaatagcatgcaagatcatagatcctgcattaaatttttatttgtgaaaatttgaaaattatgagctataacttataaagtttgccttcttatgtctaaaatcttttaaaggattatttgcatttatgtaaaactggaaatgaagttatatatgagtgcaaagaaattgacttctgctcaaatatgtgttgataccctacagtaaattgaattaaatttttatcccaactgtttgattttattatttcatggactagccttacgttaagtgaaatactatttatgttgttaccacccctaagagtgactctgatatattatggatgacccaggacggtcttaaaggtctagttttaaaaactgcctagtttgtaagtatttgaatccagttcttttctaaattttaataatttgactcaaaatttttgctacagggtcaacttttaaattgtatatttcctctgaggcacactgggcatttggagaatggttcttcactggtgtagagagccaggtttactgttggttgcaccatctgttatcaggcatgcagaaacatttttcttctggagaaacagaggggaaggtgttgttacagtgtacatgtttcctctgtgtcgtttttaagggaaataaacatgttccaaaagatgctgttaaaataaatatttgaacacgttttctgtttctaggttgctcttaattccaaacatttaaataaatgtgcatttgaatagctttaggtggtttagtctattagctgaaatggaaaagttcatgtattgacatcatcaataatacttcataaaggtttatgtatttttatg

SEQ ID NO: 1293 - DNA, 1050 bp, Homo sapiens
agttgaactggttgaattaaaggccacttttctttcagattccatcattcagtaattatgggctgggcacggtggctcatgcctgtaatcccagcactttgggaggctgaggtgggcagattgcctgagctcaggagtttgcgaccagcctgggcaacaaggtggaaaccctgtctctactaaaacacaagaaattagccgggtgtggcagtgtgtacttggaatcccagctattcgggaggctgaggcaggagaattgcttgaacccgggaggcagaggttgcagtgagccgagatcacaccactgcattccagcctgggcaacagagtgagactgcatctcaaaaaacaacaacaacaaagaaaacacggtaattagaatcaaggttagggacatgtagcccagggtatggtagggtatgagcaaattcctatcagacagcaattccagaatactagtttcaagtgtgtaagtttttggaggtggtctaaatttcaattttgattgtgactgtatgctcttgaatgaggccacttgtttatgactccatctgcctcacttgtaagaggagacagtatcagttgcaatcaatgaacctagccaaaaaggctaactataaatatttgctgaatgcttcaacattcttaggggaaatagataaagttttaatgatgtactttcccactgtacttgcagccaagttgaattttgtcatattcttcctagtgttaacatttaaaagatgtaaacattttcatcatagtatctaaatatagaactcattttgtttcccacaattaaatataatcatcagaaaggaaaatagatgattaacagaaatgtaaatggtaagttatttagtcccctctcaccaaaaccaatctgaatcctctatcttgagaagccagtccatcactaatgggtcatttaccttgattgactcagtgttaggacttgctgtgagatcaggactttctataagatttctgtgttctttgtgactctatatgtacactgctgggattatttgatgggctttgtggagagtc

SEQ ID NO: 1294 - DNA, 1061 bp, Homo sapiens
gtcagattaaaaccaacattttcaagctcccttttaactggcagcagtcatggggactgagtcctagtcaatgaaattggactgaatcccattcttctgactcgtgatcggagctccaaaagccaccctgaaccacagcatgaccatgggaatcaaatctgtgcagagcagagccacaaaatagatggaacttatatcctgacaccggggagcaccaaagctctgcctacctccacacttgaacgtttaagagaaaaccaattgtatcttgttaaagccactgcactgttaggctctgtgctttttttcacctgaactaatcgtaaatcatacatctgttaaacacatcactttagaacctgtcatcttctgtctcttaatatcatccaccaactctattcactccatttggccccggttttcctttttcttccctattttcctgctttatttttgtcctttttcccttaattgagcattaggcaaaactcaaatatcctgatgtattatctactgaacacattttaaaaattaacatttattaaaaagaatatgaaatacacaaatgtagagggaatgaaatactgaatcttcatgtacccatcactccaccccaccaatcattaacctatgatcagcttctgccccactcacactatagcctcttcctccctcctatattattttgaatcaaatttcagacctcatattgttattgaatcaagtttcagacttctttatttaagaagcaggcaagtcaatcttttttactttttccttacataaagacaaattcctaactcatgacttcttttgcctcataaaaatcaatcttttctttccctatttctcctccttttcccccttcccctcttcctcctacctctttttttttctctttctctttcccttcctaccttcttccctccttccactataatttttaaaaaggaaatccaagtctaattttcccagttttacctgtggttccttgatatacatctgtctttccattttcaatcacttttgctaaaatggcagagtttactcatggatagtcc

SEQ ID NO: 1295 - DNA, 1075 bp, Homo sapiens
gtatgaaatttccagtccttccacatcctctttaatgcctgttatcttctgtttttgattatagatattgtagtgtatatgaagtgatatttcactgtggatttaatttgcattcctctaatatctatgatgttggacatcttttcgtgtgctttttgtcagctgttatctttggtgaagtgtctgtttatatctttagcccaattttttatttggttatttattttaaattgagttttgagaggtcttcattgtggttacaagtcctttatcagccataaggcctgcaaatattttctgccactcatcttcttattctcgcattgtcttttgaagagcaacagttattaaatctgatggactccagtttaccaattttttcttttatggattgtagttttggggtcttgtctgagccatttttgcctgactgtaagccatgaagatttttttccttttgtttgttaataataataataatttttttttagagacaggacctgactctgtcaccccagctggagtgcagtggtgcaatcgtagctcatgataaccttgaactcctggacacaagggctcctgcttcagcctcccaagtagctaggactataggcacacagcaccatgcccagctaacttttaaattttttatagacccggggtctctctgttttgcccaggctggtgttgaactcctggcctcaagcgatctttctgcctcagccttccaaagtgttgggattaaaggcatgagccactacacttggccacctttgttttctaatagaagttttatactttggtttaacatttgggtctctttcattttgacttaatattttgaatatggtacaaagtgtgggtcagaagtatttggttttgcatggggatatccagtgtttacagcatcatttgttgaaaagactatcctttctccattcacttggctttgcagcttcatgaaaaatcacttatgtctgtatgtgtgattttatgtctgtactcttttttgtattgacccattttcctttatctagatgctggaaacatactgtcttaatcattgtagctttat

SEQ ID NO: 1296 - DNA, 1030 bp, Homo sapiens
atgaaatctcattttccattattttataaatttgctgtattcagcttttcttgattttagacttttttttgttagctcagtgagactattaagaaagaatatttgtgagtttgtaataggagatttgttgcatttctttaaaatggctttttatattcttcgtaatttgtaatatcaggggtgtcatttctgtactcttaaccattttgccaatgtgaaatccttgcaaagtaatcggcctattacttgggaagacagaattgtatgaaatgactgtagaataattcaggatggtccccaatacggtaaaatgttaactttttagatgtagattttaagtatggtgaaatttgtagcagtgttctttagtaagttaactattaatatatcaagacctataactggacaactaataaataacctgtttcttaaaatgttagctttttctaaatattctgaaagtactggttgtaaattgctgaactcacaatttaaattatgatatgactattgaattcatcctcattggcttgcatagaaaattacaatcaaataatgctaaatgtaacttttttggtaatagttgtgtgtaactggttgttcattatagatgtgttattcaaaactttgggtttttaggttttgacttttcttaaaatacttttcttaaatgctacttaatgctttctctagggtatttttattagaatttcaattaacagatattttgatgtctgcgaaatgacagtactatgttagaaattgatgtattggctccttgagggcagtgaccctatttgttatgtttgttcctcaatcattaatagtacacatattaaatagtacatatacacttaatatttaataactcttagaagtgtcataggctttaatatgctcatactctaatgagccatttatcaataaaaagataaataacaagactatgtcttttaggactttagttagagaaataaggactcaaggttttaattaagtgctatatggctacagtaggaaagattggttt

SEQ ID NO: 1297 - DNA, 1116 bp, Homo sapiens
gaggataaatgtttaaattacaaattaatgaagtggcaactgaaacaagttttaacctattctcaagaaagggctttgctggaatggtggctcacacctgtaatcccagaacttagggaggctgaggcaggcagatcacttgagcccaggagtttgagaccagcctggtcctcatagcaagaccccatctctacaaaaacttttaaaaattagatagatctggtggcatgggcctgtagtcccagctacttgggaggctgagacaagaggatcacctgagcccaggcggcagtgagctatgattgtatcactacactccagcctgggcgagaggagatccagtctcaaaaaaaaaggaaaagggctttcctgagggtcaaatgaagtacagttgacccttgaacaacatgattttgaattacacaggtccacttatgcatagatccacttatacagaattttcttctccctcttccacccaagacagaaagaccaactcgtcctcttcctccttagcctactcagcgtgaagacagtcaggatgaagacctttattatgactgatctccaaaaagattggcttcagtatttcatggagtgctatgaattagaatcctgagtctctatattgttaattattttagtctcttggtctacgtgtgttcctaaactgtagtagctttcttaatttagttctaggcatactacattaggggataaggtggttaagtgatattttcactttaaaagtaataaggtgtcacagaaagttatcacgagatttttttgagcagtacttcttttttaaaactattataatgaattttagacacaatagtatcatgaaccattgtgtatctatcattcagtccccaaaaccattagtaacccatagctaaaatgatgatatccacactctgcttttccacttctgttattttgagataaatttcagatattcatattgttttatctgtaaaggcttcagtgtatatctttaaagaatagggactctcctctcctttttaaaatataatcaaaagactgttaggacacacacacaaagttacctcatattataaaatgtcaaatttgtattaaaatttctaattgtct

SEQ ID NO: 1298 - DNA, 1961 bp, Homo sapiens
gaacagggatacttggactaatatttcaatatttctaaaattattggtttattgagtacgttcctagaaaactgttttattgaaagcttcaaatttctcagaattgtatagcatttttgaattctctcttttattactaatatcaagcacctatgttttctcctatttcttgatttgtcttgtcacagaatttattttactggtcttttcaaagaaccaacctttttacttgttttcttttttgttgggggcagtggagggattcactttaatttgatcctgaactcctttattttcttttaaaatgcattcaaggttaaaggtaatcagctgatagctttggctttttttttttttttttacttttagagttctctttttattgtaaacttcatttaaaggttttaagctacacaaaagtagagggaatggtatataatacacttttttctgttggataatattaatgcaaatctcagatcatttcatataatctgcagatatatcagaatgtgtgtctctctattaaatgtgacattggtaccattataaagtttaaaataatttcttaatgtcgtctaatctccagtattcagaatactttcttttcattattttatttttcttgccttttcttttttgttgttgttagataaagtgagtcatctgtacaatttccactttctggctgggcgtggtggctcacgcctgtaatcccagcacttcgggaggctgaggcgggcagatcacgaggtcaggagatcaagaccattttggctaacacagtgaaaacctgtctctactaaaaatacgaaaaaattagccaggcgtggtggggggcacctgtagtcccagctactcgggaggctgaggcaggagaatggtgtgaacccgggaggcggagcttgcagtggcgccactggactccagcctgggtgacagagcaagactccgtcttaaaaaaaaaaaaaaaattccactttctggattctgctgattgtaccgctgtgttgtcatttcatatgttcttcatgtaaacaagtttacctgaaatacaggggtttgatcagactctggtgtaatttttaccaagaatattttgcagatgtactctatgtaattcctgttgtatgtcagcttgctccatctattacagagcgcatcatcctttcacctaatagtttttagtagctaatgattgcatacttttattaggtattgcaaaagtggcgctattctttttttctgtgtatattagaattcttaagaattatatccatcaactgtttggtcatacgtaagtacctttttataagaaaagcaggagagaatttgacttcttaagttttctgatgagttgttaccctaaaacctccagtataatcaatatgagttcctttttgttgctgttagtatcgtcgcaacagcaaagagtttaataacatttattttctagtgtattgcagtaatcattcttcttttttttaaatttctaagctgttttattaaatgaaaagagaacaatgctaagcagcttgtatggtgtgtgtgttgtgtgggtttttattttgtatgaatgttaaaaacacggtggctaaagcctgtaatcccagcattttgggaggccaaggtggttggatcacaaggtcaggagcttgagaccagcctggctctactaaaaataaaatgtggtgaaaccccgtctctactaaaaatacaaaaattagccctttgttgttgcacgcgcctatagtcccagctactcgggaggctgaggcagaaaaattgcttgaacctggggaggctgaggcagaaaaattacttgaacccgggagacagaggttgcagcgagccgagattgcgccactgcactccagcctgggcaacagactgagattccatctaaaaacaaaaccatgtatatatgtaagtttgaggaaaagagttgtatgaaaattcag

SEQ ID NO: 1299 - DNA, 1935 bp, Homo sapiens
tgtcatgtattaaaaatcatttgtagtctttcagagagcatcttatctttcttgtaggtgatagtattggctatctatgtagtgtcttaagttctttaaattatccttattcttactttttgtgtacattgtttataaaataatgtgatcatcttaatctaccattttgattatggtttgatcattcttttactatttccacttgttagcaaagcctttatacttactaaattatgataaaaatgattattataacatgcccggttttacttaaatgtcttatttaaacgttctgattgttattctttcttattcaggtttcttattgtcatgttttatgtctgttttcaggtgtaattgtcctctcacaaatgtatcccattttgggtgacaaaatacctgatcaccttatccttatagttttctccctagaatcttttttgttatattaatcaaagtttatttgtgagaatgttatgaaatataagaaaatgaacatcatgaacctgtcactcaaataaaaaaacttgaatgttaccaatactattgtatattccatatgcagcaatattgcttttttttttttagagtcttgctctgatacccacgctggagtgcagtggtgtcatctcggctcacagcaagcttcgcctccctggttcaccccattctcctgcctcagcctcccgagtagctgggacttcaggcacccgccaccacacccggctaattttttgaatttttagtagagacggggtttcaccctgttagccaggatggttttgatctcatgacctcgtgatccgtctgcctcggcctcccaaagtgctgggattataggtgtgagctactgcgcccagcccaatattgctttttaatcccccttcttaccctgccatgggtaggtggctgccacaacttttgccttattttttcaatatggatttttcatgtaaatgacaaaaatatatttagtttttttttagtttatggaaacggtatgcctatataatgttttccatgtcttgtgttttaattcaataatgattctaataaatagccgtattttttggatagttttataatactcattgctgtgatatactcttttgtgaaaatacccattttatcttttattggacatttgggttgatggacatttgaatatttaaagattttgacttaggccgggcgtggtggctcaagcttgtaatcccagcactttgggaggccagggcgggcagatcacaaggtcaggagtttgagaccagcctggccaacatagtgaaacccccatctctactaaaaataccataattagcggggtatggtggtgggtgcctgtagtcccagctactcaggaggctgagacaggagaatcgcttgaacccaggaggcggaggttgcagtgagctgagaccgcgccattacactccagcctgtgtgacagactgagactccatctcaaaaacaaacaaaaaaaaacaacaacaaaaaaagattttgactttaagaacaatactgctgtgaacttctttgtacttgtttcctggtgcatttatgcaagcgtttttgagagggtatatttaaaggtataggtatatattactagtgtgtaaaataaactttatgagacagtactagattattttccagtgtattgttcctatttatgttctcaccagtagtgcgtaggagttcttgctgtttcagatccccaccagcacttggctaggtatttaatttcttaatttttaacaatttggtgtgtagtatattctctggtcttcctttgtcttaccctgattattaatgaggtcttacatcttttttccccccacatttatggccatggatgtttctcttttgtgaaattctgttaaatgcctatttgtgttttttgcttgataaaatgtgagcttattatttaactga

SEQ ID NO: 1300 - DNA, 1029 bp, Homo sapiens
gtattctttagtattttgattctaagtaccactaatttgatttgtttcaacagtcattaatgtggggcagtcatcaatcactaccattgatcatttatttcatatacattgtaagttaaatgaccaggctgaaataattcagatgaaattattctgtcagttaatgtggtaatgttaacatttatcagtagtgctgaatcacttcttttgggcataatagtggtaagctttttgctcaatgcaaagacaggcataattgcttttttcaaataaaaatgtaatttgtaaaaatactccagtaatttttgtaaaatctcaaaattgcaaataatttgacgttattctcagtaatgaaggctgttaaatctcctctcttaacggcaggtatgaaatcatttgaggaagaaaaaagttcataaatacaaacttaaaaaaaaatggaaagacttttccatgcaaaaagatgcattgcaggaaggaggaagagtgtccttcatagcacaccacaagtcagtattagaggcttgcttttctacttgagtagacccaagattccccacctatcgtcttccaaagttacttgtgatccactgcaatcacaagttttacagtgtgtatactctaggtgtatggaaggatttgaattcacaaatagtcaaacatcagaagaataagctgataataatacatttgaaaagaggtcaagtatatttttgaaaactaggagagttaaagtgtttttgtgaactaaggaacaaataaggcattgacaatattttacttgattaggaattttgttcaggtgagtaaaactttaagcatcacttaagttttgtttttgtttcttacttttagaatatctgatctggacttctgtggatttatggaagagctggctttatttctctatcctgtgggaggggcaaactttgattttgtatgtggagtaacttgaccttcagtttttttggtctgagaacaaaggccaaaaaatatgtaacagttaataacgtaattcacttacttagt

SEQ ID NO: 1301 - DNA, 1077 bp, Homo sapiens
gggatttttttttttaaacctggggtttttagatcccaccctcagagtttcttattcagtaggtctgggattggacctgagaacatatactgtcagtaagcttccaggtctaatcttaggattagggaccacactttgagaatgattagagtattcaattagatcttagggactacactgtgagaatcagtaatgtatacaattctgctcatcatgttcttataaaactatgccatgccagatcttccatatcttgattagaaattggttaagaaattaggcttggtgtaaatacagtatcaatgtggcttgaaactggttgtatttttctgtttttttttttctttgtgcatttgatgctaataagtagaaagctcttaaaatatttaagggagacaacctatggatatctgtttactcttctcatatttgttgtaatacagtttattcattatgagtttaaatacaaattagcgtaaagcttatggttaatttggattttttggactttctgaaatgctttgataattcattgcctcctttgcacatttttttcattttgatggttgcatttaacttctttgtactgattttttaaatcagccagtattaatttaacctattttcaatactaatatccatgtatgtaaatatccataactaaggcaaaacagttgattttagctagtttaaatattagtccattcatatttttgtaagtacataacattttcaaaatagctaaaatgtcactggctggtttgaacaactgtgcagttaccgaagagatgaatgtataaccttttctgtaaagaattttaagacatgaccttatttttttgcagaaagaaatctcttcattccaaagattttgcctttgctttcggtgttctagccactgaagtatatacctgtttaattttaataatgatgaagatattgatatctaactcaccagaatgaagttctaattttctaaagacctgaattatctggatgaataaaggaccattgggatggaggatttatagaacgtttctgagaaagtctagctgttgtggctttggtttgtttgta

SEQ ID NO: 1302 - DNA, 1150 bp, Homo sapiens
ttgaggctttgccaggtctgtcagaaattgtctgctctggggctaaatggtgattccataggttgcacggtactctgaaacattggagttctgagaagtcagaatgcagacatattgcagggtacttcaaacactccatttagactacagaaagcctggacctgaatagaaaggatcacaccctataggaagtgccatctataagactgagataaaaaccagaaacctagcccgataggaagtgaaggattcaccagttaatctaaccagtaactgatgaaggattaatcagtaatttagttgccttccaaaacaaaacaacacccccaagaaagacatgatatagttttcctgcaactatcttccataatatctagtataccatcaaaaattacaagtgatgtgcagaagcaggaaagtaacccatgaaatataaagaacacatttaataggaacagattccaaaatgacctagagttagaattagcagacaaggacgataagtattttaagctgtaaaggaaaagattgaaataatgagtgatggaggagtgtgttgaagagataaaaaactataaagaaagcatgtagaaatattctaattgaaaaatacagtttttgaaatagttgggactgattcactggttggaactagtagcagattggagacaatagaagaaatgttagtgaacttgaatactgttgaatacagtgattaaatctgtcagagaggagaaagtatatctaatggacaatgaagcagtctgacatgtaagttgaatttcagagtgagaatgtgggggaataaaacatctatctgtttgagatagtaatgactgagaacttctaaaatttgaataaaatatatcaacttacattcctaagaagctcaggtaaactcctcatgtaggctaaataaaaagaaccatacttagacacatagtagtcaaaatattgaaaactagaaatgaagagcaaatctaaacagctgcgaaaaaaacgtctaacaggagaccaacacctcgtattaaagggggaaaaaaagcgaatttctttagactgaatggcataacttggctctacaggggataagaggagtactgggaatggttaatatgtgtataaattttaaaagggctctctcttttcc

SEQ ID NO: 1303 - DNA, 1029 bp, Homo sapiens
aatacagaaaatcttcgtgactttggattaagcaggaatgtatttgatatgaccctaaaagcacaatctattaaaaaatggaatttgacatcagaattaaaatcttctgccattcaaaagaaactgctagggaatgaaaagacaagccataaactggaagaacatcataacaaagcatatagctgataaaggacttctatccagaatattaaaagattcagtatatgtaaaatcagcagtcaagcaacaaactactcaatgaattggccaaaatatttgaacaggtagtacagcacaaaagatacacagatggtaagtaagcacgtgaaaaagctggtcagcatcattagttattagggaaatgaaaattaaaactacagtgagataatattacaaacctattaatagtgactaaaattaaaaagagtgccatcttggaaagcatgagttgggaagaatgtggaagaatgttaatattcacaatactgctgatgggaatgtaaaatcgtagtactttggaaaacaatctggtagtttctccatgatccaggttatttgtctcctaagcatttacccaagagaaaagaaggcatctattcattaaaaaactctcatgttaatgttcatagccattttatttgtaatcaccaaaatgtgaaacaaacattcatcaacagatgaactaataagtagattcctgttttggcatcatatgcttttccatacagtggaatacaacagccatgtagaatgagctattgatagacacaacagcaagaatgaatctccaaacaattatgttatgtaaaagatgggagaaaaaaagactacatcctgtatgattccatttatataaaactctgggaaatgcaaactaatctaaagcaaattcatggttcttaggagtttaagagtgggaaaggacaggcaggaggggtggcaaagggacacaggaaaactcgggagtgatggacatataaattattgtgatggtggttttatggatgtatgcatatgtcaaaacttgtc

SEQ ID NO: 1304 - DNA, 1047 bp, Homo sapiens
aatttagaataattataggatacaagttctatgtacagaaatagtctccttatacttggcagcaaattcttagaaaatgaaattttaaaaaatctgtttataaaagtatcagacaaaatatcaggaaaaaaatttgacaaaagatatgtaagacatctacaccaatatgaaacactgctaagagaagttttaaaaagacttacatgaagacgtagaccatgttcatgaattagaaggctcaatatgttaacatgccagttctccctaaattgggatggcattgaatctataaagacttataaattgagagtacattctaaaatttatgtggaaataaaaaggagctaggacaattaaaaccattttgaaaaagtaaattttgccacagttctcaagactcactacaaacctgtagttaatccaaaacagtttactactagcatagttagtgacacagaatagcgttcagggaataactcatgcattaaagttgccttgatcactcagtgaagaaagagaaggcctttcaacagatgtgctagaacagctgaatatacatacaaaaaagcaaaagaaacttaaaccctacatcattctgtataaaacaatgagattaattatataaaaactaatatatagagtttttaggaaaaagcataggatatacttgcaactttgggataaatgaagatttcttaaaatagaaaaatcttaaaggaatatataaacttgactccatcaaaatgggaaatttctgcttcatcaaaagacattgttaagacattgaaaagacaaggcacagacttggagaatataatatttgtgtatcaatacatgcatatgactgtattagtccattttcatgctgctgataaagacgtacccgagactgggcgggcaatttatgaaagaaaccagtttaatgaatttacaattctatgtgactggggaagcctcataatcatggtggaaggcaaggaggagcaagtcacatcttacgtagatggcaacaggcaaagaaaagagagcttgtgcggggaaactctc

SEQ ID NO: 1305 - DNA, 1055 bp, Homo sapiens
gtgagccgagatcgcgccactgcacttcagcctgggcgacagagcgagactctgtctcaaaaaaaaaaaaaaaaaagaattcctggtaccagcagggcactttggctcatgcctgtaatcccagcactttgagaagctgaggtaaattcagggcagcagtgaactggtcacaccactgcactccagcctcagcaacaaagcaagacacagtctcttaaaaaaaaaaaaaggaagaaattctggttcctttaagggagatttgttgttgttttcttcttttaatggtgagggtacaagttggtcacaggagggagaagagaaatttagctcttttgttaatgaactagactttctgttcgtctgtttttcacccactccctcctcctgtgaacctgccaatttctgatttggttcctgtggctgctaccagtataacacctgtttgctgtgtgttcactgtgtctccagtccatttggttccattcattttctgtgttccaggaatttgataaaattattctcagctaatgataaccttccctcccttcagtgtttgtttattttatattcattcacttctaggcattttaatagagtttcataatagaagacatgcaaatgagtatgcattaaccatgaattctttcacatccgttcatgaaatcaccaggtcctattagttcacactttttaattatctgcctggttttctccatctttcctgctacttgtattgctcaaacacactcacctgttggctatattactacgacagttctctttataaactactttctttttcttttcccttctggaatttttttctcgctagtacagccagtacgtatctttctcaaatgcacatatctaagttactcccatgcagtaggtcctgttcatgctcaggctaaaggccctttctgagcttactactttttgtcttgtcttatgactactcccaccctatttgcttatgcttctgtcccaaaagtaatggtgcatcctgtaacctggcatgttttctcttgatgtcagtcgtttgctgccattatgtc

SEQ ID NO: 1306 - DNA, 1048 bp, Homo sapiens
tagctatttcttctcctaaaagctatcccctgataagcaaagagtagattaggtttggattgagagtgttaactccgaatgagatactgctatgcacataaccagagtggctaaaattaaaaggataggtaataaaatactggtgacaaccatttttgaaaactcgaaatatctactaaagttgagcatatagctattctttgatgtagtaaactcgctcctagttaacatacctgagaacatgtacataggtatgttaaaagatatgtacaagaaagttcatggaacactgtatgtaatagcccaaaaaactataaatcatccaaatgttcaacagcagcagaatatgttgtgttgtattcatttagtggaatattgtatagtaataaaaatgaacaagctactgctgcctgcaaaacatgggtagtgtacatcataattattggaagaagccaaaccaaagtagaatacatctgatatgattccatttatgtaacttggaggaagcgtgagtatggcttctagagtgttgataatatactgttttttatctgggtaattatttcacagagatgtccaatttgtggtattttatggagctttatacttaggttttgtgtccttttgtgtgtgtgtgtaatattttgataagaagttttattaaaatctaggtttgcaagccaacactgctccatgaattataagaaaaaatatatgaagtcattaaaaatgaaatcataaagaaatgtatgaagtaatttgttactgatgtgagagaacatgattgttaagccataaaaggaagatagagaacaatgaatagtattaaataaaagtatgaatagtattgaataaaaatatgaatagtattgaaaaaaatacagactaagtataatatttatatatatatgcttgtagatgtagctagtatctctggaaggatatcgaagataatactgtgaggggttggtaggggaaaatagactgggtgacagagttgcaggggaatttttaatctttaataccacttttataccatgatcatgga

SEQ ID NO: 1307 - DNA, 1084 bp, Homo sapiens
ttttattactaaaattatactttcactaatttttattttttgtttaagattgctgatatgctttattcacttttacaggccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttaggtatgatttttattgtcttaaccacttttctcccattttgccaaatggaaaagtaccagtaagtataatgaatccccccattttggaccttaccaaattgtgttaggtttcgtgagttttctttttctcaagtgagaaggcatatgaatactgttaagaaaaacccaaagtattctttataagtctaattaaaattatatgttagttttgttccttttaataccttcagcttctcttccatgccactctcccagaacaaaagaagaaaagctctaatgaagaaatactgttgaattcttaatgccatatttacactttaaacttgatgtcactatgcctgagtctaggcctaaagttcttgtgtgtgtttttcagtgctgatctgattgttttaatttagcattgcatggaaacagtgaaatgttaagagacaaaacatacataatgggtggaggcatatgggattttttttgaagcatattgtagtggccttttaaaaaaacaatttaaactagaagaaattttctgtaaaattaattttgctatttctttgcattttgtcttaatcatttatattttactttgtaccacaatggacttgagccacctaataaaaatacagtgcaaacatatgcaacttatagttgatagcgtggaatcaagatgaagaaaaaaataaggaaaatcttactttgtaagtaaaatgtgcaaagtgatttataagttaagatggaattttagagtttccttttatttgatgtatttcttgatttctagtattggtaagattatctttaagtcatgattttt

SEQ ID NO: 1308 - DNA, 1065 bp, Homo sapiens
tcaaaaatttttaagaacacaaatataaggtgatactcttttgctaaaatttgtggggggcttcactttaccttgtatgatttttatattagatctagctacttgactgaatttaattactttagaatcagtactataaattttaattgatttattttacacagtaattttttaagactaacatttatgtctggcttttctgtttcctttaatgctaggtatcacagtgtctcagaaaatgtaatttgttcaaagaaaggagactgagtgctttgtaatgagtttaaaatctgacatctaaaatacataatcacaaatgtggccgactattagtcattcacatattctgtttcaaagaacacagtgatcaaaaatccttcagattataaattgagacatcattataatggatcattttatcatgttaagaggtgtagttaatttattaaggggtagatcacttttagaaaaattgctggaagtaatttttcatgatcatgttatctacattctaaaaattaggagagagactgtgtacaaagagtgtttattttagagctttccttgtatttcaaattgaataacaggcattctcatcataaagtttttaaaagaaaggcaaagcagactttctgtaggaaatcattgacgttaaaatagttataattgtgaacagatacaacatttattcatgaaggtaaacatgtaggtcttatagaatattgtttctcaaaattttgctgcacgttgaagtcaccagattctaccccaggctgagaatagttaaagagtgggtcacaggcattcctatgtttttaggatctcaagatggttttactatgtagcaagagttgagaattactgctacagaaaagagcttgtaacttaatgtcatttaaatctattttggtacagttctcctggcacaattttaattagctgttaaactgaatttataattttctatatgtttgtgatacataaaattaactggaaaactttgattttctttctttgttacatttgtatgggttattcatttggtaatatttattaatttattat

SEQ ID NO: 1309 - DNA, 1066 bp, Homo sapiens
ataccaaaaatgtgtattgttcatgcattgattcaaaattgggtacaaaacgggtagatatgtaacatgcaaataataaattgaacttatatttttatctttttgacaaacaacacgttaaaatttatgtcaatcttattttttcaaaatccttttctatattttattaagactaattatagcaaataatagccataaaattaaaccaaaaaactcatctactgcagacatatttgaaagctgtcccccaagaaagaccaaagtaatcacacatacctaaacatgctagtatttcccagaaatattaaaaatacatagattttgaagcacattgctgaatgccatagtaacaccaaactaaaaaatacatgtaaattaaaaattaatattttattttcaacataaatcagaaatacttggttagaggtcacatgataatacctgtcctaactgtcccataacttcggctttctcatttcatgtgttttaatatctaagaagtaaaaaatagttggagcatgcctctttatatgtgcaattttaaattatgttgacttctttggattattgaactgtcctctgctttgctatagctgaatttttaaaatgttaattttgaagtcttaaaatgtgtcttttggaaaaaacattggaagagctaaagtagatagagttgttcatttaaattgtttattttttattttattttattttttttagttggagtactggctctgttgcctgggctggagtgcagtggcgggatctctgctcactgcaagctccgcctcctgggttcacgccattctgccgcctcagcctcctgagtagctggggctacaggtgccctccaccacacctggctaattttttttgtagttttagtagagacaggctttcaccgtgttagccaggatggtctcaatctcctgacctcgtgatccgcccaccttggtctcccaaagtgctgggattacagtcatgagccaccgtgcctggcctcatttaaaattttttaacactgggtaaaatttttatttttgagtcacaaattaatttgaagctg

SEQ ID NO: 1310 - DNA, 4700 bp, Homo sapiens
catgaagcttatcagagacagaaaacatatgagttagatctaattggaggcaaactgaaatatatagtggagttagtgtggttatcagcacataaatgagtgatccatcaacaaaaggagaaattgggagggttttatgggccaaaaacagcatgattaaatgtgatagagtatatgtcatgttttaggtgtgatgaacattcagttatgtgtgacgaataggataattgaaaaaatatgaaaggctatgatgccagaaagtattatgggacaagatcttaaaaccagtgttacccagggagtatgaatttaatatgggaattcttaaactcctttatgactggaagatgagcatcagagtgtctgcgaccatttgatgatattatgtaccaagttttagatgtttggcttttttcaggttatgaaagcgggggatgagttaagaaccactgctgtgaaggattcatcaactatttttaggcagttgggtaaaaatgaccaatttagttttaagaaactgactgtggctccagagtatgttggagaagtgaaaatggagactaggaataacaggtgggagactattagtctaattaagatgtaattataaatctaagctaggaacgtaaaatgagaatgcaaagtaagaaacaaatatggggaaaattatatgtaaaagtaataggacttggcatcttactgatgtgattgattatgagaaaaatgaagcatgtggaggagtccactggacagtaggaaattcagcctaagacttgggtaagagttctgtggagttgtgaattcagaggccagagatgtgatatttaaaattttggttcaagatttcccaggtataagaaagcaagaggattaaagcattgtaattaaactttaagcagtgcatatttatgttatagataagataaacaagaaatctagggatcaaataggattaaaattagtagtgatcattcagtacagtagttacgtactgttattcacaagagtatataaatcaaattacaaggaattaaggatataaacgtgataagaaagtatgcactgtactctttgaggaagtttgccatagaaaggaagaagaaataggatggtagatcagaagtaaagcaggacccagtggggggagtgtttgcagtgaggcagtatgtataatcatttaaaacatgggtttggagtcctctcaggttccatgtttgtaatggacataatgataataatccctttcatttaaggctgttgtgaggattaaatgtgttaatgtgcaaataactttacacagtgcctggtatataataaatgcttgctacctattaactagtatttgtttctaaggctaatttaagtcctagaattgattgcaaggattagatcaggagtatagtggacatgttgggatttaaatatttaaatatagagatgctttttaggaccattgttagaaccagaagagattttttaccaagttcacacagaaatgtaggtgcattggctgggcatggtggctcacacctgcaatcccagcacttgggaaggctgaggcagaagaactgcttgaggccaacattttgagaccagcctgggcaacatattaagaccccgtctccaccaaaaaaaaaaaaaaaagaagtaggtgcagagctggaagcagaaccgaaatcatcagtgttacagtcattattctttcctgtcaccattatatgtctttatgaagcaagggagaaagaagaacagatgaaagaagtgaggattttgaagttggttgaaagatttgattgaattctgatctaaaaattataaggcacttgtttaacaagttgaaagtaggaaagtagacataagactctactagatttggggaaactctcaaaaatggactggaaattcagctaaaagtggataacaaaatatttctagaattagcatttgtggggtgtgtgtgttttcactctagtatttgtcaagcccagatgaaagcatagacagaatgtaagactggatttatctaagtctggaattgtgtaacattaaaggaatagtagcaaatgagcagagtgttggctcaagcctaagcttgagcctaagcttgactctatggtaaagtcaagtcaagggagaatagaaagggggtcaccataaaggtcaaaagtgggtttagtggttgtgtgggaataggcagatcaagaaaagaatgaagttaggaaaggagatataagtgttgaatgaccattacaaaaagagacagaggaaagaaaaatgaagatgtatcaaaagaagttgctaatatggatggcaaagtagatgtttttaagaaatcatgagaccagagtcttggaaaagtcataggatgatgcagggaatggagaagagggaaataaagccaggtgctgaagtctttatgtaatgggaggagatgttccagtaatccaatggctattttgatgggaaagagtgtggtatgattgggtggcattgacatcggaagccatcctcattgatggtggtggaacagcagtttgaaagtaacattgtgcggtgaggtagagtggcacatgatgcatccttattcttacctttggagaaaagttgagggagaccaaaaatgactttttgagggaattgtagaagtttcattagaagaaaagtaagtttttaattaaaaagttaatctgaggaacaggtagaataaaagtgtagttgttagtggtagaagagaatggattccatagggcaaaataagaactcaagggaaggttggtggaagaggaagaggattgaattgtttcaagaaagaatagcagttgtcatccttatgaaaagtaaaatttttattttcaaatcaggaaatgtaaaatgtgccttccagaccccttggtggtatacatgggagattggttctaggacacacacagtcccatcccccaccctctgaccccatacaccccctggatactcaaatccactgatgctcaagttccttgcataaaatggtatagtgtttgcatgtgacctatacacaacctcttatgtgtactttaaatcatctctagattacttatattacccagtacaatataaatgttatgtaaatggttgttatagtgtattgtttagggaataatgacaagaacaactttctatacatttgcagtacaccattgttttacccccaaatatttttgatccaaggttggttgaatcggaacccagagatacagagggctgactatactttaagaattagaattagctgggtgtggtggtgggtgcctgtagtcccagctactcgggaggctgacgcaggagaaaggcgtgaacccgggaggtggagcttgcagtgagccgagatcgtgccactgcactccagcctgggcgacagagcgagactctgtctctaaaaaaaaaaaaaaaaaattagaaggggctgtcaggcgtggtgtctcatgcctataatcccagtcatgcctgtaatcccagcactttgggaggctaaggtgggcatatcacttgagatcatgagttcaaaaccagcctggccaacatggtgaaacactgtctctactaaaaatacaaatattagccaggtgtggtggtgggcgcctgtaatcttagctactcaggaggctgagtcaggagaattgcttgaacccaggaggtggaggttgcagtgagctgagatcatgccattgcactccagcctgtgtgacagagtgaaactccatctcaaaaatacaaaaagaattagaaagggctttagagtcccaccactaatgctcttctgttcagtagtacacaagactaataactacgagatgttatgaacagggaaaagaagtaagaccaaaagaaatcataaattactttggatggaacttttagaatggcagatggagggataaatttgacattgttcaaaatcatagagtaaactctcaaaagtaaggggaacctaaggagacaagatgattaaatgtaataggagatactggaacaacaaaaaagggacattagatgcaatttgaggaaatctgataatggacttttgttgatttatcgatattggttgattaattgcaagaactaataaattgtaataccatactaatgtatgatgctaataatgggggaactgcggtttccaggttatataagaactctgtaatgtcttaaatttgtttgtaaatctaaaccttttaaaatagctaaaaattatagatacaatttctaaatgatttaattaacaaaaccagtttaattcttcagttgaaatgagcaaggttagggatacctgtgtgtttcagtgtaatatctgaaaggaaaagaatagatacataatttatatcacttctctctggacttagggtctcttgtcatatacatgactgggcatccatcagcttcagtggaggaaaggttaggaataatagtgtcagaactaacatgagaattttaggagattactgagtcactcaaaatgtctgggtgacccagctgatgagggccatttcacatgaaaaagattcctgcaacaccttcttttctttagcacatgatcgtttatgaagctcttttacattgttttatctttatagcaatcctcagaatagatcaagctttttttttttttttttttgagatggagtcttgctctgtcgcccaggctggagtgcaatggtgcgatc

SEQ ID NO: 1311 - DNA, 1071 bp, Homo sapiens
gagcctaaaaaaaaaggtacaggcaaaaaggtgtgaaaagaaactcatcaagagcaagagtattaaatgagaaacatatgccactgacagagttctcagaagagataaaggctgaattaaaaagagatggaggggaaagttttataagtcaaaaacttaggttaaggtttgtgaatattaaagagcgcttcagattgccaatgaaaggtcatagtagtttctataaagtcaaaagatcaaaaacttgacttaaaagagtaagatctctaaaaccaaaggtaacagcagattcttatgaaatgcaccagaaagctggaaagaaagaagaaataaaatgtgaacttatggaacaagagtgctaagggcctgttctacccaggtatgttatgaaatcaaattcatttagtttgggtgtttgttcctttatgttgggaagataaaaaagaacatataattcgtttcttgagtgaaccagtatttatgagaaataagctgggtgtgtaagaatttaagggatgaaaatattccaagttgattggtaattgaaaagtagatgaacggtgctaacacaaaagggaattctgtctagaataaatgaaaatatggtgacttaaagatagtaggacagcaataagactggaaattagaacaataaaataagaaggaaatgataacatagattgggaaaggataggaaaatactgaaacaaaatctgtgttgtatagtgatggtttcttgttctttcaaccgggagagtgttgtgttgaaggaacttgtattcattttaattacttgagtgtataattaagaaggcaagcacattttgctaagattttctttatttgcatgaattaaataatgatgttcagagtgatttgtctctaggagctgaaagactactacctttgtttcataagctgtaattatttgatttcaagtgtgagtttatgaagaagatagcacttgcggaaaaaagtgaattaccattatgtcgaaagtgatacttttttacatttggccttttactgtaaatcgtggaagtgaattttccaagcctgtgacttggaatt

SEQ ID NO: 1312 - DNA, 1031 bp, Homo sapiens
ttatatatttgatattttaacataatacaggtatgtactttagttcaaataattaatggttttgttgaaatcaattatttttctttactacacatcagcaaacaatttttctaaacactataaaaattaactttcaggaaccatttggaatggtcagccgtaagccatgcagccatcgtgcttaaattggtttttgtaaacgacttgtgtgtgtttcgtaaaatatgctttattttaaaattagggcttcctgttgcagctgttccaggagctctgagtcctttggccattccaaatgctgctgcagcagctgctgcagctgctgctggccgagtgggtatgcctggagtctcagctggtggcaatacagtcctgttggttagcaatttaaatgaagaggttagtaaaataatctctaatgtttattctttaactccatttcatttgtgaaagtttttcatgtttatttcattttgcacttgcctttctttttatgtacattcattagtcaaagtattttctgtatgtttctacttctgaataaaatctacatattgtttaggtaatactttatttccttaaacagtcatgtctctttatatctatatctatatatgtatattttttaacctaacctatttttcctaagaaaaatatggtgaagtactgtagtttggcttatctttttgttgttctcaaaggcaaatgtgatctaatttgcaaatttaactgtaaaacaattttgctctttgccttttctaattatttgcttgttcatttcatgcttatatgtcattgcattttttttaaatcttattttatgtgaactactctaatacatttttctttgaaggttcttccaaagatcttgacgaggcactcttcccgtctttcttagtaattttttctttgcagttattagtcattgtcttctaaaaatattttttaactttattcccccaccccttccttccttaccaccccctccacccagttaaataaaatttattgctaagttattttctttagtt

SEQ ID NO: 1313 - DNA, 1029 bp, Homo sapiens
tgtttcagaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatat

SEQ ID NO: 1314 - DNA, 1048 bp, Homo sapiens
tttgagtaataatggatcagggctttttaagttaggataaaagtccttattaaatgggtagatggatgaatggagatggatggatggatggatggatggatggacggacagatagataatataatctccttacttttcctttaattatctaagtgggggagtgtctaatttctaatacagaaaccttatccattctacttgttttttcttttattctataaagctataactctgcaagaaagataccagacaggacaaagggtcaatattaaacagttactggcaaatgttgagttttatatctctcagttgttgccagtggtagaagctaaaaagtggttcatttcaatcttgacagatagtcctctatggaagccctttgtgacttatgtgaaatgaatatgcggcctgacttcagaaccttagaagctgttagaaatattttctacagtcaacagtttcagtaacagcttgccagttgtgacgtgagctgtctctgataatgtttactctatcaaatgaggctgtagcactcttggatggatgtattgcctggtcaaggatggcatctgttattattggcacaaaagaaatcacacagaattggaaataaacaagtttactttgtatgtattctgcaagatattcaggaatgaaaacctgaaggaagatagacaatgtgttatttaatatttgggtaaataatatataatatttttatctgtaaattaggtagtcagcagtattttatttgatcatatattttattcgatcccaagcttgtgtctcaacaagggccacaatgattattaaaatcccttgtccttttttgtttgtatttgttcttttaacttatgccatacttctcaagggatatgtttctgtgcagtatattcttttataggatgttttctattttgcaagtctatagtcgtccctcctaggttaagtatgaaataactagtttcgtatcttattacaagttttctcagctgggcgcggtggctcacgcctgtaatcccagcactttgggaggccgaggcgggcg

SEQ ID NO: 1315 - DNA, 1033 bp, Homo sapiens
cttataaatgggagctgaacagtgagaacacgtggacacagggcggcagaggtggggaaagagaacatcaggaaaactagctaatgcatactaggcttaatacctgggtgatgggttgataggtgcagcaaaccaccatggcacatgtttacctgtgtaacatattcccctctcaggaaaaatagttttaactaaaaacaattcagaatgtattcctgcctttttttttttttagaatgaacaaaagaaaactccaaagtataggaatactgttttttataagaataaaaattttttaaaaagtataagaatactgttttatttagcttcaagtgcctcaaggaactatgtgcttattggattgtatctctcataacatctaccatgtgactggcccatagtagacaggaagaatatttattaactaagtgaatgaacttcatagttttagttcataattctcacaaagtagttttcttggtgagcatgagctgcttcagaattccctcatgttgccgtctttgtctttggacttcagtagaaaaattttcagttatttttcatgtcaaactttccataactcaattactatacagtcatatgttattaaatgattgggatatgttctgaaaaaatttgtttttaggctttctcatcattgtgtgactattgtagagtatacttacacagccttgagatgtcatactctgctgcacaccaaggctctgtggtgtagcctgttgttcctgagttaaaaacctgtatagcatgttattttagtccattgaaacacagtggtaaatatttgtgtatctagacatagaaaaagtacagtaaaaatagcatatgattatcttatggaatcactgtcatatatgcagattgtcattgactgaaatgttgttatgtggcacatgactctacaaagtttcctgaatttgtttgcatttcttattaacttgattctgctatgggtacatcaaacttaaagcttttatgtaattaaatgtaagttttcagatagccctgaaag

SEQ ID NO: 1316 - DNA, 1044 bp, Homo sapiens
ctgatgggagagaagaatagagcagattgcagtaggaacagatgtgttagaatttattaatcctttaacactgaaagtaaactattgttgattgcctcatggtgtgtttccattattcagtgccttgctacgtgggagtcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaagtggttggctgcagtgtattcttttcctcctagtagctcaagcctcttaaacattctaaaatgagttcagcatgtgttaacaagtatactgcgtattcatttttatttcattatcatttcctctgaaatactattcagtttaatattaggaactcaaagtaatatctaaaaattgacattattaaaattgataactgttcaaaaattaatttgttaaaagttaagtaattgttttccacaattaaaaagtttccaagatttaaattgttatttgagttattagttagaaatccttatataattatattcccactagtagatatatttgggctttgtaaaatttgtgcatattctttacaattcatacctagcttttatttgttaagatatacagtgtttatccagtttattttcccattcatttattgtctactccatgcaaggcacagttgtaggtgcttatgttctgtagtgatg

SEQ ID NO: 1317 - DNA, 1043 bp, Homo sapiens
cttttgtttaagtagattaaaggatttaatagcttcatatgcaatgcttaataattttttaacacagttaatgttcttctaaatactttgtatgacatattctaatataactcagtctatttttatcagtataaatttctactttggggtaagatacctcatttcaaattgaaagaccagtaggatgaactgaagactcactaacaaaaccattttttgttgttgaaaatatgcaaacctgtttttcatcttctactgggagatatgatgtaatgtttagatgttttataatcaattttgtatagcttacatcccagtaaacaacatatgttcccttttccttacatgagccatttctccagttaagttatggggaaaacttttttgtcacttaaactagtagacatttgtttaaatccttaaagcagttttattttttataatattgatgtggtctttattttgaaaatcatttatgagaagaaatctaacctcttcctggacataaataatgaagattgttaaaatattctgtaatgctctgcagaggcaatgagtgcatataatagtcatgaagagggcagattagtttaccgatatggaggagaacctgttggatcctttgttcagccctgtttgaggcctttaatgccagctattgcacatgccctgtttatggatattacgcatgataatgagtgtcctattgtggtaagcacctaatctttttcatgtacttattttgctaaatgctttgatatttaactctctgacacttggtcacaatcatacccatatacttcaaaatagtgtcttagatttataactgatttataatacatagttttcagaatgttttacttgtttaaaagcaaattaatttaccttatgaatttatttatgtaattatccttttacttcattatgctatagaatagcactttgcatttgaaagaaagcaaacttttgctttgttgttgttgtcttctagcatagatcagcgtatgatgctcttccaagtactacaattgtttctatggcat

SEQ ID NO: 1318 - DNA, 1069 bp, Homo sapiens
ttttattgtggtaaaatagacataatgtatatttaccattttaccataaaagttacaattttagccattttaagtgtacaattcagtggctttaagtacaatcacattgttgtgcaaccatcatcactgtccatctccagaactttgtcatcattcctaattgaagcaggaactcctcattatctccttccccagcccctggaaccactatcctactttctgcctctataaattcaattatcctagggacctcatataagcggaatcatacagtctttgcccttttgtacctggcttatttcacttagcataattattttttatcaatacataagagttgtacatacttagcataattcttttgaagttcagccatgttgtagcagatgtcataattttattcctttttttgtcttttttgtgataaaaagcatgtaacgttaaatttaccttagccattttcaagtgtacagttcagtagtgttaagtatattaacattgttgtggaacagatctctagaacttttttaccttgcaaaacaaactctatactcgtgaaacactagttcttcctcctctatccccactcttcccaggccttagtaaccacctgtctgctttctgtccctgtgattttgactactttagatacttcatatgagtgaaatcatgcagtatttgttcttttgtgactgattttttccacttagcataatgccaaggttcatccatctcatagcatgtgacaggattcccttctttttcaaggctgcataatattccattgtatgcatacattttctttattcattcattgtcagtgggcattttattgcttccatctcttggctcttgagaataatgctgcagttaacatgtgtatgcaaatatctcttcaggatcctgctttcatttttatgtatatatacccaaagtggaatgctagattgtatgttaattctatttctaattttttgagaaacttctataatattctccataatggctgcaacatttacattcccacaactattcaaatttctctgcaactttgctaacacctggtatt

SEQ ID NO: 1319 - DNA, 1044 bp, Homo sapiens
gaactcctgacctcaagtgatctgcccacctcggccacccaaaatgctgggattacaggcatgagcctccacgcccagcctgcattcattttttaacaatagtttcactgcgtatggtatttttatctggcagtttttctttctttcagcactttgaatatatcatctaattctctcctggcctataatgtttctcttaaaaaacctgctgctaagactgatggagattcccttatatgtaacttgatgcttgtctcttgctgtttttagggttctctctttgacttttgacttttggtagtttgacttttggtagaaaaaagtatatattttaatctttattgttgtttcaaaactttatttattttgtgtggagaaatatggttctattgattgttgaaaccaacaaatgtttttccccacaactaacatatgttttgagggcatcctttgtgtgacatactacattgggagtgtaagtaatacagagaaattaatcaaaataaaatgtactttggtgaagatcgttttgggttgactctatttaggctttttcattcttttttctcttttttttatgtgactggcttatttcaaaagacctgacttcaagttcagaaattctttattctgtttcatctagtctaacattgaagctcttggttggattttttatttcatttattgaattctttagttctatgatttttgtttagttcttttttatgatatctctttgttgaaaacctcatttagatgatgaattgttctcctattttgtttatattgtctgcttgtgttctcttgtatctcactaaactttctagatatcattatgttgaattctttttcaggcctttcatattttcttttcattgggatgtgttactggagacttattgtgtccctttggaggtgtcatatttccttgctttctcatgtttcttgtttccttacattgatatctgtgcatctggtataacaatagcttcttccagttttgtagatagctttcatagggaaagacattttctcacagatata

SEQ ID NO: 1320 - DNA, 1068 bp, Homo sapiens
tggtatttatatcataaataactttttaattttttttttttttttgagatggagtcttgctctgtcccaggctggaaggcagtggtacaatctcagctcactgcaacctccacctcctgggttcaagcaattctcctgcctcagccttccaagtagctgggattacaggtgcctgccaccatgcccggctaattttttgtatttttagtaaagatggactttcactatgttggccaggctggtctcgaactcctgacctcatgatccaccctcctcagcctcctaaagtgctgggattacaggcgcgagccactgtacccagcctaatatttttcatatttattttaaatgagtattacaaaagtttaagtggcatatcaaattcatattttcataaatattgcttagggtaagctaaagtaggcattgtttcaaacagttaggtattttaaattagaaagttattaatagttcaggtggaacataagtttgacaaaaccatgaaaatgataggcaaataactgaagcttcaggaacacagacctataggataaagctcagagtgattagtgtgacacactggaccttctgaaatgtacctacagttctagactcatttctgctgctgcatacttcacactctgaattgctacaactgagctgcttgtaggggctattttgcacagctgagcatttatccattctttctcttgtgcctacaatgccttctcccctttctttgcctggctaactcctacctttaagactcagctcagtcttaaagtctgcctctaccagaatatcttcctaacatcacaggcataacatttaaacatttgtgccttcttctgtaccaccatagtactttgtacatatcttttccaaagtacttatattatagttaaatgctcatttatatgtctgtttacacttacaacttaagttcctagaaggcagcagctgtgtttcaccgctcttccattcatagtgcctaattagcaagacttaaacaaatgatatttgtttttatgtgattggttgtcaactgattttatatcctgtaagtac

SEQ ID NO: 1321 - DNA, 1035 bp, Homo sapiens
ctgggattataggcatatgccacttcgctgaactcatttgtgtttttgagagtgaaataggattatggatggaatttggcactataaaaatataatatcctttttatattttttatattgaacattgacggttttaattcttttctagcaatctagacaataggtctggaacatacatgttgagatctgtagttcttatgggacaaaaatttaaaagcatttctgttttcagcttggtatggaaatgaatcacttagctagtgagactagatgaacaatgaacacttgtgtcttaattttgtaatcttaatcatattccctgttcataagatgaggaaatcgtatgctttaatgtactttgagaatgtttgcaccttgcagatttttagattttacttttaaaagcataccttttttttttttttaaattgaaccttatgtaaggccgaggtaattaaatctttgaattatgcagagaataaacaaataaatgaacaagcaaaccatcagagggacaaaagagtagtagtttggcaatgagatgtatgcctgcctgtaaattcacgtttctgaggaagtatataaggtttgtttagttgaagatagaaagagaaaagacaatgatactgccattattgaatgaatgaatgaatgaatgaatgaatgaatgaatattttgagaatatgctcaggacactaagccagatggagaagatggattctttttcctaaaataggtaactaagccctctatctttatgcatcttacctttgtggagaatacattttcagtaataaatctagtgacattttctcaatcttcattcaattctatcctaaatgtaataatatatttgcctttagcctcattccatctcctgaaactgggtttttgtttgtttgtttgtttggcttctctgaaatggtacgcctatacttgcatttctgattgtccctttggtagtttgtcaatccttgctcactctcttggctatctcatccactgccatgtcatatctgtcttctctaggaaga

SEQ ID NO: 1322 - DNA, 1033 bp, Homo sapiens
tgagaaggcctggcgcagtggctcacgcctgtaatcctagcagtttgggaggctgaggcaggtggatcacaaggtcaagagattgagactatcctgaccaacatggtgaaaccccgtctctaccaaaaatacaaaaattagctgggtgtggtggcacgcacctgtagtcccagctactcgggagactgaggcaggagaatcacttgaacccgggaggcagaggttgcagtaagtggagatcacgccactgcactccaacctgggcgacacagtgagagtctgtctcaaaaaaaagaaaaaaaaaaaagctactgagaaggagccaccattttgctttaaaatagtgggtttttttcctttttaatgaacactggagctgaggatgcagattacatgagttatttaataagttgattcaagagagagagagtatattagaaatggtaagatgatttggtgggcaaaaatgctttctataatttgaatatgggtttaatttaattattaactatagacagaattacttactgagtataagaagtattttactgtctgggcacagtggctcatgcctgtaatcccagcactttgggaggccgaggcgggtggatcacaaggtcaggaattcgagaccagcctggccagcatggtgaaatcccatctctactaataatacaaaaattagctgggcatggtggtgcgcgcctgtagtcccagctactcaggaggctgaggcaggagaatttcttgaacacaccaggtggaagttgcagtgagccaagatcgtgccactgcaccccagcctgggtgacagagcgagactccgtctcaaaaaaaaaaaaaagaaaacacacacacacacacacacacccacagtatgaatgaaaaaaataaaatacttctttttttttttttttgagacagagtctcactttgtcgccaggctggagtgctgtggcgcgatctcggcttactgcaacctcccactccctggttcaagggattctcctgcctcagcctctgagtagctggg

SEQ ID NO: 1323 - DNA, 1363 bp, Homo sapiens
ctaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatg

SEQ ID NO: 1324 - DNA, 1093 bp, Homo sapiens
accctgtccgagctgccggtgcctcggggtcgcggacccgcatgccgccgctccgggaatcgtcctccgctgctcgggcttgcggcctccggggcccgtcctctttctttcccgcacctgccgccctctgctctggccgcctctgcaggccctgcggcctcgaaccccacgtgcgcctccgccgcggggaggaatgtgcggggctcccccggcggcccgcccgccgcgcccctcgtcgccgcagcctcgcctcgccttcgccgccaggccccgcggagccgtcgccgcgcttgtcaaggggctgggaaccatccctgctctcccatatgttgctaacggggtggcgtctggcgcggggatcccgctgcggccccgtagtacgttcgctttctgtttccacgtctctctgcgtcggtgctccggctctgggctgcttacagtaaaccctgaccggagatgggcttccctcacttcccggagtcggaagcatgacggcagacacctggggcctacattcgaacctgctagttttcaaagaaaagtcatcactgtgtgtcttaagatcaaaagtattagaatcagtcatggcctaaggatcggaggaggacactttgaagggaagaaaggtttgctttttagaaacagttgtcatcacagtaaactttatgcagtgtgtagttaaccagctggggacgtaggatttttaattgaaaaacaaaacaaaacaaaactgttttatgctaacatttctccgttgctacactgtgtggtctttgttgcatccgctgataccgcgttctgaaatagaatggaaaggtgatatatatgtttcacttacctgaagtgtgcagaaattgtaccattaattccatttctgtttatatcttattggagccgcgatcaactgctagcacagtagtaaatgtgtaagtaggccaccattgaggatttgctgaattcagttgaaaaacgtgacaaaattttatgacatttcagaacacggcccagtcaatatgccaaagtttagaaaacttgagacatatgtaatgactttggaatatatttttagtttaacgtttattatatgttatag

SEQ ID NO: 1325 - DNA, 1033 bp, Homo sapiens
aagagcaattgttctgtttgaaaacagcataagtaactaaagaataagttccacatattatattcagtaaatatttaatcatatactgtatactacttcactgatgaaagtaaccatattagtgaatttgcttttaaagcatccatatatagaaatagtttttaggccaggggcagtggctcacgcctgtaatcccagcactttgggaggccagtgtgggcagatcacttgaggccaggagtctgagactagcctggccaacatggtgaaaccccatctttaccaaaattacaaaaatgagctaggtgtggtggtatgtgcctgtaatcccagctacccgggaggccgaggcacgagaatcacttgaacctgggaggccaagattgcagtgagcctagatcacgccactgcattccagcctgggtgatggagtgaaactgtctcaaaaaaaaaaaaaaagaagtttttagttacaggttttcatgtatgtaacattcagtgtaggtatttaagacagctgaaataaaaataccttctgacattttcaaatactagaattctgttttgttttattaaagcattaccacttgtttttaagcattcctgttagaggctaagagctaaagagttatttacagtattcaaattgaattttccttatcttttaaaatgctcatcttaaaatatgatctttattgttttggccatacaattgtggaactacatctctgacagtggaaaatgtatagttctttcagaagtttgtggtaaaatgactttaaagatttgatagaaagtaaggcatatctgaattgcatggtcggaagtacctgaaaaaagtaaaattgatatatcatttgaaaatgaaatgcatatccctggataagcagagcaccagattttttttttcttggcatccctgattttaattaaataggagtcagcaaccgtttcaagagcaggacccaagctctgaccctttgcactcttcacctgcaaggatggctgaagtagtggcaggaaagctctctgg

SEQ ID NO: 1326 - DNA, 1052 bp, Homo sapiens
ctataagtattttgctttatttctgggttatctgttgtgttccattggtcttcatgcctatttttataccagtaccatgcggttttggtaactgtagccttttgtataatttaaagtcgggtaatgtgatgcctccagatttgttttttgcttagtcttgctttggctatgtgggctcttttttggttccatatgaattttaggattgttttttcttgttctgtgaagtatgatgctggtattttgatgggaattgcattgaatctatagattgttttggtcagtatagtcattttcacaatgttgattcttcccttccatgaacatgggatgtgtttccctttgtgtcatttatgatttcttttaacagtgttttgtacttttccttgtaaagatctttcacttccttggttaagtgtattcctaggtgttttgttttttttgcagctattgtaaaagggattgagttcttgatttgattctcagctttgtcgttgctggaatatagcagtgctattgatttgtgtcattgattttgtatcctgagactttactgaatcgtttatcagatctcggagctttttggatgcgtcattagggttttctaggtatacagtcatatcattggcaaacagtggcagtttgatttcctcttttccaatttgcatgctcgttattcctttctcttgtctgattactctggttaggacttctaaattttttaattactatgggtacaaagtagatacagatatttatcaggtacatctgatattttgatacaagcatatgttgatacaggtatacagtgtataataaatcagggatactggggtatccattacctcaaacttttatcatttctttgtgttaggaacatgccaattccacttttattttattttattttttattttttgagacagagtctcgctctgtcgcccaggcgacatacatagtacagtagtgtactccagcctgggtgacggggagactctgtctcaaaataaataaataaataaataaatctgttcagactaatgtcctagagt

SEQ ID NO: 1327 - DNA, 1050 bp, Homo sapiens
agctcatgtttgcataggacagcttactacactttgtagagctgatagcttctaaatattaatagtttttaatgacattgctataaattgctagtgtctgataagaagcttgattttagattaagtgatttcatatttgtactggttctaaggtagggaaaaaaaaccaggtagtttactaagtgataatttgtttaaacaatgtaggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacaggtaattctcattcaacatgatcaaattgtatggttcatttggctagattaaaggctactggtttttggtcatgaaagcttttatgtgagattctatttgagattggataaaatgcttaaaaaccagagtttaagggactgtgttcttctacataccaccttgtgaaaattggctgtgcatattttttttccacttgagaatgaaaaattttaagtacctagtttgtcaatggcatatgtaacaaaccatttctctttactactagtctcttttgaaacttttctaatatcacagttgtgtatgttaactaacttttcatacaaaaggcaggcttatggtaaataacctttgttcactgtttgctatatttccctcttttcaactgaaaattaatgccaaacaatgctgatcattttggccaatattagcagctcatcagtttcctggcttatttagcagagttctgtacttatcttccaacccactaagactacttttaaataaaagaatgtttgtgggctatacacaaaactggcagtgcaagcttctgctaagaatgaatgtaattttgggctaaaacaaaggtctctttttcttggtaacctgtgtttttctcacttccagtcacttgaaattataattaccttcttgaaacaaagaaatggtaatttattttgct

SEQ ID NO: 1328 - DNA, 1058 bp, Homo sapiens
gccattcttctgtttatttcacagtctccttccacttctgtccttaaaatactaatattcaggccaggcacagtggcttatgcctggaaacccaacactggaggctgaggtgagatgattgcttgaggctaggagttcaggattagcttgggcacataggaagaccccatctctacagaaatttgttgggcacgatagcttgtgcatgtagtcccagctattcaggaggctgaggtgggaggatcacttgagcctaagagtctgagtctgcagtcaactgggatagcaccactgcactgcagcctgggtgacagagcaagaccctatctcaatcggtcaatcaatctcagacccatctgctacacaactaatgtgtctttccctttaaactcttcggtacttcctgatatagtccaaactctttgacataacgttttagtctcaatctggcttcagccttcctctctttacattccctgtctcctactttgctgttcagcaacatcaaaccctgtgtgcttttccatagactgtactatttctactatatctggaatttcacccccattcacctactcacccaaacaaaacaactggtcaatttttactcatccttcacctcagttgtcaccactctcagggagctcccttaaataagatatgcctccttggtgttatcataataccctctgcatatttttaccttgtggtattttaattatctgtttatatatctaattcttccaccatgctctgaattttttgagtatatggtatatacttagtacgatgcttgctatataacaggaacacagtgaatatttgaatgaatgaataatcttggctaccaatttgctgtgtttccttgtccctttctgcatatgtggctttgtcttttaagttctttataaaagatgaattgagataaattgctaaagctccttctaattctgaaataacttaattcttttttttttttcttcgagacggagtctcgctctgtcgcccagactggagtgcagtggcgcaatctcggctcactgcaacctccgcctccc

SEQ ID NO: 1329 - DNA, 1064 bp, Homo sapiens
aaaatatttcaaagccaactttagttactaagtgaaaaatgtgatgttaagcccagtacattaaagatgaaggaagatgttaatcaccaccaccacccctcctccccacataccttctctgaactggatcttttgaacgatatatatagggaactaaattagcaagaaaaaatgtaaagaaattaaagggtaatttgtgacttgacaagataaaagtagaaatgtttcagaaaaattttagggcatagggaatacagttgcattaaaattaccatttgaggtttcaaaattgttatttgcctaagctgtacatctgagctttctgattcagtgtgcgtggaaggggcccaggcatatatatttggacaaaactcacaggtatgtatacctctgaagaagaaccatggttgtacaatgaaatgtgttatcttgaggctattaagtttctttctcatcaatcatttgatctttgtgtctctgtaggtttttcaataaaatgggcttgacattaactctctgcctacataagttggagttgtgggctctttcctccatctctcttcgtattacttatatactcctcttctgatttcaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgaagtaaatacatttttcttttttatgtaattaattaaatcagggatatagatttgatctgtaatttgggtataattctaatctttgctgaaatcacatctc

SEQ ID NO: 1330 - DNA, 1032 bp, Homo sapiens
ccacagaaacaaactggtatacgaatttgaaggagaaggcagagagctttgagaacataaggcaggggcctgatcttattgggttgccaaaaagactgtctcactttagagctgtgatcccaaggaaacggaggaggtggcatctaaacactgcgatgatgcaaggtaggctcaggttgagtctggtcacttcataggccattcccagccccctttagagtccttgaagtcagtgtctttaagctccataatggagatttcagactatctctgtgccctcgtatatgtgcaggttcctgtgcaaattgtaagcgttaagtaaatatatatgctgattgaattacagtcatctgtggtgatttgtgctctgttccacctcctgctggctgcgttgtatcccatgttggaagtggctgagtgtggcttcagaatagacacagaggaagtgggagagtgaatatttggatgagggagtatgccttgactaaatactttctataagcaaatacaaatcatatgacctagagcttttattttttaaaatcagtctattgctttctcttgaagcacatcattggtgaattgactctatttggcttgatgctttcatacaactgggctgagaaagttcattttacccctcttttgggcattcccactatagttgtagtgatatagtcttttaaaatctcattcaccaattattaattaagctgaattaacccttttgggtagatgcattcttatccttatatgtttaaagtagctgttcattaaacataggttttttgctgagcatctatctgacaggaggcatctgaaggtttataaaggtatgggaagcttggttacttgagctccagaagctttccactttagtctaaaggaaactaattacaaaagagctgtgaggggcccatcaggatgtgcttatgagtttctatgagggagccagactgactgtgtgaccttgagcaactaattctcagtgcttttcctgtaaaatgaaaatgggaataataatggaaccta

SEQ ID NO: 1331 - DNA, 1049 bp, Homo sapiens
tgctggaacaagaaggtgctttggtgatttgtgttgcgaaaattcgctcagactactttttttttttttattcctacctttagggttccagatcagttttaccaaacttagtgaagtagggtaggtgccaaagtttttgtactctttacggtatatttccagtagccttagttgataaatatggttttgaataagattgcagtcatttaccttaatgaacatagtaatagttattattttgttgaatgttatgaaaagctcttaaatacctgagttaaaaccaatttgccattatttttatttttaaagaaaaattgttggccgtgtgggtggctcattcctgtaatcccagtgctttaggaggccgaggcaagaggatcacttgaacccatgagttagagaccagtgtgagtaacatagtaagacctggtctctacaaaaaaaaaataaaaataaaaattagtcaggggtagtggcacacatctgtagtcctagttgcctgggaggtttaggtgggaggattgcttgagcccagcagtttgaggctgcagtgagttatgatcgtgctgctgtgacagaatgagtccctgtctctgaaattaaaaaaaaaaaaagaatagaaaaattactggttaaatgggtgtcagtcagatgttgatgaaatgcccagagtacaggtcttggtctgtttttctggtgttattgctagttctagacagattttattctgctgatttcaggtgaccttttaagccatgactttagaattgaattttcatgtatctctgtttctttagatgagtaaaatgattcctgtatagccttatgttaaatctgaaaagctgagattctgtttttttgttgttgttgttgttaggtacaggtcacgttcaactttgggccctgcctcctgaggcatgtggttttgctctttcatgaatgggagatggttttgtcctccctactaattctcaatacagtttcgtcttgtaggtctcaatgatataagctctttcttttattgtagctggtacatatatgtcatagat

SEQ ID NO: 1332 - DNA, 1025 bp, Homo sapiens
tattatatataaatatactatattatatatagtatatataaatatatactatatattatatataaatatatatattctctcatcaaatattattaaggacctattaagtagaaatattaaggaagaaaaaacagtaaaagatgcagggtttttttggggggctaaatatctccctatgataaaaggaagacaaaaactcataagaataattgatttttcttctcctaacaaagaagttaatcactatgatctattctgtcatagttaggtctagttcccaacaggttctaactataaatttgttttatttcattttgtatacatataattttacatacaaaactgatgtaaattagaaatcaaggcatcttttgtggggctttttcatgttattctaagtgtttttttagttccagtaagacagtcttaatgcaatataaccagttttataaaaagatttctagatatgcattaaacatcaaaggtttcaagctgtctcttcagattagtgaggatcatttctgtaagtaggagttccagaaatgatgagtagagtttatcaatttagcatggaaaaactaattcaaattctgcttttagggattacaacatggattttttgactttgagacatttgatgtggatgaatatgaacattatgaggtttgtacatttaattttttttacaaaacataatttcatgttgattaattttttccccctgtcacactcatgtattgcaaatcgagtgggtgctaaataaaagcattctggagttttccatagtggtcagttttgtcctttcagccttggttatttcctttgaatcaggagtcaccaaaattttattttggaaaaacaacatatctatatatattctctcatttatatacaatcactttgcacctttagtttataagaaaaatctagtagggtagtaaaattatgttacttttattttagaaatcaggttttatttaaaataaaactgaatttgtaccttttatttatttatttttgaggcg

SEQ ID NO: 1333 - DNA, 1028 bp, Homo sapiens
atagtgggcagtcattatttgtggaatgaaagaactaatgagtaaatgtgtgaataatactaaaaacaggagtatagcacatttcaagatattttatatgatctgttttcagtggaaagtgcctaaaacatgttgattaagaatccattctgattttgcagtaatattccaagggacaaatttaccatggtagacaacttcttcaaatgatgtttcttttatcagcagccaatctatgctgcaagagtgaggttttttttttttgtttctaagtcagttatttacaacacagattgctagatgttttaatctaagaccagttctgtatggaacatcaatttagtttaatatgtgagtggggacctatctccaggttgactctgtcatccttcactgcataagtaaattttcagattgaccaggtggtgtagagtcctaacaattgctctttagcacctaccttgagaaatagtaaagtttgttaggcctcctgtctctcagcaagtcacattgggtcaagagcaggagtcaatattgttgaacactgaagttatgatgcttcaagactttgtttggattagaatttgtacagcaaactaaaatgtaatctggatgctgcttggtctgccttctttacatgttggtggattatggaactggaaataatgggactgccataggactggggtcaagcagtcctcagaatgcaagtatgtgggcatgtcctcaccacctggagcagttatggaagtacgcctcctgtggcaatttgaatattggaagaactattagaagaagcattctcctggagctgtctggtagtgttcattacaccactccaaagcctcaagtttaaggaagcaaaattacttcctggccaccgcaactgcaaaagtgaggggacccagtgtttccgtatctgttacacccattgctggttcaaagctcacgttggttaagtctataaaatgttttgagacttaccctgacctaaacaattccccatggcttttttttcttcctcttta

SEQ ID NO: 1334 - DNA, 1040 bp, Homo sapiens
taagtgataacttgctttatagttttaatttgctttttcttgatgactaaggtcaatctttgtatattctagatactagtcctttgtctggtaaatgtttttcaaggtttttttcagtctataacttgtcttttcatcctcttaatagggtcttttacagaataaaagttttaaattttgatgaaatcccttttatcacttttttctttttgatattgtctgagactcttagtttagccctagactcaatgatttctcatatttttttttctaaaaagtttatagttttacattcacatttaagtctgtgatggattttgaggtttttgtttatttcataacgtgtgagacttaggtcaagcttctttttttttggcctatgcatgcccagttgcttcagtaccattttcgttgaaaattcagtttctccactgaattttttctatagcagcatcaaaaatcatttggatatatttgtgttgatctatttctttgttctctattctgttccattgacctatgtgtctccttccttcaatgccacactctcttgattactggacctatatagtgagccttaatattggaagagtgattccttccactttctccttgtttaacaaaatattcttagcaattccactttcttttccttttcatatacattttagagtaagcctgtctaaatctacagataatgtttctgggattttaataggaagtatgttaatcctctatatcgatttggggagaattgacatctttactattgttgagtcttctaatccataaacatgatatgtcttttcatttatttagatcttctttgatttctttcatcagcattgtgtagttttctggatgcaagtccttttttgttaaatttacacctaagtacttatttttttttagcaattataaatggtatttatgtccatatgttcattgctggtatgtagaaatacaattgatttatctttttctttctttctttttttttgagacggtgtttcactctttttgcccaagctggagtccaa

SEQ ID NO: 1335 - DNA, 1040 bp, Homo sapiens
atgctttcagaaattctctaaacatcttcctagtgaatcttccacttgtaccacagcatttgaagaactccttgaatacctgttgccttcccgccccctgcatcttggttactgcttcccatctgtcttcctttgatagcaaggtagaccattttgttagcccacttctttaggccaggaactgtctctgtttccataatagctctgggctggtggaatagaaggtacacaaaacagattggtactcaagtcatggctagagtaggcctaggccaagctagagagtgggttatgtttctatttggagtgaccaaacagtggctttggatggactttggggtcagggttgagttttttgggaaaattgtccaggatggaagaaggataaagataaagagttcggttggtgtggagatgggattgggctgggcttagggaagtgaaggaggacaggtcagccacacacagaagcctgcacaacagcttccattgtgttctggactcagaactaggaatattcactataacagtgtgactgacttgaatttcattagaggaatattaaaagcagatgtaaaaaaagacctgtgaaggctctagatcagaatcaactgtaacttggctcataataagccaagttatttcgttattttcttatgtcccatgcctggctagcctaaacccaactaacccagggcaaggacatggctgaaaacaaggaccccagcactggctatacttcttaaggctctattcaaaccaagacacatctcttcctgtcattttaaagcacatgccctttttagcagagggtcagtaaatttcatgctgtcttagaaaatgcactatattcttggagaatgtactttgagctggtgtgttggcttcataagatttgatttttaaatactaaatgcttaaaaatacatgttttacttcttttgtttgagatgaggcttttagggagtaatagacaccacaataaaagctagcatggtttgcattttcaataaaaaggaatttgcgtgaagtgctgcttt

SEQ ID NO: 1336 - DNA, 1030 bp, Homo sapiens
gtatttttatcctctagtgcttaatagatacaacttatgttcagtaattatttgttgaatgaattgaactggtgggacagaaggtcaattcgttggccaaatggtgtcatcatttgtttgcagaggcctgcagggccagttaggcaacataagagagcaaactagggggttggaaaaggaaatagtggggcttgtggtgagctgtatctgagcctagattaaacaccagccagagtttttgagctctgtggaagtaaaggctttggatagaagactaatgaatatattctccatatgaataatagaaatctttaaaatgttctagactatttctgttttccagttcactgggtactgtgattcactaaataaatatgtaaataaatgaatatatatatgtgtgtgtttatatatataaatatatgcacacacacatatttgcccctctatattgatgtacatatgaaatactttaccctataaaaaagttggtttaacaaaggtcgcttgtctaatgtttatttgctacatctctgtttattgataattgatggagcttgcaaaaacaactttgttctaagttatatgcagtttgaagaatttctgatttctgttagtgataacatgcacaactttactaatcggaacaaaagtaaaagttaaatattctcaagaaagcactagctgagctacacacacacacatacacgcacaacatacctttgtggcattcttatagctgggggacttaactggctctgccctctgactgcttgccagacttagaagaaaccgagaaaaagcaggtagaaaaatgtttatgctctaattgcgagtgtggtagctggcgtccctcaagtggaatgtatatgggcttcaaggcttttgaccaacttcactggactttcttagggtcttacctcttttattcgcactgtgggttcaggtatatttatagtatagtgctctgattcttgatcatctcacacctattttgaagtattagcatgaaccacatacaagaaagtca

SEQ ID NO: 1337 - DNA, 1041 bp, Homo sapiens
tgtgtaagcagagctcaggatgcatactctgtttctttctcttccccacccctttgtctttcctattccctctctcttctgctttcttactaattcttcccctctgtccttttcctcctcttctcttcatttcccctgtgagtgctcttttacattctcttccttcttcatctgtctctcatattttctgtctctcactcttgttcccttcctcagcctcttactctctcttatcttctcctgaactcccttttccttctcttgtctttgcttcttgtcgcttgggcttgtgctcatgctcttttttcctctctcttccttcttctgtccccctatacctttcctgtcttattctttgttttctcctgctcttttcctttaccttttaaccctttatctgtcaggctcaatctctcctcctcctcttctcttaacttctttagctctatttcttttttgtctccctttccaagtctctctttccttccttcactgattctccttccctgagctctccctttccggtgcagtttctctcactctctccctgtcctttttacagccatcttctttcatgtactgtctcttaggcctcttgttatgtcttttactctctgtccttaactgctccccctttctccctggcttggcttctttctttagcaggcacacactctttctttcacatgctcttgttctgtttagatatttattgagggtccatatgagtcaaatacttttctagttctaatgatgtaaaaatgatctaatgatgtaaaaacatgcctcctgccttgccggaacttgtctcttgggcaaacagttctgtaaaaatacaataatagctatatattgtgacagttgccaaaaaggagatgtggagttctgtggcagaacttgctgattttagttataagcaagggatatggttatttttgaaattataaaaagtgagccaaaaaatactcattgtacattttatagtatagagcagtagatcctatatatctataaattcaaacagcttgacagctcagataa

SEQ ID NO: 1338 - DNA, 1992 bp, Homo sapiens
ttttttgtcaactatgacatttttgaagaatcagctggccgggcgcggtggctctcgcctgtaatcccagcactttgggaggccagggtgggcagatcacgaggtcaggagatcgagaccaacctggctaacacagtgaaaccctgtctctacttaaaaaaaaaaaaaaaaatacaaaaaattagctgggcatggtggtgggcacctgtagtcccagctacttgagaggctgaggcaggagaatggcatgaacccaggaggtggagcttgcagtgagctgagatcgtgccactgcactccagcctgggcaacagagtgagactccgtctaaaaaaaaaaaaaacagcaacatgtcaatgctttttgtgtttatttataaaagttttaaaatattcaaataaaaataccagtaggtccttttattctgaggaggaagtagtaaaaattgattttaaagtttataaggaaaaaacaaacaggaggaatagccaagtaaatcctggaaaagaagatgtaaaatataaagcctttgtaatgaacataatgagatacctgaaagagcaagaagactaatggagcagattaggaggtccagagatgggtttatatatatatagtggcttactaatgataaagacagcacctcaaatcagtggaaaaaagatggcttccctaaaaactggatagccatttggaaaaagataaatttagagctctatgttatactatatacccggaaacatttcaaatgggttagtgttttaaaagtaaaacatgaaaccatgctagtattaaaagaaggcatggctgaaatatttacggtagcatgagaatattaaggggtagctgtggctcaaaactagaaaatcagtaagagaaaagattaatgaattaagctacatttttaaaaagaagaattttggcataagaagaaagcatcataaggaaagtcacaagacacaataaattagagtaagtattggccacttagatcatgaaggactaacatttctaatataaagagagcttctaaaaataaaaatgtaatttaattaagagactaacttcctgatagaaaactgggtaaaagtataagtttatttaagttacaggaaaagaaatacaaatttaatgtgattaattaatttatttttaaagacacattcagtgtcatgatcggactataacatttagcaatcaacagcatggatgcaaaaaataaaatcttatattaaaacccttcagtggactgttttacactttccacagaacataaactaagataacctgttattaattgttacataattaatcacaaatatagttttcatgttttttgcccatatacacaaatactgtctaaaacatgtcttctttgtagcagctaggccctgccaccactgtgcttggctgaattcacaaatccgttgtaacctgtagtttccctgtcacttctctggctcttctctcctgctaaactttatttcctagcagtaattaaaatctgctactgccatagcttctgcagctattggaactgccacagccaccttggtttcatagtttagaaaagaatttgcctccaccaccataggggccagatcttctgccaccaaagtttccttccttcatgggttcagaatttgaagactgttgtaattgccaagatcattgtagctttcagcacctccaaatttgcttccattattacaaaatccattttaaccatcccactgccaccatatccaccaccaccagagctaccaccaaagccaccatgaccactaaagtttccaccacaaccaaaattgccattcccaccaaaaccacctccacaaccaccaccaaagtttccagaagcacttcacccttttcggctagatgaagcactaggcatctcttgatttgacacagcttccctaatttcacaattgtggccattcacagtatggtatttcagaatgacagtcttatccacagtcatgcttacaa

SEQ ID NO: 1339 - DNA, 1033 bp, Homo sapiens
ctcactatgttgatgaaatcctattttagtttgggttgccctagagacatgattcatgtccccctgtgacatggattcaagtgcaagtagtttatctgggaggtgatcctaacaaacacctgtagaggagtggagaagtgagacagggaagggaaggagccagcatcgggttcagtgtcaattaagttaccactataggcaacaggagcttaagttgctgagtaactcggggagccagcgtaggagtcatgtttcagagttatcccactggaggggaagaagggaaatgggatttatagaccaactcctcagtcgttggaagacagctgctgaaaagtgagggagtgtgaatcagattttttccacttggcagatatgcaaagcaagctttggggttagagaaagatgttaggtgaaatgctggcagttagaaggaaaaggggtgcgaagcaggggaggggtatgtcagggtactgacacaaagtacccctttgtctactacaaagctagaactcatttagaaaaagcaaagcaataacaacaaataacagcgaaaaagggaatcaggttaaaggaatcagaaaagacagaaaaatgctaatcagaaaaaaaagctttgttatagaatcttagttaatccattcctaattttcagcaaagaagatccacaaattatactaacatgttgcttgtgaaaaaggaggcactaccctccaagtctcgtagttgaagaagaatggaacccaacttttccacagcattacttcccataatgctccaaggtgcacctcttttcttcagttagcactgtctccctactgcccagtgtgctcatgccaggctcgtggtaactgctgtgcctttgttcgtgctgctcagcctgcctgcaatcctctccatgttgtgaaaagtcttcccacctggaggacctaactcagaccctcctctggccagtgaggtcctgccaacaacctcctgatttctccctccttacccacctggctagggtaagaagaatggctgggcagaagaa

SEQ ID NO: 1340 - DNA, 1044 bp, Homo sapiens
taaactacagggtgagtatcgtcttcctttccctaggtaaaattgaggctcaccttaggtccaaatgctagcggctgaatcaggattctaatccacgtcactctgactctaaaggtcatcttctttctactgtatcacactgcccttttcatctgtaactacactgtcctcccattttttaatttgtaaaattaagccagtttctacaggaattattctttactttgtgttttaagataactgcagtcatgtacttgtactgccacatatggaagtaggagaaatcttttcaaccaggttatttcattaacagtggagctcagcttaaggcctcatccatgaggatgccatgtagaaagagtggagggatatctggctaaaacagctatgttgtcagagtccaaaaagaggaagaaaaagtacaccttgatctttttccccaataaaagcagtttttaaagaaggcacggtagatactatctcagtttcctatcaactgtcttggagtttatagaaaataatgactacattcatcaaattctgacaaaacataaatatttttgatagatataagatcaacattttcttaacttcccaggtagattatgtaaaaatcagaatctcagaactgaaaaagatcttattgtgcatttggcccagccttctgtctgttgcaaaatctcctctatgccatcaagttggtattacagcttcttgaccatttctggagataggtagttaacaccctcacagagaagctccctctttctttgtaaactgctgtaattgttataaagatcttttcacattgagcttttttcttttaacttttggttgttgatcttatttcagctcctccagatcaatatggggatgcagaacaatagcagtgatttgggtatctgtctttttcctgatcttcagggaatacatctaatgtttcatccgtattttctgtacatttttggtagttagcctatattaagttaaggaagtgtccttctaatagtttttttccaagtcataaataagtgttggacttta

SEQ ID NO: 1341 - DNA, 2327 bp, Homo sapiens
ttggggagaatttagagagcagtatccttgagtagcaagttcatatccaaaacagaagagagaacttggagtgcaaaataattccaatagatggttatacttgctaaattgtttactaatcatttatcacaggaggatttagacagggttgatgtatcaatttcaactaggagccaaccagtcaagcatcatggtgtcctctaacagagtaactgtagaaggtgaactgcatttttctaagtatcacctggatatctggatagggtgtgtgactgttaacatggctcttttttttttgtttgtttttttgtagtggtaaatggagattattttttgtagcttatgaatatatttgtttctgaaatgattcttttctttttttaaaaaagtgagatttgtaaaagaaaaaaaatactttcctgaaatgtgtagggtgttattagcttgttagattttctaacttttttttttcttacttttcaggctggagtgagacagctctacgtacagattgactttgcagccatgtagtgaatggaaagaaattatgcaccttttatggaccaaatttttctggtactgtacgatccaaaacattgtacccagctttttaaaagagagaaattatcactacaactcccgagcactaagtagacggggtagagtcagccgttcatgctttgtggggagttcacagctaagggatcagatttaagaggatatctcctggacttttggtcttttcttttgtgctctttcctccaaatctttttgacttctgaggtttttagcttaggatgttaatttgtccttttgtctttctttttttgtttttgttttctgtttgtttgttttcatgttgaatgcccacaccaccatcctctcatcccagccagtaagaatttcagttgtgggcctccagtcttctggaatgtcttcactgcagctgctggaaatcactgctttcattcccacaaaaccagtattacttttttttaaaaaaagaaagaaattggaaatctgtgctatacgtaatgtcataattgttgacgttcttcagtataatcatgtttgttaaattgtttgtaccttgcaaacttatgaaccaaaccatattgggttttcaaagtgcctttgtatccaaaaatgtatttgccagcatagaaatgtaccatcaagagtcatgtatgttttatttttgtttttattttttattttttgagatggagtctcgctctgtagccaggctggagtgcagtggcataatctcagctcactgcaacctctgcttcccgggttcaagctattctcctgcctcagccttctgagtagctgcgactatgggcgtgtgccaccatgcccagctaatttttgcatttttagtagagatggggtttcaccatgttggccaggatggtcttgatctcttgacctcgtgatccgtccacctcagcctcccaaagtgctgggattacaggtgtgagccaccacgcccggctatgtttttttttttttttttttttttttttaacaatggatattctgtaaaatatcctgtacaaaacaagactattgccagtaatgtatacaaattgtctttttgtgtacttccagcataggtttggatatatgaacatttttcttttattgttttatcttcacagaaaataaaaggtgttaatttgctttttaaaacaaatttaattatcacattttaaattactttgtggactgtgttttcaaaactttgcaaattcatctgttacacagaaaattttgacttaaaacatctgctgaattccaaatttctgtaatagctactgtatctgtgataaactttcctatatctttccttgccatttctatggattttataatgaaagaaaaaggcattggagactgaaggcagaaatggttgtgacagtgctgtttggctttttcattcttcaaatgccaagtcatccactttgttttcctgtttaggctttgcacaaatacaattgctttcaggaatcctaaagcagcattttattgagtttgaattattaaaggtacagaggaaatgtggtgatgtagaacttttcctaacacaggtatctaggaagtaagtgctgagttgattttctaggttcttacgtatttgaaaaataaaattgcaattcgagataagtgcttgagcactctacttaagtattctctgtgttttatgaagagaaaatgatctgattttcccttatacttcattttacaatacatattcccttttaacttaaaaaaattgtaaatgtgggagaaaaaaccctgcaggatggaaacaattattaaga

SEQ ID NO: 1342 - DNA, 1049 bp, Homo sapiens
ttacaggtgcacgccaccacgcccggctaatttttgtgtttttagcagagacagggtttcaccacgttggccagggtggtcttggactcctgacctcaggtcatcctcctgcctcggcctcccaaagtgctgagactacaggtgtgagccaccgtgctcagccactagctttggttttttaaacatagattatattcctcaagatgaagggcttaacatatccacagcttcctcagtttgctaactccccatgcatctttgtgaaggacagtatctagtttatctgtaggtcagtgttccttgtgctgtcatttcccttatatctggaatttgtcagcattcctgaaaacctacacgtgtatatcagtaaccaaaatgctatgccttttttgcacctttgtacagcagccaaatcatgaactcaaaatgtatttgatcacagttctataatgtttttacctacctattatggaataatcagtttttacagagattattaatatggtagaaccctgttatgtaattccaaaacttaagaaccatatttacattgcttaacacagaattttacatctaagcaaggactggctttagaagcagtgtagttctacctctcattttacagatgagaaaaccgaagcccagaaaaactctcatttgctcaaagtcacagagaaaattagtggcaaagccaaaaagattcagatcttctgactcgaagttgagagttctttatactctattatgctgcctctccagtgtaatatttgcctttctgtaaatgggattaaatatgatttgtaaataaaggacatctgacctccttttttggtacattaaggcactttataaatggacttttattgtctcatttttcgtatataattatttccatcatattctttatggaagatgcaattaattttaacttttttactcttataaaaccagttcctgacattttaaaaaacaatatctgtaaaatggatccttttatgagtgaatttttctgctaattgcccaaggctaaatccaatttaaggattgct

SEQ ID NO: 1343 - DNA, 1113 bp, Homo sapiens
gagaaactgaatttctatccaagagaccttaatttagtttattagggaattatcttccccaaaagtacaagtaattttgcactgcaggagaaggataagtagatttgatttacatcacattttatacacacctttcaaaaggaagaaatctgtttcataaatagtagtaatctatgcttaaacttaacatttaatgttgacttcttacaacagccttgaaaattatttgtaattttgatcatgatgttggaaagcttgtaataaagaatatctttctcttctgcatccttttatcctcaaacttagcatggattcacatgctgagtaaatgtttggttaactagtgaacattttagatagttgtgtcaaaaataagggttagggataggtaaaaccagtaatttactgttttttacagaagacatctcagcatttctttggcatttttgcacaaataaatgactatatattcaccttggccatttttttttttaagtagccctatgagctgctcattctttttcatatacagtggaagtatacagatgttatccattttacaaattgttggatcggaatttgacagaattgggactgtggaacctgggtcacttgaattttctatattttgtatggccaaatcaggaaccagacagtctccatagtctcctttgtttttatggaaaattgccatattcacatatttcatttatcctaatgtattgtcatccaaaatgaaagaggtctttcttgaaggtgctttaaagacatcactacatgtattcaattactgatttaaatattcccagaattattttttacctttctctttttcctctcaaacacaaaattttagtagtacctccctctatttcttcactgatttttcatctgttttcattgttatttccactatagaacttctactttatactagcggggaaaatttttttatttagaattttaatatttgaattttgtttatgtatcacatactgtgctacagttagcctcaatgaagattctattttgaactagacatcctgtcaatagtttgtcaagtaacttcattgcttcctttgatagcaattcagtgaaattttttcccaagtg

SEQ ID NO: 1344 - DNA, 1028 bp, Homo sapiens
cagagaaaaggcccacgccgccggcctcacctacggtgccgcaaaatgctggtgcctttactgcactttacgactagcgggagggggccgggctagcgggctactgggctgcggagaccagagcccggctccactgaagaaacccgccggctgctggggcagggcggcgaaaggtcagtcggccgagaggagtccgtggagccaccgtttcatagcctcagggaaaggatcgggcgtgctcacgagccctctaacccatggcttaaacacccgcttcctaagcctgggtaagtgcagtagctcttcgctcgagaggagccacgtggaagagagtcgggaggggccctgcgccctactcctcctctccagaaacagggagggctgggaaggattttcctgatttgtccccggatttggccgagtgcacagattttaattccagtcttctcatcctcctgtagttcaactaggtgtcttcctggtgaagcgtgagattggcaaacccagcagtgagtgtgcttctgatttcccaacaaggcaatgactccttgggtttgtccccaagaccttatgcctggagtgccccaaggatgtttcagtcaccctcagtgtcaggaatcccagaccttcctgtacctaaagaagtgacctttaatagtgctcagggatttcagacctctcaagtgtttctgccgggggaattcttataaagctgttggttacatgtaattagaaatagggaagatttgttttgactgaaaatgctcttcccaaggtgacctcatccaagttaaaaaagacagctgtcattgcttttcttagcaggcagtgttggttactcagaattttcctgttgcctccccgacaatgcccaactccgcttccttgaaccttggctttttttcattcccaggttccatccacctttttgcacttcctatctataaactcttcgtggctgtgttttatcccctctcattacgttgatctattcctcacaccacatacacaccccaaaaaactcaaaa

SEQ ID NO: 1345 - DNA, 1035 bp, Homo sapiens
tcctcattttgtcactcttgtagctgataataatgtctccttcactcaagggggtcagagagttatagttaacaatctgaaaatattacaccccttctagatccttctgaggccaagagaaagtccaggtttgttaacataccccacaagatcattcgtggtgtggccactgcctacctttttagcatcatctctctccactccataccatgagctttctcgctttctctccagcaatactgaattgcttgtagttctctgcccacaacatgctgctttgttcctctacgctgctgcctcatcatagaatattgtctcccattctctcctgcctagatcactaatacccattctttaagaccaagttcaggaagccttcccagagaccctcacccccctaagctaatttaggtttctcctcttcattacagtattactctacatatacttactaaccaatttatgagattttatatttgttcatttgtatttcttctttaccaaactattgatttagttaattcagggactgcatcttatttgtatgctcatcttaggtttagcactatcccttgcacataataggtattaaataaatgtttgttgaataaatcattattatccactagtagctgagctacgtatttttccatctttattaatacagagggtggtatgttttaaaaaactaccaaaaaaatcattaatggaatatcaaatataaatatgcctgtctcatgccactttagaaggtcatttgtattgaaaggcttgcaacacacaaaacatatagttcatatgcatgctattgagtaggtaaacacattttccaatgtgttgatcatttatgttttttgttttcagatttaaaaaaataataatttcaggtagattcacagtgcaaggacactgccaaaaaggatgattaagtaatctgaagaaggtgtggtttatctcctttcaggaaatatatctatattgaaaataaagttattctgggtaatcaaggaagtgaaacattgcctgaaataacag

SEQ ID NO: 1346 - DNA, 1049 bp, Homo sapiens
tagaacatagtgataatatttcttttgaatgaagtagagtaggcacttgacattctggatttaatttcctagcttgcaagcaaccttgaagattcatcacttgtactaatttgtattataatttgcagaggcataactttgacgcaagtgccctatggggttggtatgtaggaatgagtcactaaccttgtgagaattctagccagctacttgatgctgccctttcagagtggctttgcttttttcattatggaaattgtcaaggttcttttattagttttcatactgctataaaaacatacctgagactggctaatttattaagaacagaggtttaattggctcatggttctgcaggctgtacaggcttttgcttctggggaggcctcaggaaacttaaaatcatggtggaaggcaaaaaggaagcaggcatggccttcaggtggccagaacaggtgaggggagtggggaggtgccacacacttttaaacaaccagatcttgtgagaactctattatgcaacagcactaggggaatggtgctaaaccattagaaaccaccccccatgattcagtcacctcccaccagaccccacctccaataatggggatcacaacgcaacatgagatttcagtaggggcacagagccaagtcgtatcattctaccctggctcttcccaaaactcatgtccttctcacatttcaaaacaatctggcttcccaatagtcccccaaagtcttaactcattccagcattaactgaaaagtccaagttcaaagtctcatccaagacaaagcaagtcccttccacctatgagcctgtaagatcaaaaacaacttagttacttccaagatacaatgggggtacaattctctcattccaaaacagagaaattgaccaaaatgaggggctacaggccccatgcaagtccaaaacccttcagggcagtcattaaatcttaaagctccaaaatagcatttgattccatgtctcaaatccaggccacactgatgcaaggaatgggctcccaagggattgggcagctgtg

SEQ ID NO: 1347 - DNA, 1024 bp, Homo sapiens
gactaaaggcatgtgctaccacacctggttaatataatatttttcatatttttgtagagatagggtttcaccatgttgcacaggctggtctcaaaatcctgggctcaagtgacccgccctccttggcctcccaaagtgctgggattataggcgtgagccaccatgtccagccaacacttttgctttctgatgtttccatgtacacaaactttatttcatgtacaaaattattaagaatattgtataaaattatcttcagtcttttgtgtataagttgtatatgaaacttaaatgaatttcgtgtttaaatttgtgtctcatccccaagagatctcacgtatatgcaaatattacaaaactggtatacttctggttccagccattttggataaggggtgctcaacctgtactattcatttattcagccaataattactgaatatatgcctagcactcttgtagaggcttggtgtactttgggtcagcaatttataaatatggacatatactttgaataactaaattttttcataaagtttttggtaaaccatggttttttaaaagggtttaaattacagcatatgttttcatttttcctcagggaaaaaaggtttaaagcttatttgaacaatgccctccttcctctcttttgtattttgttgtgtgtgtattttacaaataccaccctgagaagtagagctgggactagcggtttccaagttcctgctctgtagatgatacagaaatgcctagacaagatctatctttaatattaaatattcatattcttaatagagaaaagctatgtacaggtgttgtcacttcctgaaactacttcagagcatagtacagtatttgaaaacagttctcaggtaatttaagttaccttatttatataatgatttgcaacagttattcacaaaatgcttttaaatgacatatttcagtccaggctccgtttaataattagaatatgaataaaaatgatttaagaacattaatattatatcgattttattattgt

SEQ ID NO: 1348 - DNA, 1046 bp, Homo sapiens
gctgttaccttcagatgtatttgaccaaccacaacctgtaggtaacaaaagaattgaattccatatatctaccgacatgccagctgcatttaagaaagatttagaaaaggaacaaaattgtgaggaaaaaaatcatggtaaggatattctagttatttcacatgctgaaatcaacttattgtgttagaattaagttttacatataatgtttcatattttagtatttgtcaactttatttaaaatatgcaattagtgtttcccaaaatcatggaataatatccgctttcaacttttttatataacagaaattgatggtaaacggtgagattgtcactgttaccctttgctaataatgacctctagaatgaaatttagtgctttttgctgatgtttacactaaaaatataatggagtttcttttattgactttttcatttcttgtttcatgccgtggcctatggttttattagtgtaactatattaatactggttagaaaacaagcaatgtgactattttgtgagttgtagacttaatgtaaaaatacatatatatattttttaatccaaaagacatggaagattgtttgccaagaatactattcttaagtttaaaacaaatgtattgaaattacagattttttttacttgttttaaccatgaacttgatgatataatggtgttcttttgttctttaagtctttattttgaaatttctgaaataatacaagttgatagaaatgtaaccaaaacaaagtaaaattgttaaaaagttaacacctcaaacctcactctcctgtgtcctactacctaaaggcaaatactgttagcaatttggtatgtgtatatacatacatgtgtgtgtgtttgtgtgtgtgtatgtatgtatccttccagaccttatcctgtatatgtatgaacacatttcactcttattttttaaatgaacataatgttttgacggtatttatcattcactcattaatgacttgttgaaagtttgttatctagcggcctccatggagaagtttgccatggtctctttttt

SEQ ID NO: 1349 - DNA, 1059 bp, Homo sapiens
ctgtgtttacttcattcttgcatttaaatatggaggtggctgatggtttgggaaattcactttaagcaaaataagtacccaaatcaattaacatatatactttgctcttttttataacatgactcatcttaacggacctttaatagtagatattttattggacaaattgtagttactctagaagtctgaaatttttaaaacaaaagttatatatatataaagttttttatataatcaattcagattttcagtgagtatatttaaacccatttgtaatattgttactaattttgttactaattttatgtaatattgttactaattagttcatatgaaaatgaactaattttcattttatgttaaagtgaaaattttaacattttcataaagcttattttgtctatttaacaattaggtttcaaaattgtaattatctttaaaaacttgcttaaaatattttaattttatatctttgttttttgttttttaataagaaatggaaacactttcagttttcagaagttatgaaccgggtgaaccaaactgtagaatttatgtaaagaatttagctaaacatgttcaagaaaaggtaggtataaattgattttttttcatgtaaatgaaaataatttgaaggttttatagttgatgtgttaaagtctgtttgaaactacctttaagaatgtggttttcttactgtgcttcagggcatgacaaattattgtttagtattttcaggttaattttttattaaaataatactctcatagcttgggttctctggcagtaaatactgagacagagtttgtggtatgtattaatttcctagggctaagtggctgaaacaacagagatgtgttgtctcacagttctggaggcaaactgaagtcaaaagtgtggcaggattggttcattctgagggctttgagtgaaggatctgttctgtgcctctcccatagcttctgctggtatgcagaagctggcgaactttcaccttccttggcttgtggaagcatcaccacaatttctgcctttgtacatagcatactccctttgtga

SEQ ID NO: 1350 - DNA, 1078 bp, Homo sapiens
tgaaaccccgtctctactaaaaatacaaaaaattagccgggcgtggtggcgggtgcctgtagtcccagctactcgggaggctgaggcgggagaatggcgtgaacccgggaggcggagcttgcagtgagctgagatcgcaccactgcactccagcctgggcgacagagtgagactccgtctcaaaaaacaaaacaaaacaaaaaaaacgataacaactatattataagacatcatttgtgaattccacattctcatatgtaaggtaaacacaaagtttgtatgaggttctctgtccgggcaatgttaactattgaaaaattacattctaggagtttactctgattgaggaaaataagatacaccttaaaataaccacaaaacaagaatatgagctaaggcccttggcagttaatgtacctaagtgctgtttacatattttgaagctaaacgttacaaagactttttctgatttatatatttacattaaaagtcttttacattaaaagtcttataaaggtatttttcaaagccgttacacatgtagtaacacaattagtaaatcacatgaaatctgaatgactttagaaagacagggacacatgagtggagactgggaggacgactaggttcactacttagggaggccagaatggagtcttttgtgggtaatgagggcagttcagggagaagagggcagtagaaaaggtattttgtcacaaaagattaaaatgtgtcagggagacaagcatagagatttattttattgttataaaacagaatataaaagtaggttggggtctaactattgtggacttcgagtgatcaacgaaggagtttatattttttctgatattttatgccattgaaggttttagggcaagggattgccatgatcaaagtagaagaatcagtctggctgcagcccacataatcatggtgacataataaattgtaatgactcaaagcagtagctggaaattgagaaagaaatacatgaattagaaggtgttgaaaatcgcttatgttgacttgagacaatggtattcatcttttctgtgagtgtatttgtcttctgttt

SEQ ID NO: 1351 - DNA, 1245 bp, Homo sapiens
tactttatatcccctccaacttaggtaagataagaatagattttccattgagcacactcccatacctacttccagaagtccctaaaggagatcatgaaaccagttttaaaagtgttggtgtaatccaagttctcattgtacagatgaggaaacggagtaacagagcaattgtgtgactttactcagtatctttgtccagaatgaagatgtaaataactgctggagggcttcattctaccattgtctgcttttgtctatctttaaatttttcatgatataaattgttttaaatttacttgagaaacaggagtatagcagatccttagtctcaagtttaaatcctagttttaatattttctgagcagaagatctgtgacatagattgtataattcttctgaagcaccaattatataccataaggccagaatttatgaagaagacagctggtaagtcagcctaaccacctaccctaaactttattgcatagttctctacaactcatcaaacacccaccaactcttgtaaaagaatgaaattcactctgaaaagtgctaataaagaaaaaagatattttgagagagaaagtgtatactctgctggcatttgggaatgtggtggcaaagcagatctaggggtgatataagtctcttgaatagcaaggttctgacgcgttcatattccaaaaggaaggaaattatcatttgtgaaaatgatttcatgaatgttactgtctctcaattcttaaaactctgtaatataaatattatccatatttttgagtgaggacatcgagactaagaggttaaggaattaattcttccagggtcccaggatgcaatcattcattcggtacatgtgtattgattgcctgccacatgccaagacttaacaagctagaaaagaccagcccctgctctgaagggattcactgattacgtgggagacaggcacacagcatacagtgtcactggggcacacaggataggatccctagccacagttctttgaaagccagggaaatctttactgagaaggggacactgagctaagtttaggggatgactaggaatttactaagcacaggaggtaggtagggacaccccaggagagaaaactgtgcacaagtttatgccatcgttacagggcattgagtatttaagaaatgtcaaataggtaatgttgtcgttttatgaggtcatttttcacatattcttaacattactataaagcaatcaaattaaagt

SEQ ID NO: 1352 - DNA, 1048 bp, Homo sapiens
ctgtcctttggagctcttaatagctgcttttttgtgcttgtatttttgtacttaccacattgtataagttttgcttctacctctaaactctaagcatgtattttgtcttattttgtacttcctataccttgtacagtattaggcacctgactgggtaaaatattaataaatattgattgaatgaataaattttgaaaaccagaagatatgtggatgacttaagatctgggccaaacccagaagtaaagagcgctgcataactcgatatgaaccaactttttgagttcagattttgctgaatgtttgcttttggaccacttatactctgtccagaaatgagaaacctttgcagaaggaccaggttactccagtattttccttgttttgcagcatttgttggtccaactgcatgcagtatcatttatagaatagctgctataatagctatgttactcaattgctttccttctgcttctaagttaaaaacagttcttgtttccaaatatgattgtgccctagggaaaatggtcacagttctgcattctctggaagaagcctggttctgaaaatatgtaattggcacctggaacatacacatgatcagaaactattagaaatggctttgacactgccttttgtacatttactttgaatatgaatactataatcactttcttaagaacttttactctcagtgctacgtcccatgctgtgttgatttaagccacagacattgcccaaattatagcctagcactaacaacactaacattaaagtaatagagtactctttagcttgctgttgtgatggatttttaaggaagcagtatttccttagaaaccacattaaaacctaccaattttgtgaacatttataagaatacatctgagtcatttttgttagagaaatactgaacactaaaactgtagcagttttaagatagagtgctgttaaatgttttgaacaacaggagtttattgcatagactgaactaataaaggactgaaataattttttaatgttatgaaaaatataattcttcagcgaa

SEQ ID NO: 1353 - DNA, 1032 bp, Homo sapiens
gaatttcctcttaaaatgccattaaggagagacactagtcatggtggttgcttctgggcttactaaactcaggcacactcatggtaaaatgacaagtagtagggtataccctaacatcttgacaaattgggaaatgggtacctggtgataacttcaggcagtaatgggccaggcgtggtggctcatgcctgtaatccagcactttggaaggctgagttaggaggattgcttgagcccaggagttctggttgcagtgagcttcagtcatgccactgcacttccatctgggcaacagaatgagaccctgccatgaaaacgccacaatattatgacagctgaagaccatcatcattaactcagtgcaagtcctgatgcactgccagagtcaacatatgctcttggatgagacctattttagaatgaatagataaacatgtttgaagagcatttcttgccaccatttgtcgataggtcaagaattggggaattctaatagattattgtgggaataagtgtgagagaatcaggatctaggctaatccaatgtattaatgataaacatttaatatttcacatagtttctatccgtgatgcctttaaacgttatggaaatcaaatctagtagaaaaatacccagtgccccatctctccaggggtaaggttacttggaacagtttcaaacactgcagctcaaaattttgaagtttttttccactgctgttttagggtggggtctggagcttatgaacaagttgtgatcaaacgctagaagtcaagtcggtgaaaacatttccttgtggatttaagatgtgagtagttgatgtatcaaggcattttattcaagcacttaatagaaaatgaacctcaactatcaagaggaaagccaatgctggtttcttctctggaaggacccaccgccatcctgtaccagccaccaaaggggaacatctacatggcagtctccaggcactgtgccactgtgtgccttggaagcacctggcttctgtggtcactgcacatcataatgaaaag

SEQ ID NO: 1354 - DNA, 1031 bp, Homo sapiens
aggtatgcactattaatcatgctcaatcgccataaatgcatttccctggttaaatgaacgactaattagatttttgtgggtttttttggccattgcttttggtccttcaccaattaggtaggctttttccacttccctgcaaattatgtagtataaaaaataccttccaggcctccgaaagttaatttctattttaaagaatattaataatagccttagtggtctttaaaaattttatccggagcatctaatacacaatccatttttgtctatattcactcttaaaaacttgacagaccgcacaaagtgttttctatcatttgaacgtatgtgtagagatggtaacaaaaggacattctcttttgtcttgcccaccttttcccccagttgagtaattaggttattgaaggattttgagagattagttgctttttatagaaaacatctcttgaatacagttcaactttgggttgataaagtacacaaataaatttggaatcctcttacgagagtaggtctgattgtaattctatgaattagtttttttagcttttaaaaggtaagacctttttagcatggatacagtatggtgaataacatttaatccttagctttatttatgcagtaaactttaaacagttgaaaattgggttcctgctctttctgcggcaggttctgttttctaacataggcaaaatgttaatgtaatagaggaaagtctcgtttttaagtttcaaatgtgttttgaaacaagattctaccaggaattgtttttaaattccgttaaaaaactaaagacccagtttttttactaatattaagaagacttaagactttcagatcaaatactcactgaaatttataagtttccaactttgtaattttattttgtatgcatccagccctgcctttggctagcttttaaggaattgaaacatcttttacatggcaatctgtggggaagaaaggaaacgttaaagcactgcaaaatagtgtagtgcttaaacttacatgcacgcttttctatctaa

SEQ ID NO: 1355 - DNA, 1074 bp, Homo sapiens
cacagaaataaatacatagtaggtatgtggaatgtaaatttaagtcaatcgttccgcatagtttagaaatgtaaggggctttttcatattgttaactgagtgagatcagttccctttatgcctgtgaggctgcagggtttgttctcacttgcatgcacacactaagcccaaatatttctgttcattcattgtcagatcaggatatgaaaataaaatttttctgttagttttttttgtattgagattccaaagatggtaatatttttataatattcatgtatatatggaaatactttttttgacggctagggtatcttttgtgtttctgtaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtaatgtcactcttgaattatgcttatttttcatatatgctttatacaaaattaatggttctgagaaatagcaagttcttaggaatttgtttttactgttcattttattagtttgtcacttttaccccccaaagattattttcttcctttcagggctttttctataaaattatgcatctgtaaatgagaacaataaaattttttgctttaatgattcttgacatggccttaagcttgaggacatgaataaataatgctgttgaaagttttactgtgaaaagaattgcatatgttttattcattgaaattttctttctccctccgccttccttaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgacc

SEQ ID NO: 1356 - DNA, 1031 bp, Homo sapiens
tgccctatgttgaactcccttcccactttctttgtttagctaattctactctaagatacagctcggagattatctcctcctggaaaccatttctaagctccatagttaggctctgtggcctccgtgtgctcatattacaatctgtgcatttttctttcttagcaccaactgtattaaaattaagttaatctgtttttatggtgctcccttcctcctcacctctccctttgagcattagctcctcagctgtggtcactcctcagcagccatgataattagcatgttgtctggcacatattgaacttcaatggaatatgaacgtaataagatgtttatctgtcttgctaaatgttttgaatagtattgtgctttctaatatggtaagaacagtagataagtaggaatggcttgtacctctgcctgttggaagatcttagaattgtcctttttctgtgatacagtctagatcaaacatggttgcactttgctataggacttcaccaagggaaacttaaaaatctgtactgtctgtaataggactataccaaacaaatctctggctttatcagtgctctaagaccagcattctgtatattgattggattgtcgtataattgggggtaatgatttgaactctttatgttaggccataggctggtataagttattcttctgctatagtaaatccttatgaaatgttttatccatctggttcttccattgtggaggtcctcctctatccctggaggagtttctgtggcacaatgaatttgtaattttgaatggaatgtttcttggaacactaagtaacctcctaaggggacatcagaatgctttattgaaatattttgcacctatttcaaaaggtagagactgatagcaagtacaatttaagttaaaaaaaaattatatggttgatttttaaggaattattaattttttatgtgtgataatggtattgtgattgtattttttgaaaaagattaatcttttaaagatacatactaaggtatttacaaattaaatcatat

SEQ ID NO: 1357 - DNA, 1031 bp, Homo sapiens
tagagctaggatttatgaaagaagatcacacaaccacagaaatggaaagcataatagagaaaatggagagtagtcttattttgcctcttaagtcctgaattccatcatttattcttaaatagtatgtaagccctttgaagcaagagtcaaatctggacaaaattgatgttattaagtcttttagaaagatgtagcatcatggttttatgttttgcattcactgacgtcctgtgaacacgaaacaaatttaaggaggtaaagaggataatagtcaagtgcaaaatctagtgtggaagagaagttaaaaattaaaagaaaaattgaaatgacatgagtttgcacagaaaatgagaaattctagctaaaatgttcactctattagcaaaaatgaaaacacgtcagttaaggatagtagtactgtgtctatttgaagtttattagaaacatattttctttgattatacagctagataggctctcagaagcataaaggaaactttgtatgtgggatgaattttaatggaggggtatgttcttggtttttcttctacatgtgggtatgttctttgttttcaacccaactggtaaacaaaggaagtaattctattctctcatagtgacagagaggatatgaaattactttctctgttactatttaatgatcttctaaaaaatttataaaccaagctgccctattttgcaggcataaatctatatttgattcaggtgttagagatttttgccagaatattaacttattttctaataaaatacaccagagcctgaatctatctaagaattaatcataaactagagtgtttgggacattatttcaggtattagtcactggaataacttttctaagatagtctctcctgtagggcattctcactacatggacttcaaggacagccatgtagccagcaagcttccagtttgctagtattgtttcttatgacaattatgtaaaatgcctttttaaaaacgtgtaacacttacgatgccattcaatctatagctaagttttgtgg

SEQ ID NO: 1358 - DNA, 1039 bp, Homo sapiens
gccttttaaaatattgcctaatattttaaaacattgaatggatatggaaattctctgtatttaataactttattgaaaaaagtttaaggactcgtttacttgttttctgactggcagtaagtctgtcatctaatgagatcttaaaatagaaaggggtaacctagaaaagagtaacagcatagtagtggggatgctattttgattcttttcacgcaattgaaggcctacagccttttccttctgttataaggaataaactgctctacagattgttatttttgaaactgtgtggatagtataaaaccagttgttataaaatgcctttttcaaattaaggggtaatgtagtaaccagtgttagtttccaaccaaaatgtaacttccttacatcaaagcattttagaggggaatgtatattctatttttgtgtagctggtatagaaaattattattcttggaagaatacatatttgtacaggttttctcgtttcatatgggtttgtgtatcagattttagaactgaataatgtaatgatgctgaacttgtactcttaagggctccctggtttatttgaattaattttttttaaacaaaggtgtacgccccaagttgggacgccggcatagtatggaaaatatggaacttatgaagttaacaccagaaaaggtgggtggcaggttttatgttttaaatttcatgaactattataaaatgttttagtaatttttaatttaatgaaataatttaaataaggcttgccctatataggtatcactttaaaatttgcctgtaaaaaaaaagtcagaaaaagtatagtgcaaaaagaatgagtaccgtatgctgccatctgtttaagaaaaatacatgcatatatttcctttgtagattcctaaaacattctggaataagatataagaaacgggctaacaatgatttcttctgggaagaggactgagtgtctgggttaggctagaaatactttatataccagtttgaactgtttgaatcatttactatgcaaatgtattacttttaatta

SEQ ID NO: 1359 - DNA, 1030 bp, Homo sapiens
ctcccctgtacatttatttcaatttgtgtctcatggggcacttttctggattggtggaaatgttctttgtattgattggagtagggtttatatggcttccaatcatagacttaaaatctgtgcatttgactgtaattttacctacgaaaaaatgtgtgtcactaaaattattacatagcatgaacctttagacttacttgtaaacatttaagactgaatgttaaagctgcaaatgtcagagctattgtatgtagtgcatatttttccactgtactcaataaatgttattttgttatttgtaggctgtcatgtatttaaaccagatctagacctttataaattggtttcgcctattgagaatttagtatggtattagtaaaaacagtaccgttttattttttaaaattactatgttttatatattaatttttatgtttaaaaattctacatacatccaaaaattccagttgtaacagatttttaagtaactcacgtctagagtaaaactttggctccttctctgaccattcatattttatttttacagagttttggtaaaccttgctttcttattcgtaggttcttaaaaaccagcattttaatgttttgataatgagaatccacagtatgcatttggtacaagtcttgaaaatagtgcaatatactaaaaaggatatttttaaagagatctaaaattcttcctctctcccccaatagtaaataagtgagtacgtcaggttaatattatgggaaaccagaagagagctggggatttgggggtgtttattcacctgccttccatttataattttgtaggtacagaactggaacagtgaaattcttgctaagcaaaaacctcttattgccaaaccttctgcaaagctactctttgtcaacagactgaaggggaaaaaatacaaaacgaattcctccactaaagttctccaagatgccagtaattctattgaccaccgaattccaaattctcagagggtacgtttaaactaagtttttgagtattgtgttttga

SEQ ID NO: 1360 - DNA, 1389 bp, Homo sapiens
agcgagtctccatttcaaaaagaaagaaagaaattgaagacaaattaaagtcacgatcacagaaaaactaaagatatgtatataactatgtagttatacaaaggtcaaaaggctaagtgccgtggccatcgcctgtggtcccagctactcaggaggctgaggtgggaggatcacttgatctaggagcaatgagccgtgttcgcgctactgcactccagcctgggcgacacagcaagaacgggtctccaaaaaaaaaaaaccacgattctgtaaggtggaaattagtactgccttttcctgggacctatgttcccctccgagccacgcgagggcagcaacgcgcgcactctgaggaacacccccttcctcaggactcgtccgcctgtgctcggtggtttctcccagaatcctccaaggcgcgggagggggcggagagcttaaaagtcgcggggggagcggacttccgctgttttagggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgggcacggccaccgggctgcgggctgccggtggcgtaggggcgagcacgtgaacggcggcggcgggcggggatgctgagcgcggtggccaagggtaaatgagccgctgcccctccccctggagctggaaggtcgcggaggcctttttggccgctgatatactttcctcccactttcccatttctccttgtttttcttttttcttttgttcctttttttttttttttgagacagggtcttgctctgtcgcccagactggagtgcagaaccgcaatatcggctcactgcaacttcgacctccttggctcaagcgatcctcacatctctgtctcccgaataggtggaactacaggcgcgcgtcaccacgctcggctaatttttgtatcttttggtagagacggggtttcaccatgttttgccaggctggtctcgaactccagcctcaagtgatccgcccgcctcggcttcccaaagtgctgggattacaggcatgagccaccgcgc

SEQ ID NO: 1361 - DNA, 1048 bp, Homo sapiens
cttttgataacctttattagctccaatgacaacctgccctgggccatctacatttccacctagccgcattatgacctgttttagagatcgcagggaacagtatgatcttatcagtgactggctcactggccttgatggcctgtggtctaaccaaccaaaataatgagaccaagaaagcccacttgcctaagaatcaaacaagggagtttcctgagtggaaggtaagaatcatacagtttaactaccaattcttgttgagatctttgtcaacaatggaaaatatgagacatttcagaaattaagcacttctattatcttggtttggaggaagggaagaatattgatacttgagaactcgaacttgtgtacgaattttgcctttggtcctgtttgaataaccaatatttgcctaagcaaaaggtcttgccacaaagtgtaagcttaaggtagtggaaagctatggagctcaacctaccagggtttcagtcctgttacttaccacgtggtttttggatttgtagaatgggtatcaaaataacacctacctcagaaaggattgctttgagtattgaaatagaaaatacattggaaacacaaaagagagttacccaccctccttctctgttcagcttctttcccattagatccacaccccatgccagattggaaatggcttaggaggcatgcccatttgccacaggcgtcagcaagtcctgtttacattctccttgagcaaacagtggccattgaacaccctcaactccaaaacaatcagggagagaataaacccattattatagtattcatttggcaatatgaactgatcaaacaagtttgggggcttccaaccccaaatggtgaaaaaccaattcaaggtagaccagctcttctctgttctttttttttttttttttttttggtgagacagagtctggctttgttgccaggccaggctggagtgcagtggcatgatctcggctcactgcagcttccacctcccaggctcaagcaattctcctgcctcagcctcccaagtagctgggattac

SEQ ID NO: 1362 - DNA, 1034 bp, Homo sapiens
tccacccgccttggcctcccaaaatgctgggattacaggcatgagccaccgcgcccggcatggcttctttctttcaagattatgtctgtaagattcatccatgttattaacatgtagcagtagttggttcttttcattgctatataatactccattatgtaaatatgccaatcaattctactagcatatttactgcatgacatttggataaactgggttgttaccggttgagggcattatgaataagcttctagagactcttttttaaaaaatgtttgattggcaattaacagattatagttgtatatatttatagggtacaatgtaatgttatgatttatgaatacaatgtggaataataaaagcagctaattaacatatccatcacctcaaatacttatattttgtgataagaacatatgtacattcttatgtgtgtcttttggtagacattaacactcatttctgttgggtatgtaccaaggagtagaattgctggatcatagggtgggcacatgtttagatttagtagataataccaagtagttttccaaagtggttgtaatgattgatattcccaccagcaatatctaagagttccagttgcttggcattcttgccagtacttgacattggcagtccttttaatttagccattctggtagatatatagtggtgtctcattgttattttaatttgcatttttttggtgactaaagatactgagcgctttttcataagttgatggcatttggatagcctattttgagaagtatctgttcaagccttttgaccaatttttatttgtccttttcttagtggtttgtaggaattatttatatcgtgtggatagaagaatacctgtgagatacagataccacagatctcctctcccattctgtggcttgccttttcattctttcagtcttgtgatgaatagaagttcctaattttaatgaagtctaatttattgacttttcttctgtgatttgtctattgtgtttccaaaacacaatagataaatcacagaattt

SEQ ID NO: 1363 - DNA, 1033 bp, Homo sapiens
tctgtccatcctcagcgtcgaacctctggctctacaccagccgctgcagggatgcgggcactgagctgactggccacctggtaccccaccacgatggcctgagggtttggtgtccagaatccgaggcccatattcccctaccaccagctcctgaaggctgcccctggagctgtcgcctcctgggcattggaggccacctttccccacagggcaagctcacactgcccgaggagcacccgtgcttaaaggctccacggctcagatgccagtcctgcaagctggcacaggcccccgggctcagggcaggggaaaggtcaccagaagagtccctgggtgggcgtcggaaaaggaatgtaaatacagccccccagttccagccccccagctaccaggccacagtgccggagaaccagccagcaggcacccctgttgcatccctgagggccatcgacccggacgagggtgaggcaggtcgactggagtacaccatggatgccctctttgatagccgctccaaccagttcttctccctggacccagtcactggtgcagtaaccacagccgaggagctggatcgtgagaccaagagcacccacgtcttcagggtcacggcgcaggaccacggcatgccccgacgaagtgccctggctacactcaccatcttggttactgacaccaatgaccatgaccctgtgttcgagcagcaggagtacaaggagagcctcagggagaacctggaggttggctatgaggtgctcactgtcagggccacggatggtgatgcccctcccaatgccaatattctgtaccgcctgctggaggggtctgggggcagcccctctgaagtctttgagatcgaccctcgctctggggtgatccgaacccgtggccctgtggatcgggaagaggtggaatcctaccagctgacggtagaggcaagtgaccagggtcgggacccgggtcctcggagtaccacagccgctgttttcctttctgtggaggatgacaatgataatgccccccagtttagtga

SEQ ID NO: 1364 - DNA, 1051 bp, Homo sapiens
ggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtgagtggctgggcactgggggtggggagtgggcctggtgggcatctgaggtgcctcctgttctgtggttgaagtaagaggtcaggcagtgaaagcgtggagcaggctgccggcagagccaggtctgctcttggagttgcctgtggttctgccagcagatctccctcccctgcgctggttaggtggcgggggtgctggcatccaggtgggtaccccattccctgcccccatccccaactcctgttcaggtttgccacaaaggagcgcgacgggttgctgttgtacaatgggcgtttcaatgagaagcatgactttgtggccctcgaggtgatccaggagcaggtccagctcaccttctctgcaggtgatcacagttgccccccatccttgcccatcttccaaaggccccaagtcttccagcccctgaccccaagccacatactctatcagccaaatctgggcccagccccagccactggcaccccaaaccctgccattcctagccctcgtcaggcattccagctcacctggtcctttccccaggggagtcaaccaccacggtgtccccattcgtgcccggaggagtcagtgatggccagtggcatacggtgcagctgaaatactacaataaggtgggtgtggagggcacagagggttgggggttctgttcttgcctcaggtgcttacccagccctgagtggcattgcctccaggcttgggtgggctggtcagggcatttctggctgagaggaagggagcggctgggaaggtgccaccttgctgggcattcccaccccactgggcactgctcgatgctctctgttccactaggcagccgcaaacttggacactgagga

SEQ ID NO: 1365 - DNA, 1029 bp, Homo sapiens
tccgagtgagtgtggccgggtgggcgggacggggtgcagcccctcggaggcctcacctgggcccagagctgcctccgggcctccccaggtgactctggatggcatttggaggacaaatgggcagaactggcccagctcccttactatgccgtgcccacaaaccatggtgccttgcggggagggccacccctcctaggctctacgcggcgcagcccagcctagggcagagtgcgggaggatggggagctgggggtgctttcctgtttccttcgtctggtgaaagctttcactctctcctctgtttcaactaaccctctgtctgccttttctgccactttcctttcctgcctctccagatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgcctcgtcctgcccgcactgcctctcccaggaactggaaaagccctgtccggtgagggggcagaaggactcag

SEQ ID NO: 1366 - DNA, 1029 bp, Homo sapiens
tctcacctccttttcttttttcttttcttttcttttctttttttttttttttttggcggtgggcgggagagggacaaggtctcattctgttgccaggctggagtgcagtggcacgatctcggctcactgcaacctccgcctcccgggttcaagtgattctcctgcctcagcctcccaagtagctgagattacaggcatgcgacactctaccgccaggctgatttttgtatttttagtagatatggggtttcaccatgttggccaggttggtctcaaactcctgacctcaaatgatccacccgcctcagcctcccaaagtgctgggattacaggtgtgagccaccgcacctggcctctcacctccttttctaaccaaagtgtgtttcccagaaagaaatctgaaaatcataggatgaggaaattttatttcacttgagagagaaggtgtagtaaaatgtgaggaaaggtggagaagaaaacaattcgagtgacctgagacacctctggatcttaacactgagaaatggcagcatcaacagatgacaaagggaaataccagtggggaaacagtggagactgataaggcaagtggagggtacttttctctgggcttgagccaagattgtcacattggcccagccagcactattgctagaaggccatgtgccttttggggaagaggaattaggctgtcagtactatgggacagtagtatggcccatctggggtggcttggtagaagctggcccctccagctatacctccaccaaggcaggaagccactggaagttagcaactaggaaacaagattagatgactagttcaaaggagaaatgaaaagcgttctaggcatgtctgatctaggttgatgcaggggaatctttttgagtgtgtctctcccttgggaaggaaattcaagtctatctgtaagctagaagtttcctaaagcctgaattgcagaggttttgtgttagtcatcttaaggaggctacctgtggtccccaagtcatgcccaatggagagatctgg

SEQ ID NO: 1367 - DNA, 1047 bp, Homo sapiens
tgaacagctttggtgagcatttattatagtaaaggaaattgaaattgtaggcatccttatctggcaactcagtttgtagtgtttgctgttggtgaattttaaaagtgtagtttgatttacattggattaaatacacctgtagaaacgtgccctatgctgctatcgatgttagagggccctaggtagggaggaatatgatttcaacattttaaatcccaaaattttacaattttgggatataggtgctttgataaatgatttagcattgcaattaactttggaggacatctgcagtataatgaatcattatttttatgggttaaaatgaaatatttggattatttgtgggttacagttgcttgtgtcagttctgttcccttttactctaaataaatatagttttcagtcatgtcatatataaatactacgtaatttaatgttagcatcaaaatggctttttgctgccctgctttcaaataaggagaaggaaacttaccaaagtccaaaattagaacactgagactgggcacagtggctcatgcctgtaatctcagcaccttgggatcacttgagctcaggagttcgagactagcctgggcaacgtggtgaaactccgtctctactaaaaatataaaaattagccggtgtggtgatgtgcacctgtggtcccagttactccagaggctgagggggaaggatcgcttgagccctggggcggggcagaggttgcagtgagctgagatcatgccactgcactccagcctgggtgacagagcaagacactgtctcagaagacaaacaaacaaacaaaaaacgttgaggcagccagaggatgatccctgtccttgctcacaaatgactgctcccttaagcaatcaaaggcaaggaaggaactctacgtacttctccccctttaaatgataacattttgaggagagctgcttagctgagtgagctgccttttttttaaaaaaaactcaagccaacccttccttagatgatttatgaatgtaaaatgcttgttaactttctgctttatggtttatg

SEQ ID NO: 1368 - DNA, 1022 bp, Homo sapiens
atattctgtggttctcatcagatagaaataacatatttgaaaatgctttgtaaatgttatgatactcaggattatactgcacagaaaaaaaaaaatcctaaggcagcaccaacaaaggtattcaacgtagtgggtggtcttttacagcattactttgcccatattcattttgaagacctgaaatgaagttgaactataaattgctctaaaattcgtgaagcagggtgaaaaggtctttgctttgttttacatttaaatccagctgtctattttctgcttatactagtgctttttcatggcaaaaagacagaaaagttcccttctgcagtctccagtgtcttctgacctcacagaaatgttttcatgcttttacctagcaggaccaccagaggctctgtcacacttgcagtccctggcccaacaccgaaatccttctggaatctgtgctctgggggctgtgccgggtagagagggcagtgggaggtaagagctcttcacccttcaccaccttctccacccagcatggccggcacactttggtctacggcacatctccaagtatagagtgggttttgaatgctgttatgtctcaccgtggggatgggaaggaatactctgttttggactatttggaggtacatgtgagtggattttattaccagagtaggaactgtttcaagttaatgtgtcttttatgttgcttttaagacaacttttgtgccgcttttatccattcttccttttatccacagaaatacaaatttctaattatagtatattttttctatttttaaaattgtgataaagcatatataacaaaatttgccatcttaagtgtacagttcagtggcattaagtacattcacactgttgcacagccatcaccaccatccatttccagaacttgttttcatcttcctgaactgaaactctgtacctgttaaacagtaactccccatgccccaccttctttcagcccctggtaaccagcattttcctttgtctctatgaatttgactatt

SEQ ID NO: 1369 - DNA, 1023 bp, Homo sapiens
tgccccgtatgagttccccgaggagagccccattgaacagctggaggagcggcggcagcggctggagcggcagatcagccaggatgtcaagtgagcccggcaggcagctgcttagtctccctccatacccttccagaccctttcagagccccttttctgcctctttccctcgcaccctgccttggggggtctgcacagggagcatagagtgggctttggagtcgggctgctgggttctgttctgtcttctagccgccggtgtggctgggtcatgttgcttaacttatgggtctgctttctcatctctaaagtgagtgagaacagcacagggttctgcagctctgcctttgaggatcacatgtgacaacatgtgcacagcacctagtgcggtgctgggacctgggagcaagggccgtccctcgggatctgcctgacttctcacccctcttgcctctaggctggagccagacatcctgcttcgggccaagcaagatttcctgaagacggacagtgactcggacctacagtgaggagggcagaggggcacaggggatgcggagctgcagcctgcccttctgccggctctaaacccctcccttgaatgcaccccctgcaggctctacaaggaacagggtgaggggcagggtgaccggagcctgcgggagcgtgatgtgctggaacgggagtttcagcgggtcaccatctctggggaggagaagtgtggggtaagtatggggtgtatgttgggtgagtcgccatcacctatgtcttagtgggttcccccagcctggagagctgggggtgggggctggaaagggcgtttctctttccagcagctggaggggcggaggggcagaggggctgcctaggagccacttgatgtgctggaccagggtgatctgagtgttcctgggggtcagggcctgtgggaggtggggatagtttgggttctaagataaggccttagggaggaggtctctgagtccaagactgaggagagtgatcgcatatcctcatctccag

SEQ ID NO: 1370 - DNA, 1061 bp, Homo sapiens
cactgttgataagacaaagtctatatcgtagattgtaaaaactcattaaggcagggattcttgttcacctttgtatccagtgtgcctagctttgtacccagcatacagtaggtactcaaatattaattgctcacctggctaactagtaactgagatgtccatgtggccacctaccatgaataactatcccttttcctctcttcttcccaggaggaatattactaatgtgtattattgtcaggccaagtgctgatgattttagacttatattgcattagctaaaagaagcaggctctgccaggaatgtgggaagaccctgttttaagtttccatttaccagtaaatgtgccccaccgtgtttcttattaatctttctcttctaagttttattctttagcatttacgtagtactttgtaataaagtgtttcatgatgactaattaccctttccctagtgatgataaaagacatttattaagttaatggatcagttgaggactagtcaaggtcacatagcaagtcctaggcaatctgtttttcagaactgctgaattgaacattaagacttaagtcacttttgtacctctgccatgtgttgataacgtgaaagcatgggaaaagtaagagggaaaaaagtaacttggcatggtacttaatggtgtgagaaaaagacctcttcaaatggtgcagtccttcacctatgagaattctaccctggctctagaccagtaatccttggattattctgaagccctgaggcccctcaggaattgaggatgttcttgatgccagaggatataggttacttcagggtgaccttgatggtcctcagttagatcagatcccagtgtcactttctggtcagcttttattcattttgtttgctttgtttgagacagagtcagcttttattcattttgtttgctttgtttgagatagagtggatgtccatcaattaaaagcataaatatctagattcttcagctataatcatgacttactcagttttgtatgccaaggtctatcacactgctatgaacaaaataggacttgttggtttg

SEQ ID NO: 1371 - DNA, 2412 bp, Homo sapiens
cttctaaatactactcccttctaaaagaaaggctcctgagagaaatggttgattccaggtttggagaagaggaagaacaaggtgagcctggtatatcttcttttgtcaaaaagagtggaaggactgtaatggaatcatgtcaaaggacagaagagccagcttgaaggaggctcccactggcccaatttgagacaatatgagtattcagtgcaattaatgtataattaagtgtaatctgttaaatacataaaaatctgaatgacaaagggagaagatttttctttacaaaagaatgccagctaatgtggaagcattgatagaaaaatagaagttgcgattctataaccttcccaatataattggttcaggcaaggattattaacagatggtgaagtcattagggaataggatattaacatgatgaaaaaagtattgccctacaaattaacttttacttgcaaaagagaaaatgtacctttcaaagaagagatctgatgttctcactttaaccaggactcaatcttagcattgctaatagtggaacaacccgacatgtgcctcctgataatgatgcaaggtgaaatatactacataatgcaggaaatattcttgccagaattttaacctttttcaaataaaacctcagaactgaacttccagtttataggaaggaaaccctctgaaaaattcaaaacatgagtgattttataagacaattagtctggattcctcaaagaaaagtcagtatcacaagggggtgggagacattggagagactgttctagattagcagaggctaaaggaacctaacaaccaactgcatttaatgaaccttgaatccatgctgggttggcagggttgaggagactgttgggatataaataaatattcttgagaaaattggggaaatttgaatataatctggacagtctggatatatgaatatatagaataattgttaatattaagtgtgatatgtcatcatggttctgtaggagaatattcttattcttagaagatacattctgaacaatttattggtaatgttcatgtttgcaacctttatttttacaggaccatgtgaaagtatgcatgtgtatgtgtatatatatagagagagaaaaaacctattatggaaaacggaaagatttattctaggtggagagtacaggtgtttattatactatgcttttgaatttttttatgtgctgaaaatgattataataaagttggaaaagtaaagtacaacaatggtgctagcgagtggggatggagggtagggggtgggagaggagactttaatgttgtcactaaagtagtgggtatgttccaggaaccaggatttcttcagtcacctgtactgatttttttttttaaacctagaattgatgataaatcaatatcgggagaaacagagatgactggcatgtgtttatataatattggtggtgggactgagaaaagaagtatggacaggtcaggcaactaggtaggtagtagatagctaaataggcattgaaacagtctgggtgtgtgttacattctgttgcaaattgtggtgttcaaaagattgggaagcccttttctgtcctacttactgccttttttctaacttcttatgtttacttctagttggcagttgcaggcctcgattactcattgactggagcactttaggagataatagtgaagtgaagtcagtgaagtgtttagtcttacaggaagagaggggagtagctcacaagggtcaaactactctttggcagagtttttcaagctgtgtgttccttaccttttaagtgactcagcagtttggggcctggtattgcctcacctcttctcgccgcgagcattgacagaagatctagttgagtcctactttgaaaggagtattgcttctgactgtggaattggattctagctgtgtgtgtgttatatcctgttactgttgagacacagaggcgggagtcggcgggggaagatatgtgctgagattagtcagcctgccctccctctcccccaagaaactcaggccccatctggggagagtgagaacttaagaaacttgagacagggaaggagagccgggagcagccaaaacctgctaagtctcagaagactggtttctgcacaagggaatggaagaagtgactggaggtggctgtggattcaactctggcctgagattgattcccttgagataagttgttttctggtgggtgtgtctgggagcattgtgttgggaagggaattcctttctttgggaaacacttttttttttacttgaagtgaaaggtattcagacttgtgtatttcttgtaccaaggagtgggtgtttattgataactgtttctttgggttcatctgaagtgggaatcagactggtaaatatcaagaaaaactgggcatggt

SEQ ID NO: 1372 - DNA, 1112 bp, Homo sapiens
cactatgagattctgttttctgaaagatttgggaagaagggtaaagagtttaatctgtcagggttataagaggggaaaaaaacttgatggaatgtgagaaagatttataaaattgaacatatactaaacgaaattggttcttaaccttagcccctcctcccaaatcctgcagaaacaattgggaagagacagtgattgacgtgttgggagaagtcagagagtagcctcggccttcccccatttctggtgggaaagttgctggcttagtaggaaccatgtgattacatggcttttagggaaagacaatgtatccttaaaaaaaaaaacatttcatggattttccttataagttttcaactttttgtcttccttttgtatagcaaatccagtttgctgatgacatgcaggagttcaccaaattccccaccaaaactggccgaagatctttgtctcgctcgatctcacagtcctccactgacagctacagttcaggtaggtgtgaatgaactccatgtcctctctaatctctcttccctgtttgctaccagtgctcttcacttagcaatctgaaaatacctcatgttatgactgcccacctttgtgctgaaaactgttagtggctgggcagtgggaatgttctgcagccaagctagtagctggggaagcttttgtcgactcgagactttcttccccctggctgtctgtgtgtgtggtctgtggccagtgcccagttggtaggactgggctagttcccattcccacattgatccgcccatttcaaaaggaagaaatcaatgctattttggctgacagaattggacttaaaaaagaagtgcattttgaagcacgatttctttgtgtaaaatataccctgtcacctatctctttctttcttgtctccaagactgcttagattgtaacaataaaattagtattttggcttctcttatttattaggttattctttctgttggaatatcctcccctgttagactctggagcaggaaagattcagactactgtaatgtaactccagctctgtttctttttagttctctcctcctgtcttaactctctgtaaataaagtctttttctgttttgtattgtgtct

SEQ ID NO: 1373 - DNA, 1006 bp, Homo sapiens
agagctgcaacatggaagtacccacaacagtttcattcataccacctattagaacctagaggagcagaactgagagcgttgtaaaaggtagctccaattaagggtgttcccttaacttaaatgaaagtcccttggggactgcactctgtagagttggggaccactgaggtttttctatccttgtttttttctttcctggctctagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaaggtaaagaaagggagtgggttaggggaccagaaacaaccctcttgttggccatcagaatccacaaacaacttaagacttgaaagctgacttgaaagtgtactgggaagaaagacagtattatggactttcggataaacacttctctctctatggaacttaagtcttgggattttgttctctcttccttctgttctcagcatgtggtgattacacacagagtagtttctgttttcctccttgccccaccccaccactgtattcaaagatctacatggcagaattgacaagtcctagatcactacgtggtagttggttatatgggatcttactatagctgccaatggcagagacccagattgcccagaagcagctgatgaggaagggttttaaggtaaggatgtggtgacctagagtcttgtttggtcctgagcaccctctgctggagcagagtaaaagtgactgacagttaaatcttggtttctctaccccagccactcccagtaaggtcctctttactcttgtgttgtttacacattgaaggcatgttctatactgagagagaatagagaaaccaaacagactgacaggacatggtaagacagcatagaaaaacagaagttagtggtttcggctgagggtacagtctttctggtctga

SEQ ID NO: 1374 - DNA, 1025 bp, Homo sapiens
ctggatgatgggggagacttaacccactgggtttataagaagtatccaaacgtgtttaagaagatccgaggcattgtggaagagagcgtgactggtgttcacaggtaacagattctggagtagctgccccttgtgtccttgcctcagcaaactctcctggtctctgttaggctttaggactgtgtttcagacttataactaaatgggaatatcttcattagataaaattttgagtttttacttttgaaaaatcaagttgatcctagaaggaagttatttcaggttctagttcatacatttttctctcccatttactccattgagtgattctcaactagtgttgaggggcgggtagggaataaatgtatcttgaaaaactgtattcaatattgtattatcattttatatttgaaatatgaaaaacaatcctattgtaaaactacatgttatacacactacaaaaagtaaaactgggcaaaatattcttggcttgttggaatactgaaaagatatctgaaagagtgtttcttgggggcacattgcgcatgcttactcacacacacacggaaccatatcagaatcattgatagtctttgtttatcagaagtaggcatgggtttctattgaaaaatgctgatcaaaggaaataacactccctataaagggaagagaagtacatttcttcaattgaaaggcttttttttttcttccaaaaaaggggtaaagggagaagaaaatgaaaagaagtgtggagggatgacaaggaaataatcatgttttctaatatccttgggcaataaatgagactgggaagggcagcatggaacttgaagagaattaggcagattttgccacaaattatgttgtgccagctaacttggtttttgtttgtttttgtgacctcttctctctttaggctgtatcagctctccaaagctgggaagctctgtgttccggccatgaacgtcaatgattctgttaccaaacagaagtttgataacttgtactgctgccgagaatccatt

SEQ ID NO: 1375 - DNA, 1066 bp, Homo sapiens
tgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagttaaggcctattttcctcgggcacttaaccaaccaatcagaacaccacatctgttaggggaggtaacctggccaacagtgtatccatcacgttagccctgctggagggaagggacccacattcacctgccctctgacctgccccttgatcccatatctattaccgtgtccataggaataataggtaagggctctgtctctgtcaagccatgtaacaaaggacactgttaaaaaaaaaaaaaagtctggcatcagagggagcatgtggagagcaacttgggaagaacaagttcattttgtattgaatgatttttaatgaatgcaatattaatccttgcagatgagcaataatcattaaaatcgattaaaatgataagaccttattggcagtccgtatgtgtcattctttgttaaacagcaaaacttcattagaacctgttttctagggtgtgacaagttataggtcagtagcatttaatagagatttgttgagggcctaatatatagaggctggatacaggattcttcaaagtaatacctgaagttttgtatgcctgctctgtgccaagcaccgggcctgggtactttcactcctaacttccttcaggaagcagacttgctgcttaagcctcagggttcctcatttgcatagtccttctaagacctaatttctgaagaatgcccccaaagttatgtaagcttcagcctcctcccacacctgtatccatttctgaagtggtctcagtgtcttttttttttttttttctctttatttttttgagacaaggtctcactgtcacccaggttgga

SEQ ID NO: 1376 - DNA, 1027 bp, Homo sapiens
agggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgctagcattgctggtcaacgcttgtccttgtcaagctgcctgcctttcccatcctgggggaagaggagagagagttggcatttatccagtgtaagttaaccccacagtaatctgggattgctctagcccaactccagggcactaggttactttactgacacattgtcctgcacccctgggtttgctgtaatttcagtaggagccccaggtttctctggatcacatcactgagctggcctcagccaaaccagtgtcagtgctatggagggaggggctaggtcaaagcaagggggtctgctgctctaggtcctccctggggcaggtggttgggactgaggggaaacttcagtactcagagcctaggaagcagaccatcaggagtcaggttcacggtgggaaaaagtgttggagggcccaggagccccctgtggctgagagaaaagcaaggaaaatctttgtagtaggtgtcagtggacacctggcgcctccactttggcctccagacccctggtttcatctgcctgagaagatattagtgttttgatgctggtgaaaggagtgtttcctttttagaattcctggaagctcttattttacctgtaggcagttgttttgtaggttgttaaatctccaaggggtcttgacttgtaaaggaaacatgttctggggagcatctccccttctttgggtcttgtgttcatgcctgcctggcctgggacctgctgagcctcaggacaggccttttgatgtgccagcatggttagggacagcaggggtggaaggcagcagtgtactcctgatggtcacacagctgtgagatgggaagtcccatctgtgactgatgggccctgt

SEQ ID NO: 1377 - DNA, 1007 bp, Homo sapiens
taacagacgtctgaagggcttaccacaggtcccactggtcccagcctcttagtattggaggagagattgctgggggagccagcagtcgctaagtgggaaggaagggggctccagcatcagaatcaagggctctgacagctgacgcttgatgctcaccaccttccaggtgaaatgcctgggatgagcctgtggaggaggctggggcaggggaagtctttcctctgctggataaaggaaatgttagggtcttcccagttcctggccatgctagactcttcccatctggagctgcagagggtctgcactttggggttgtaattcaggttgaagtgtaaatgggagaggtggggaaggaggattgaatgccttgcatgagaagcatttccagctgctgactgaggtgggcagactagactgatgggccccctggctgtggccctccagtcctgacctggtgtccgtgtttctgccaggaccaagatttagggctctggcatcttctctgggggagacaggagcctcagcaaaatgagctgggatttcaggaggggccacttcccctttcccttcccagaaggagtggccagagcacaggcctggccttgaggaaccactggcctgggcggaggtctgaggttagctctggagtgaggctgagggcagggttatctggagacggggccgtgtcttaggggtgtgtgggaggaggagggacacagctaatgagaagcaggtggaagggctgctcatgccccaggcaggggacaggctggctgggatggcccagtaagtaggaggacctgtcacctcacagacaatcccacaaaacaggctccgggatacccattcatattcattatatgtgaagtgggcggttgtaaagttagctttctcttcatttagctgtcactggacagaaaaatatgagctgtgggcagatgcccctggatgagagccagtagccagtctctggcctctctgtgccctcccctaggagcccccgaccc

SEQ ID NO: 1378 - DNA, 1065 bp, Homo sapiens
tcagctggggtgagaggagaattaaacacgaagggcctagcgttctaggctctgcaggctcccacggccagtggccagccacaggcttcctggtgatgataccagatttttgttgccgcttcttttctttctgctgcagcacaaactgtctttccagaaagccctggttcaggttactgcttgaaatgggtgtatgagggaagggggaagcacaggttgatttaggcaagacctaccgcctcctccccaagtaaatccagtttccctaactcctttaggtgaaaggggagaacgggggaggtgcttcccccattatgcttcgacagctaaaaaaaaaaaaaaaaaaaaaaaaaaatccctgaaggatggctttagattctttaaagaaagaaaactctgggggctggtgtcggatctcatggtcagcagcctaaagcctggctggagtctgtctgggagacaggaaagagcaatgtaacttgttgggtctggggactgctgcttgctgtggaacctggttggttcctccagcatcccaaattgtcatgttaatgagtctcagagcaccctccctttcccagcacccctgtgctggactccttcctagtcatagaagaaggcagggtagggaattggggaacaggcctgcagggaaaagccaggctggcataaatgccaggccagggcagatgcatcttctgcctggaagagaagggaggagcagaggtctcaggggccatggcataccgggctggggctgcaggcagccacgagaaggcagggatctttctcaggactgacaacaaagctagaggcaactgtctgggtttctttccttgcagccctgagactggctaagaaggtgagggcatagtgatgcccctggcctgggtctgctgtgagttctacagacttctcatgtaggtcactaaccttgctagtgttagcacttggctgtctgcattaggggagagagggcaggcacacatcattcagactctttcaaagttgggggtcggggaggagagatagagatagagatggggaaaggggacaaaccaggga

SEQ ID NO: 1379 - DNA, 1050 bp, Homo sapiens
ttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcaggtgagattaggggttgggaaggaaaatcccttttcccccagtggcctagggagtttccaaatggacctcagaccttgggatttggcatgtgttttgtgtggggcttccctaagcataaagatgtgcctttatgagggcaaagtgttgaggccgaatttctctgtcctctggctgggtctccgatagcttcccgaacatcagatctttggagtgagtattccacccagggtagggtgtgatgggcagtacatggggctgtatattagatgccctggttttaaatccaatcttggccactgtgctgtgtgccctgaggccagtcactcaccctctctaggcacctgtaaaatgggaataatatcatatcctaccctcaagactttgagagacccaaatgaatgacagatatgaaagtactttgggaagtcagaaccacattacaaatgtcaggtactgtcaatattagccagtgagcagggcagctg

SEQ ID NO: 1380 - DNA, 1044 bp, Homo sapiens
ctgctccttccatggtcagcaaagataggatggcagggcagcgtcggggctgggcagaggctgggaaatctgaggctccccaaaaggcggactgggcagagcaaattattgcatggggttgggggtgttgtgtaaagcctgtgcccggagtgtccccatctcggcacctccctcagtcttgggcagacacagaaatgtccttctggaaaggtctgttcagagtgggcactgggatacccccaccctgcagtggtttgtggggcctgcctcccacttgctctcagaatgaagtgacctgacccataagaagtgagaagaggggatgtgggggcctccatgcaactgcccttcaggagggagcaggcccttgaagtgacagggatggggaagcctgtggaacaggatggagatgcgagggcccctcccccaacagcgagaggactccctggcatggagggcctgggctctgacagggacacaacgagccgggtgtgcaggttcacagggatgccaccactgttttctcctctgacttgcctttctggttcagggaaccgaggccgctatttctgtggcagccctcaagttgtcaggagcccaagtttccacggcacccaccgcctccttccctctcttccctcccacagggctgggtctggctcatggcacccctacggtgggcacagatgtccctgggcgacaagatgcagcattgccaggctggagccctaatgcctcggggagctggctcccacacatccctcctggctctctggcttcatctgggagagatagaacccagatagcaggagggctgagtagactgtctgcccttacaacctctcagcacctctgggcctgcccagggccctgggaaagggcagggtgagcccaggcatttgcagaacccctgcataccaggcactgccacaggaagtggctgcctgtacaggcgtcaggctcacccaggccttgagcctccctccttgagagaaggctctctcccacccaccatctgagagtagagtttgttttccttgggct

SEQ ID NO: 1381 - DNA, 1030 bp, Homo sapiens
ggtccctttctccactgcactggagctttgaagacctaagaggctagtggttcctggagctagtggttacctgaacaggtatggcgatgagctacaacatcacctgagtcaccagagttgggttggcagaggggtgaagggttcaccccattccctgacccatccatgctcttcctggccttttagccctgggttcctcatgccttccagctctgctcctggtctactccttagcccacaccctgtgggtcagcagctggcttccttctaacgtctcattctttgtttctccctttcttttgctgaactccctgtccccccaaccccagaaggcaatgttgagccgaaagcgtgcgtcccagtgtctcacacctgtgctctttaaacacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtgggg

SEQ ID NO: 1382 - DNA, 1269 bp, Homo sapiens
cacttggggtccagaaaacatttttagctaccaaccatgagtcagacttcatccccatttacaaccgtgtgactagagggtagggagttggagaagattcctccagccacagaacagctccttgaacaagcttttgctaaaagacaagtctcctcatgcccttccttttccgaaaagtcttctctgactccctgctggataaaggttagaagcttgagcgtggcttccccagaaccttcaccgtctggtcccagcctctcttttgggcctcagtcagtccctgccctccctcccacacactcgcactccaatcccatgcacatagaagtgtttgaatgtatgtactttcctgctttgggttacacgcttccctttgcttggagtgtcccctggctttcctccacctgtgaatctgctcatcctttgtgaagtcttttctttctttttcttttctttttttttttttggtacacatttattgggtacaagtgcaattttgccacatgcctagttgcacagtagttatatcagggcttttagagtatcggtcactcaaataacatacattgtacccattaagtaatttctcattgtccacccctctcccaccctctctccctctgagtctccattgtccgtcattccactctctacatccatgtgtacacatttttaagctcctacttatgagtgagaacatacttgtctttctgtgtctaacgtatttcacctcttgttccggctgtgttgctgtaaacgacataatttcattctttttatggctgaatagtattccacgtgtatgtgtatcacattttctttatctactaatcatctattggtgggcagggcatttaggttgattccatgtctttgctattgtgaataatactgcagtaaacatacgagtgcaggtactttttttttttttttaggcaagatctagctctgtcaccgagactggagtgcaatgataccatcacagctcactgcagccttgacctctcaggcccaagtgatcctcctctgagtagctgggaccacatgccatcatgcctggctaagttttaattttttgtagagatggggtcttgccatgttacccaggctggtctggaacttctgggcttgggcagtcctcccgcctcagcctcccaaagtgtagggattataggtgggagccaccaggcctggctttcttctagatatattgatttcttctgtgaagtcttttcttttttctttttttttttttttttttgagatagt

SEQ ID NO: 1383 - DNA, 1048 bp, Homo sapiens
attactaaatttggaccctcggctgtttgaggtgactggggcaaagtctagagggtgggtaaaagcaggcaccatcctgtgggaacacagaaggaaagagccctggagcccagacggaggatgggctgggggaggtggagtggagagagaaactgatggagaactgggatgacttttggtgggatctgaccctttcatggagtcacagtttctctgagttaaaagtatctttctagggcatctaatccagccaagcagtggagcaggcacaagtctccagtctcagccagaggccttggaagatgaagaattccatttcctaagactgggggcacactgcattaaaataaatgacacttggtaggctggagttgagggaggttctctctggcctcttgaagaaactagacagcagggatataaggtccagatgcctttacacctggcctcaatttggtctcatattctgttttcaggaacaatacaaatctgtagcagaactacatgagttccaagctgatagcacactgataataatagctaatacttatgagggattcccatgcactagatgcaattctgaacgctcacttgtgttagctcatttaatttttacatcattgctttaacggtattagccccactttacccaggaggaaatggatgcactgggaagttcaaacacttgatcatcatcatgcagcaagttgtgatcaaaatcagaggatgagaaccagaccctctgactccaggagcagtattcttaactattataaaaagccagccataggcggatcacttgaggtcaggagttcaagacctccctggccaacatggatggtgaaactccgtctctactaaaaataaaaaaattagccagtcgtggtggcgggcacctgtaatcccagctactcaggaggctgaggcacgagaattgcttgaacccggggggcagaggttgcagtgagctgagattgcaccactgcactccagcctgggtgacagcgagactccatctcaaaaaaaaaaaaaaaaaaaaaaacccagc

SEQ ID NO: 1384 - DNA, 1042 bp, Homo sapiens
aagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtggtgcgtcctaaagtccatgtgtaacttgtatttactactttgacatggttcctgttttgtgatgtgtaatgggatacagcatcagatgcaattttctttttagttgttagttgtagcattttcttttttatatttttataaacgtctttaaaatagaaatcaggacagtttagctatttttttgtttgtttagctattattttaagtgaaagggatgccctaaaggtagcaggcaggcagacagatttgctttaattaggagttcccacccttatgagtaattttttttctctattcagttgttttttttttaatcttgagcttaaaaaatcctcagagttacaaaaccaaaattttgaaaagtcagaatttggagaaaggagtccactgaccatataaagagagtaatagccacctaaaaatgactcgattggtgtgtaggtaaataattcttttaccagaaatgtgtgtgactgaaatttgatcagggatctcaaagatatgctggtaaattgtatagcaatgtaattattttaatcaggtatttgagtatttcttaagatacagtttattcccagagagtttgctttaacatgcattttttaaatcatttgttctagagttctgtatcccatatatgcacttttggtttgtagcagtaactgttcagtaaaaattaaggactatgttacaaaccat

SEQ ID NO: 1385 - DNA, 1702 bp, Homo sapiens
ttttttgttagtgtgacagcgtacagaagagtactgtgtttttgctccatgtttgtttgaatctttacctgacattgccgcttttgttaggtctgggcaatttgtgcttcagtgtttttgaaacaatggcttgataccatttctaaatgtatgtattataaaaaactaattatgtttagttggtcattacctacagagtgccatagtccacatgaacctcatatttgtactgcccattcttttgtgcaggttcataatatccataaagtatctagttaaaccttaagaattcaaatgaaagcaaaagtctaaaaccggttctacttctcattagccaggatttaataatcccaacgttgaatgttctttgtaacaaccaatttttttctatctttcttctttaattattttaatgtagttgatttttctggaactcagttaaaatgaatggaaagaaaacttcaggatatcatttaatgactattaagtattattggtaaaaacgtgaagataagacttttagatcacagcttcaaattttatggaaaattaagcaagcaatacctagccaatagttctgcttaactttttggttaagtattttgttgggattcctataaataatttttcacacaaagttttaaatttctggtgtactttgactctcaactgagagtggatagagtttttcttttgaggattacatcttaaaatgtccatcgcctggctggttataagcatttgtcaccttttgaaggtaaaatatactctggcccttcttgactcagttacaggtcattttaggtccagtaataagagtcaggtgtttggttattgctttcagagtcagacattgtttaggtttatttaaaaactattagcaggttttcactgacaatgcttttttaaaaataaaaaatgtaaatccacttttttaaggcagattgttcattatgcatatacagcttgaactatagtttgggtccatataggaaccaatcaccaaaaactctggtaacagaattaggaaatcctcttgagaagagggccttaatgaccttttatgtgaaaaaaattttggagagaatttctggacatttttttttctgtctctctcacagggtttggttttcagataggagttaggtatgagaacaagaagagagaaaacttggcgctgaccctgttatagtggttatagtggtgtccctaaagggaggaaatgatttcaggtaaccacagtgaaatgttaagctgaatgaagagttttatatgtatggtttaaacagagttgaaaagtgagattcctgaagtgttctttggctgtttaacaattatttgtatgagtgttttattaaaataacggctgctgtctttggtaacatagatgagggtggatttttaaatggctttgtatcgacccctttctacaataatggagtagtctatgttgctccatataaattacagaatgaaaatagatggggcaaaagtttgactaaactttacctttttatagtttcactttttaagttatatttagaatatattgatagattataaattgattgtgaaacttttttctgaattttttcaacatgttttactcagttacatgagttaaaggatattttcagtcctgttatcttcaattgcagtctttaaaaaaacccaccctattgttctacttgttatatgtcta

SEQ ID NO: 1386 - DNA, 1087 bp, Homo sapiens
attcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtttttctgcctggaagtgaattgacggcaaacctttgacccctttgtttgcagccgagggggtgcttgctgctgctcagatcttgtatgtcttgagcaagaagcagggagaccatcaatttcattttgactatcacggtgtgtcaattctgaaggatcactagtgttactgttgaccccctttgtttgcagtgaaggggatcatttgcttctcggttctcaacgtgatgaggaaatggtgctgtttgctggcacgcaagaagccggggcaggcaccctaagcctcaccacagtgcctgagtcgggggcttttgctggtttgaagagctggagttgctgaaatttaagttttgatttattttgttcacccatcacgtttggccttagtttcatttttaatttgaagaaaagtttgaaattgctttatcttgcacttaacatttgcaccaaattgccaaaagaaggagaaatgctccgtttgctttttaaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttg

SEQ ID NO: 1387 - DNA, 1088 bp, Homo sapiens
gcgcccagcctacgataagtatcttaatatatgccatttgtgtatatttatgtacagaaacacttcagtaaactagaccccttaattgtaatttttctgcattctatggcagaggtctcaactctggctgtacaatggaatcacctgaggaactttaataccaatgactggggcccactctcagagattcatataaattgatgtagattgagtgggtttctgcaaaggcccagttttgttttcattttgttttaagtgctcccaggtgattgtaacgtgcagtcagggttgacaaccactgctctagagacacattttatacctacaaacacacacaatcagccttttaaggattgcttgaaaatcaaaacacaaaactttgagaatgtaatttgggttcagtacagtatgtatattgctcggtcttctagaatctgttattgaagtgtggtcctcagaccaacagcattagtctcagccggaagcttattagaaatgcagaattgcagggccttatcccaaacccactgaatggaacaagatcgtcaggtgatttgtacatatataagtttgagaagcagtactttagatgtagatataaatgttctatgtgataaaaactgataattagaatcttcttccatgtgcataggattctcagatttgtgcattagtcagtgacatttactataaagcatttttaaaaatactttcaacaagaaaagtggaacaaagtagttcttacttagtgagcctcaggtgaccagaaaattaccagaggtctctgtcaccaaggtaggggaaagggttactattttgcctatcctagttggttggttcttgattactttgctctgcttatctcttttcttgccttcccattctatcctcgtcacctgtcttctttatgagatagaaaatgttacttttttacaagtacaggtgcagatattggagacactctgctaataggtgccgcaggatttaggaaatttggtagtggtaggtttagagctttctgtgaggggatagatatgggcaggattgaggaatggttcctaattgcctttgtttcttaagtgtagtat

SEQ ID NO: 1388 - DNA, 2479 bp, Homo sapiens
cttgtgactgacttcacatttcttgaagcagtgaattcaatgtcaattcgcactttgagctatttttaatttgggggtcagaaaattgttttttattatcttagatcttattctcttgtacttctctggtaagtgaaaattggaaggacattttgaaagtctgcatggattataaaatcttgttgtagcgaagtctgattcttctttccattataaagtactatactactgatcagtttttttagtctctctactctcttagccaagcaagatgagttcgtctgttggggcacatacatttgttttcacctgggcagacacccattatttgtagaacctaagacacctgccagttggtgagtcatcttattgctatggcttcagaggactgctgtacagctggagtatttaggcttgaaattgtttgattaggtatgataagcacattcctctgatttacaggttgccatatataggtaacttatattgaactgtgactagttttgaggtagtggaaggaaggtaatatttgctgttgctctttaaaagttgtctcacttatttccttggtcctggcgtactacccttaagggatggacttacttttttcctgctaaaagacataagattggttgacagaagtcaaagggtggaacaccttgccattacttctgctcaatttgtcacttttaaaaatagtttaaaagctggaagcttgtcaataggaaaagtaaactcatttttaaaaatttattttcacaaggcaaataatgccttaaagtggcttcttttttaaaatttaatttaattaattctattctgatgaattctcattaaaagtgttgtatgcctcctttgttggtttctgttttgctcattagtgcttgcacgaggtaaaaatagaaatgaatttgtggattttttgtttgtttgtttggaaggtggctagaaaaaactttagtctttcgttgtgtgctatcaagtattcagatgtattctccactacttaataaggagtagccaactcatcctggctttaaaactgaaagttctatgtctcaagaactcctttgtttctgtctagacccagacagtcaccctaatcctagttcactctctgtatccctaaaaaggcctcactaagttgttattgattatcattttgaatggaaggagatttcataatatactagcttctgttggaatgtatcagggattaggttgtttatttttatttttatttattttttgggggttcggagtctcgttctgtctcccaggctggagtgcagtggtgccatttcggctctctgcaacctccacctcccaggttcaagtgattctcctatctcagcctcctgagtagctgggattacaggcgcccaccaccatgcctggctaatttttgtatttttagtagagacggggtttcaccatgatggccaggctggtttcgaactcctgagctcaagtgatccacccgcctcggcctcccaaagtgccaggatttcaggcgcgagccaccatgcctggccccaggtacttttttcaagagatgacttgtctctgatcctaagtcatgctagtctaattctcacagaaataaaacatgaagaattttaaatggattttaaaagttgctttcaagcactttagttattttttgtttgtgtatatgttaagaccatagatgacaaatgtgaaacaattgagtagatatttgtggcaaatgagtagccacatgaggcaaatatatagatataaagcctcatacaaggtgattctggcttaagagaaacactcaaggcttttaaaaagtattgggctttgggccaggtgtggtggctcatgcctgtaatcccagcactttgggaacctgaatcgaggatcacttgaactcgagttaaagaccagcctgggcgatgtggcgaaactccgtctctactaaaaatacaaaaattagccaggtgtggtggtgtgcacctgtagtcccagctactctggaggctgagggagtatggggcaggagaattgctcgagcctgggagacaggttgcactgagctgatattgcgccactgcgctagagcccaggcaacatgagtgaaaccctgtctcaataaaaagtattgggctttggttttatatgaggtcttcagagaaaccaccgtccaagttttgcactatgtctctcttaaaaacaattaaaataatagtatatgatttttttcctcacatggaaaaagctgattttacagttagacaaatgtatttactaaacatattttgcaaacaggacataacacatacctcaattatttgaaaaaaatcacaaaagtatcatttcagtccatataagtataattgcttttaataaagttaaactcctagagaatcattaaagaagaaaagccaggggccatgagctaattaatcagcaccagtaattaggttttaaaattggctttgttaagggctag

SEQ ID NO: 1389 - DNA, 1031 bp, Homo sapiens
aacaactacattattattgcattgtagcagatgtattttgtggttttaattttgacggaggtggaggatggggggtggttcttaggtactttgcatatttgcattctttttttttttttttttttttttttttttgagatggagtcttgctctgtcgtccaggctggagtgcagtggcacgatcatagctcacggcagcctccaccacctgggctcaagtgatcttcctgcctcagccccccgagtagcttgactacaggcgtgtgccaccctgtccagctaattttaaacaattttttgtagagatggggctcactgtgttgcccaggctggtcttgaactcctgatcactcaagtgatcctcccaccgcagcctcccaaagtgccaggattacaggtgtgagccacctggcccacattctcctttttgtttcaatacagacattaaaattttaggccaatttgagttagatttttattataactgctttcaattaaatcagcttcataatctgttgatactgccaagaagccagagtaatgtaaaggagaaagagtagggttttgtgttagattgtgtttgaattattactccactactcactgggtatttaatttctttgaccttcaggctgggcacggtggctcatgcctgtaatcccagcatttggagaggcccaggtgggcaaatcacctgaggtcaggagttcaagaccagcctggccaacatggcaaaaccacatctctactaaaagtacaacaattagctgggcctggtggcgggcgtctgtaatcccagctacttgggaggctgaggcatgaaaattgcttgaacccgggaggtggaggttgcagtgagcccagatcatgtcattgcactctagcctgggtgacaagagtgaaactccatctcaaataaaactgaattattttaaaaaataataatttatttgaccttcagtttcttcatttgtagaatgggcatcatagtatggtatctctatctgcttctgaaggttatcatgaagact

SEQ ID NO: 1390 - DNA, 1047 bp, Homo sapiens
caggaagtagaggctgcagtgatctgtgattgtgccactgcacaccagcctgggtaacagagcgagacctggtctcaaataaaaattttttgaaagaaaattatttttttaaaaaaggtatgtgtctacctcagtaactggtgtattattagatgttgaagtgaagttattcaccaccctactgccccaagcgcacttactcatatgtaagttgtgtaatatttgtttcctctttgttttatggaatctcttgagggggaagaaaaaatcagcaactattatgcttttcttgaaactccatatatagctgggatgatattcctgcattatggattcctagaaatgttttatatggcatcttattgtccacaaaaatgacaacatagcagtaaatgaacaggaacatcataagttaattgttaatatgatgaacgcgttagttatagaagtcgttagctttctgtagtcttgggattcaggctttcttaattcacaccacccaggtttagagggcctattactattgagtaggataaagaacttctctgttgcatgagattcataaaacctaagaattcaatttggagttctttagttggtcccacttaaaatgtacagcttgcttagctaggaggaaggatcaggttgctctaggtagttgaagtcccttttaaaaataattgctactctaaagagaagaaggaattaatgaaagtggttcataaaatcattgatttcttttattttttgttttgacatgaaagcagaatggacattagcagctactatatatgaagggcattttgcctggtataagtatattttctttttcttttttttttttttttttttttttgagacggagtcttgctctgttgcccaggctggagtgcagtggcatgatctcactgccacctccacctcccgggttcaagcgattctcctgcctcagcctcctaagtagctgggactacaggcgtgcgccactgtgcccagctaatttttgtatttttagtagagacagagtttcaccatgttggctaggct

SEQ ID NO: 1391 - DNA, 1065 bp, Homo sapiens
cctcaagtgatccacccgcctcagctctcaaagtgctaggattgaaggtgtgagcaaccatgcccggcacaagtatattttcatgggtttagtcctcacagtatatctgtgaggtgggttggtggtattttcattttacagagcaggaaattgggtctcagataagttaattttaagtaactttcatgagggcatatggtaacaagtggcagagctgatatttattattagttaactatttttgctgtttgtatgtgtaaggggtggttttttttttcattttttttacatgtaaaatgtaaaaatattagacatccacatctaaatgtaaaaatgatatttctttttttttaagtcagaaaaccagttttcttttttcttttgctttagtcagaaagccataaaaaccatatttaaataggatcaactactgttttttaacataactgagatttgaaccgagattaatttggttccaaagcttatgctaggccttggagaatacaaagatgaatgaaaccccattcatcttgttgatcttgcagactaatggaaaggattgacatgtgagttcatgtagtactctgttaaaagttagataggattccagatgagaatgacaatgctggggaagatttttccaaaggaggtagcctttgagtgagtcagatagtgaaaagtgaaatggtgcctggtagagaaggcatacataggcagtgacagggtatggagctaaaaccagtcttctagagtttttctctgtaagttgttaatagacattttaaagcagagaggaatggaagagtggaataacgatgatggtaatagtttaagaagcattttggaccaggcatggaggctcacgcctgtaatcccaccattttgggaggccgaggcgggtggatcacttgaggtcaggagtttgagaccagtctggccaagatggtaaaaccctgtctctattaaaaataacaaaaattggctgggcatggtggccgatgccggtgatcccagctgcttgggaggctgaggcaggagaatagcttgaactctggaggcggagtt

SEQ ID NO: 1392 - DNA, 3207 bp, Homo sapiens
aaagcattcagaaggagatgctaagggaggttggtggtataagaaacatcttttaatttaaacatatttcccattaaaaccacctattcaactttcatgtaaatcttgtaaagagacgtttcaatatttagtgtgaatattttgttaattagatgtagcagaaaaataacgctttgatgggcaaaattgctgttcagatgatcttgaaataaagaagtttttaaagcaatttttatatactttttattatttagcaatacatgtttatcatagaaatttaagaacctaagtaatacaaagaaagtaaggattacctttaattaagaacctaagtaatacaaagaaagtaaggattacctttaatcaataaacaaagataaacttttggagggagcatataccattccagtcactaagtaaggttttaatattcagattccagaattctgatcaatcaatggctatgtttcacacttctttaaattaaaaaattttctatctttacatattttagtgactgaattaccatggcgtaattgagagtttggatttattatggtacattccgatttctatttaatacataaggtacctgattaaaattttagcctatttggttaaatactaacaatacaggttgctattactcttgtcttactaccaattagacatttctcagaatgctaaagcaagaaggaaccttaaaaacttatctggccgcgcccagtggctcatgcctgtaatcccagcactttggaggacaaggcgggcggatcacgaggtcaggagatggagaccatcctggctaacatggtgaaaccccgcctctactaaaaatacaaaaaattagctgggtgtggtggcgtgtgcctgtagtcccagctacttgggaggctgaggcaggagaatcccttgaacccaggaggcggagattacagtgagccgagattgcgccactgcactccagcctgggcgaaagagcgagactccgtctcaaaaaaaaaaaaaaaaaaattgttttccttctcatgttacaaatgtagatgcgatgtgtttctttcaagcttttgtttccaatgacattagtttaggttttcttttgtttagctctcacttgattgcagtcttctttctttcaggtcagactgtttttccatctttcggccaatggtacaaaaaaaaaggaaactgaagagaggagatagcatatgccagagaagtagaaagagccattgtatgtctgggtataatcatataaccagcctggaaggaaggaatgatttctgttagggaaggaaattttgccattagtaactctcagccatgaatagctcctcaaagcaaggagcctcctgtattgtgacccatttgaacttagtgaagcttcttagctgccctatttttcactgatgaagttgaatcagctccacctgagttagggacttacaccatctccaatcttacagtggaagttggagaaaattaggaacacataccgttttattttaccatgaattttattagaaggccgctattatgaagaaaataatcataaattattgttttccagagaaaaaaagaagtgataataatcagttttcttttttttcctttactaaacaaagacttgagtacttactatattcctgttaatattgctaggtgttgaggatacactagtgagccaaaacagatacggtccttgccctcacagaactttagtggggagataggtaccaaccacataaatgatatgtgataagtgctatgaagggaaggtgcaggaggctatcagaagatatgagaaggaactgactgcttgatcacgtgggttaaacaatgacaagttcccccctgaaatctaaatgctttttttttttttttttttttgagacagaggcttgctctgtcacccaggttggagtggtgtagtggcacgatctctgctttgcttactgcaacctccacctcctgggttcaagcagttctcctgcctcagcctcccaagtagctgggattacaggtgcccgccaccacacccggctaatttttgtgtttttagtagagacggagtttcgccatgttggccagggtggtcttgaactcctgacctccagtgatccgcctacctcggcctcccaaagtgctgggattataagcgtgagccactgcacctggtcctaagtgctttttaaaagcataagttggagggtcttcaaagtcttttggctaatggcacatactaaaacttaagcgaaacacttttttttcttttttttttttaactgagtaggtgatagcaaagaatatttatgctaaggcacatcattgcaaaagtcaacactgaaaaaagcaaataatgtccttagtattatcatgacaataattttggcctcctggacttcctaaagggtctcaaggatctctgggggtctgttgacctcactttgagaagttcttttccaaagtatagtatgtatattatatctgatcacttattcaagaaatttcagtgctgtatggcagcacaggtctgggtttcagggatatacccctgaacaaaatagatgaaaatatctgccctcatggagcttacattgtgtctttgatttttcccttctatcttagatcatgatgcctcactggatatgtagagtataccctcccccacctttttcttctggtctgcttgtttcatctcctctttgttctgttatggacacagaggagatgagacaagcagaccagaaaaaattgacttaatttatttttgttttatagctctgtgtttcctattgttaatgtaaaaaataagtgaatagaatgttttataacctcttaagttcaactaactttaagttgctttttacttactgactcctgtttgattagtgacctctattaaatgtttcttggagttactggagtgaaaacaactggacaagtctttgtgttatgttgattgttattgacctatagatctctaagaaataggtgactagtctctgaactcttgtagacatttctagaaaggaaggagtatagaaggtagcagtccttaccctcccatcccttgtcattcttgccttagtcctgccaacacagcaaatgtattagagtgtatgtgtctgtgtatgtatatgtgtatatataaaacctgtgaattataaaatagtggtctcagaagtaacaccctggggaaagact

SEQ ID NO: 1393 - DNA, 1045 bp, Homo sapiens
atagcataagcattgtgaacgtcagagaaagacaagattacataccagttataatctaggataatgtgcatgtatctgaatgttcactctatgcctggtattactgtatgtagccagcactctgaggaataaactggcagctgatgcagaattattaagctgaagacctctgtaagcatttccttggtgtctacaggctacctgcgtcagatttacctgagatgcatgttaataatgcagattcactggattctgtcaagcataactccatcctgggtggcactcagttgattcttacgcacagtaaaattattatttaacaataataattattgtatttgaagttactagtccagactcttttcttatatctatggctataggacttgttttaggcagaaatgtctagtaatgtttcctgtgataatttaaaacaaataggaagattgggctgagcttctttaaatactggtgcaaaccattttttttacagtcagttaaaaaggaataagaataatcattcaagttagatatttaatataggattctgaactcattttttaagtgttaatattttaaaactattccacattattttatgtgttaggccatacatgtttcaaaaggaatttagcatcctgtctaaaaagtattcataccttcagacatctcagaatctcagaacttgattgttaagctaagttatgaatcttttttttttttttttgagatggagtctcgccctgtcgcccaggctgaaatgcagtggtgcaatctcggctcactgcaacctcctcctcctgggtttaagcgattctcctgccccaacctcccaagtagctgggattacaggtgcacaccactacgcccagctaatttttgtatttttagtagagacggggtttcactatgttggtcaagctggtcttgaactcttgacctcgtgatctacctgcctcagcctcccaaagtgctgggattacaggcgtgagccactgtgcccagtcatgaatcatttttattaggattactatgtaagtttact

SEQ ID NO: 1394 - DNA, 1023 bp, Homo sapiens
cactatttttgtatttatattgctttttgcaggtttacttctgttaacaggggtctgtgagaaataaggcttaaaatatcaatacttctcatttttccacagccttccaaggcttccatctttgtgccagtgtgtggctctgggtgccatctaaccgcaaaagcagcagttgggtttggatgagctgtgtgacatttggcctacacgtaggtctactcaccaccctggtcagggaacctggaacaatcctaaaactcacctactctaatgcaggccatattttttaattaaaattgaaattgtcactgagtattggaataagaagggactttggggtggagtgggtgagcagggcattgtcttacagaggaggtgtggggaccggtaagttttaactttcatcctttcaatctctcagtttcagcaaagatcttataaagaattttgttgctttcttaaattcatgaaagaaatgtaagcaattgaggtgtgtaattttcttgcccgtattctctatattaaaaaaaaataagaatatggttctatgaatttcttgtgctatttttgctttccttgaattattaaaatatgttgcatagaactaatattgttttcttttttatttttatacaggaaggagagaaatattgttcatgtaatgtgttacctttttttgtctgtgtgatctacaagagcatggctgaaatgttaccatttttaactagtgttttgactgaagattattatgaaaagttttacttttgttagattcctaattaaaaatgcctatactcttttataggagtttcaacttttgcaatttggtaataacagatttaggtaagtaaaaaatgagaatctcatacagttctgaagatctaagtttggttgagaatttaatgtttcatcaccagtaaattcaattaaagacttttgattcaattaaagactcagttctgcctacacctgcaagaactgagttgatctgtacatcaacatttctgatgtttctttggtagttgc

SEQ ID NO: 1395 - DNA, 1100 bp, Homo sapiens
ggtgtgttcataaatgcaaataagagagttggttgcatatttatgtaaattttttctttagaataagtatgccttaattgaacctcagctattggcatattttttgttcccagtaataattttttttttttttttttttgagatggggtctcactctgtcacccaggctagagtgcagtggcatgatcaaggctcactgcactcattcctgggctcaagcaatcctcctgcctcagcctgccgtgtagctgggactacaggtatgcaccatcacacctggctgatttttaaaatttttttgtagagatggtgcctcactatcttgtccaggctggtctggaactcctggactcacacaatcctcccaccttggcctccctaagtgctgggattataggcgtgagctactatgccaggccctctcagtaacaattcttgttatccttagtttatagtctccttcttttaatatttactttttctgagtctttttttgagatgaagtctcgctctgttgcccaggctggagtgaagtggtgcaaagtgaagtcggctcactgcaacctctgtcccccgggttcaagcaattctcctgcctcagcctcccaagttagctgggattataggcatctgccattacactcggctaatttttgtatttttagtagagaccgggtttcaccatggtggccaggctggtctcgaactcctgacctcaggtgatccacccacttggacctcccaaagtgctgggattacaggcatgagccactgcgcctggcccctttctcagtcttaagaggtataaacttaacatcattatgaaacttaattttttaaaaaatgatagtaggacaagattaactcccttctgtcttacttcaggactaaaagaagcaaaagtaagttttaggctaagttcctttatgtggatgattagaaatgtcatagtaatttgtacactgaaatacattgagaacctgtggtgtgtgagaaactaaagtttaggtctgttccctagaaatacttctgtgtgagtattcaagtttgtaatagtattagattaaatattcagcaagtacagaatgtctaattaggta

SEQ ID NO: 1396 - DNA, 1012 bp, Homo sapiens
tgtaatatgcttcccttcgcacagatctccccctgccccatgaaatgctttaaaggtaacttaactctttgttcggggctcagtcctttggatgttaatctgactggcttggtgcacctaaataataaataacatatatcctcctcaacccctcagtctctctgattcctaaattatcccgctgtaattgcagggctagatttgccgacctgctttataaagctatgttaaatcagtatattttattctttttattagacttttctatagcataaaaatgataaaatacagcaagaaaaaaagtcacctgaaactctagtcctaaccctaatatgaatgtgaaggagctgggctagaatggaatagggtagaatttgcataaggtggaaatggggacaggcctgtcacaaggatcactagagtcttgctggcaaaagcatcttactgcattcatgctgcagcacaggacccagatgcagaacaggttggggacacagccctgccttctaatagtggacaccatctgagagctgagccatagattcaaagcctaactcctaatagcgattggtagtaatatcatcagcagttcatatacatggagtgacaacagcgtgccaggcaattcaaagggtctctcggtcctcacagcatttttgaagtagctaacatcactatcccccttttacagttaaaaacaacaacaacaacaacaaaaacacaaaaccctgaggctcagaagataaatatttgctgaagatcactgtgcttgtaagtggtggagcctgaccattaacttccccacgacactgcttcaatttctatcacttcatcaaccacacaacccgagaactgtgaggggatttagcaggcccagtccagatctcttattgtacagagaagaaatctgaggctcagagaggggaagggactaatttggacctttaacttcggattcttaactttctttctggtgttctaactatactgtactacaagaggctgtcttaga

SEQ ID NO: 1397 - DNA, 1020 bp, Homo sapiens
tagatgtaaaatctggtttctcctcttttttttttttttgagacagggtctgcctttgtcacccaggctggagtgcaatggcactgtcttggctcactgcaatttccacctccagggtttaagcgattctcctgcctcagcctcccaagtaactgggattacaggcccgcaccatcacgcccggctaatttttgtatttgtagtagagacagggcttcaccttgttggtcaggctgctctggaattcctgacctcaggtgatccaccaaccttggcctcccaaagtgctgggattacagtgagcaactgcgcccagctcccctcctctttttaactctcttcctgttgctcagttaggatacttaaaaaacacaaaccagtacattatttaaatgtgtccttggattctttatcacatatcctttaaattgtttcacttggggcttgtctgagaatttgactgctactcccagaagggtttggtccaaatcacacaaatcattagagatatagtagaacaacagggaggtggattgattccagtggaagacctccagtactaaactagttctaggatggggatcaaggagtgagagcaggttcaaggatagttcagccactaatagtcatttatggaacaccacagagtatatcaggtaatgtgttcccctgtaatactttttcttggcctctgttcttaagtgatttggaatgtatgaataacccaagaattagttaaatctttagggagacttccagaatggaagctattcttttcactagttgtgatggttcagaatggctgctaggaggaatcagaatatgactgagctgctgcttgttgttctgcaagggaagataatgtcctacaatggagatgcctggatgcatttttagctacgaggtagctatccttattaggctcaaagcagaatgcatttaaataggtcttggttgttttctatgacaagctgttatctctgtgatcttcagtaagataagtaaattttctaagtcacc

SEQ ID NO: 1398 - DNA, 1491 bp, Homo sapiens
ccaggctggagtgcagtggcgcaatctcggctcactgcaagctccgcctcccgggttcacgccattctcctgcctcagcctcccaagtagctaggactacaggcgcccgccactacgcccggctaattttttgtatttttagtagagacggggtttcaccgttttttagccgggatggtctcgatctcctgacctcgtgatccgcccgcctcggcctcccaaagtgctgggattacaggcgtgagccaccgcgcccggcattcttttacaattctaattgtttcagtgagttcttcattatgtagcacttggatcttctctcccatagcttccaactagctttccaacctgcaggtaaaaatatgttagtcaaacatggtaactgtgtgtctgaatactcttgcctttcttattttatttcacaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacaggtattgttgatttttttaatgttattgattattaacaatggttaaaccagtgtgctaagcagtgttagaatacatgtttagtcatgagaataagtaattttgtattaaattttagtatttctcaaaagactatgaacctagttaatatttgttcattattggtagtgttaggaaatttagaaattactttctgcttgttatttttagccccaaatattgttttggcatcttttgtttttaaaagcttggggcataattgtcaccatcaaaactcttatgaactaaatgagagtacagtggtgggagactagttaggtaatttgtggtcttcatatatttaaatgaatgttatgtagacattcagaattatgttaatggacttggattataactacgtcataagaagctcagagaaagactatgacaaattaggagtatcgttaatattgcattgtgtactggaaatttgctaagagagtacattttagatgcttttaccacaggagaaaaaaggtaactatgggacatgatggataggttaatttgcttaactatagtaatcatttatatatatggcatgttttacacctcatatacaatttttaaaagaaacactaaagtgctagcaataactgagttactctgtttggattataagtgatatctctttatttgcactgttttgcaagtttttaaaatagtagtttattatgtttttagagaggaaaaagacacttaaaatctaaatgacagtttttcagctagtctttctgacaggaactcatccctcccctcttttatttttgttttatttagtttctcaattattttcttgtttgacatggcacttaaaatatttaaaaagaaactaacaaaaaccccttatagttttacctcctgaatccacatttacaggta

SEQ ID NO: 1399 - DNA, 1010 bp, Homo sapiens
ttaatttttagtgtttctactattttcaaaaatggcagaatttataatatctggatttcacatagtttatgtttcgttggttattatctcacagttcactttcaatacctattttgaaagcttatttatctgtcagccctaatgtattctctttccctttcaaataatacatcaccaaccatatggtgtgggaactgaaggaaggaaagaaaattaaccatggatgtaggagaagagtaaatagtgtttttagaagtgatttgatatcacagctttctgtcttccagtctttgaatttccctcatgatgttgtcctgtgatgaagtatgtatttagagaactgtaaacaactccatatggttggatgataagatgcctgcctgtagggagtggcaggagataaggctggagaagatccagaaaatcaaggtcctgtgctctgccaagaaatatgagcttttaccctgaatctgcagggaacttttgcaggacctaaagcagggaaatgacaaaagtgccttttagaaagatcagtctggcagtaaggcagagggtaaattgtagtaggctgtgacagaagcaaggagacccgttagaggaagcatcagcataattaatgtgaatgatgaagcatgcactaacacaatggcagtgctattgcagagcaaggaataaattggagagagacttttgaggtagaaactataggacacaatgtgtgtttggatgtggggaatgaatgagagggcagagactgaaatgactcctagttcccttccttgggtggctggatgaaggtagagaaaggcactacaggaagaggaacctatttaaagagagcagtctacccagaaacatatgtgagggattttagacatccaaataaaatgagaacaggagaaaacttagagaacaagcttagaaagaagcccatgaaatttattgaacagccagagtagtaggaggcgtactggaatataaagccagaaggatgcatttcacaaaagaac

SEQ ID NO: 1400 - DNA, 1057 bp, Homo sapiens
ctgacctcgtgatctgcccaccttggcctcccaaagtgctgggattaggtgtgagccaccgcacccggcctatattaggttatttttaattctataacttgtagacatatatatatagaatcatttctataagttaaatgcttagaaatcctaatcaatctttaataaaactatacttacataaaacatcggtctttttttttttttttttttttttgagacggagtctcactgtgtcgcccaggctagagtgcagtggtgcgatctcgactcactgcaacctccgcctcctgggttcatgccattctcctgcctcagcctctgagtagctgggactacaggcacccgccaccatgcccggctaattttttgtatttttagtagagacagggtttcaccgtgttagccaggatggtctccatctcctgacctcgtgatccgcccgccttggcctcccaaagtgctgggattacaggcgtgagccactgcgcccggcctaaaacatcggtcttaaaaaaaaaaaaatctatgctgtaaaggcagaactcacttaaattatttcaggagcaaaatactcttcaattattttttccaagacaaaaaataataaattgaacttgggccaatatatgttggctcaaatgttaatctctaagttatcttttttatatatcagcttgggcaaggctcgtaactttcatgggcctcatttcctaatttgtaaaataagctttagatgatctataaggttctttctgtttataaagtctgtgagtctactaattctacacagatattattacaagtgtacttatttataattacagtaggcagagtattaatttttgcttttattacatttttcaattcatgcttctaaagtttcacatttatattagctaaaaaccctgtcaccaaatgtttatttctatgtaagtaagtagcttcccactctttcttttctatagttaaatgaaaaaagttaataggctatgtattccactaggtagtctgacaaatttagttcatctttttgtccaggtgatttttaaagaat

SEQ ID NO: 1401 - DNA, 1060 bp, Homo sapiens
ataaaaaactgttgtttgttaatgtataatccactttctatggattcagaattgggaaactttctaatccctgcgtagaatctatttatctttaaatgtctaatacttatcacatgaattattaaataccagaggttttcctttcagtttccaacttccctgtgtagctttttttcagcaatgatttgttcatttgggcctcagctccgttcgtttaattttatcagttgccatagatgatgtcctaaaacaaccatttgtattaatgtaaaacctagattgcagtttggcctctcagatcaccaggtaaaatcatggacatctatctatctcattagcattcctcagttcttaatttttatttaagtagtttttatttgaagcctagtctatactgctactgttttgtgtgttatctgtgtttccaaactttttaagtgattgaactggatgttttacttacttttatcactagtaaactaatccaatgtagtagagtattataatgctggtgtggaattagggaagagaaagaggaaaaaggaaaacttctggactaaagattatcaggaaataggataaggagatggccaatttgatttttgctctaaccatatccaaatagaagttactcttgattagattctttcccacttaccctttccacatatatgctagtttttttgagatagcagaggtaggagtgtggtgaggcttgggacagggaaggagcgtaagatggattagtgttttttcaaaatgtacattgggacttctaagaagaattcctatctacagggaagtctagatcagttctggtgctaaagggatttatgtcatagtgtaattatttggcaagtaatattcaccactactaggtaattagagttgattctgtgattttagtattagtgtttccagctgcctacttaaaagtcattttttcagtatattacagttttaatttttttaacttctatcttgatttggataagaactatgtatgtatgtataaggatagtatagtactgtataaattgtatcattccatctttaggtg

SEQ ID NO: 1402 - DNA, 1131 bp, Homo sapiens
caccatttatttcatctgatactacaaagcacttatttcaagatttcatattttataacagtgcaatgtaatcctctgcttgatactcaaaatttaatacctcctcaattttttttttttttggtgggaaaggttaacctatggtttcagcccaacttcaatgagtcagaaatttcctttggaaaggaggggtttttattgctctttgaaattcatcaaattaaattaaaaggctttggattttatatgattttgctcataacaaatttttgatgcctccttttcccctttcctcaatatttgagattttttttttctattgtgcatgatagaggaatgctgctaagcttgcaagtaattaacttgaaattgttgtgactaattctgctcttttggctttttgtacctaatcagaattgatgtgactgaagtgcaaatcttcataataatcatgcatttgctggcagtgattggaggaccacctttttggcaatctatggtaactttgttcacattgtgtatcccatgtaatgcatgttgtcttttgcttgtgttttctaatatgggataatccagttaaagggtaatgtgtgaaattcttttatttttttccaaacagtagaacacaacttctctttagaggatggtgaattttactacttgaagttatgtagaacgttaggactattccagggctattatttttgaaggccattgagaatctgaattagtattgttatcccattttacagatgaggaaacagcagacagtataacaagttaaccagtgacaagattaaattagaccttttattctctttcttaactacatgagtctactagtttttctgtcatatacttaaagctgaataacaaatttgagattgtaagttaactctggttccaaaacaggataaatacctgttgaatgaaatcagtgccatgggattgtttgaacgagcttggaccttgatttccaggtctacctgaaatatagtcactcttacaaacacagattcttttccacaaacctctgaggtagggagtaaaatatggaggccaagaacacaagctctggaaccagactgtgtgcgtttgacccaggttccatggcctactgtgtgaacttaa

SEQ ID NO: 1403 - DNA, 3415 bp, Homo sapiens
ggtagtaaattccttcaggtatactttttacctttttccattatgatttatacatataatctacacatgtacatagtagatataattttttcttttataaagatcaaatgttttgtcctgtcttgtaattaatataaacatcctttttaaattatatgttttatctgaggaactctcagattcacatctgaaatggagttcccagacccagtaaactagcaatctaatttcaggattcatgaggtgaggttgcaacgggaaaacagattctccccctgccccttcatcctattgttagcactttggtcctactgttagcatcattaaaccaaaagggaacaacccgacttctctggtgatatatttggagacttagtgaaatattctgttttttcttttttaacaactcccaatacggattcccataattgaccccagatcactatattatttttttctttttacttagcattaagggttcattactgaatatgctgttttgaattgcattctgttaatacaggaacaaatactacatattgagctctcacatttttgtgtgccaaatggagaaaagatatttacttagggttcaggtatgaaatttacatctcttctgagattgaggccataaaatggaaattgccttccaaatcctcattaagttagaaggcttttactgacatttagaaagcaagtttatggtcagaacaaataaaaacagtgcagatgtcttcataaggctgattccagaagatcagctgttttgtaaaggtaagtgatttgcatctattacatatggattacccattctttcccaaattttttccccaaagagatgaatttttaccaaagattatagttattgttgttgttgtggttttccttttttttttttccaaaggaaagcagttgtcttcatgcataaaagtcagtgcttgttttatacattgcaagaaacaaaaagcatattttttgtttgttgcttccccaaaagacattccttttagaatgccttggaactatgttctatcatatcactctttaaaaaaaacaaagaagaatatattcttatttggaagagacttaatataatcaactcatggttacttttactgatgcttgagtcttttaaatgtagtaattgatcaaattgtattaagccataagggactttctggaattcagttaaggcaactaggtgagtgttactactgcaggtgaggtttcaggattcatttggtcagactgaagacgttctatgtagtataaattgattatatctcattcttgaactacaagactttaaaatgcctttacacttaaataattctgatagggtgattttcctttgtagacactgtaattatgttaacatttgctgtattttggtggaattcatttacattaaaatgatttacaaacaggcattcccacattctttggaggaaagtgtctaatctcaaaatggtactttttatttctgctctgatgtacaaagcctgtaaggacattttatcatgcttataagaaaactagtcaaaatttactaactgatattagtctgcattaatacaaactattgaaccaaaaaacatgacctttgtaatctggtaaagatactgataatttaagattttctttttctatgtctaacctttttaaaagtgaatttcattacattgttattatttggatgcataccttcatggtatgagtctggagagttttcacctggctgtaggacagacaccatggtccaaaggaattcttactcttcccaactcttaaagacttgaaacttcaagcagacctgacataaagatgtctttggtatagctctttggctatttctaaagagtggatgcactttggccacctttgataagttccaagatgatgacagaaagaaaaagattgggaaagacagaatgtgcctgttctttttgacttgagggagagagagaatgtgccaccctccttgatcttaagcgtggggtgagaatggcaacactttgtgttttttataagtagtgccaatttttaaaggatcacctggtgagacttgggattcctttgactcgagcttttccttcactttgcctcatattttcttggtagctcactttctttttcattgctaatgtgggggctagatgtttcttcatactctcccaaaacaggagttctacatagaaaggaagagaaagggagattttaatcttcatttaacaaatgtgtattgagccacctacaataaccagggctctagagagtgtacaaaatcaattcaaacaaaatccaacactcaggagcttatgttttggtgtatatagctaacatatatgacaaaagtgatgaaaaccttaagaatctatgatactttgcgcctaggtcaatagcttgcttccttactttgtggtccaagccatgtactaattttcctggcttttctaatgtttgtgtttattcttctttcaaagggcaacaatttttatgatcccaaagcaatttcaccaaattttaaatacagttatgactctcattcagttcatttatgacacagatgactattatacagagatggtactcatttagtaccctggccctaatacagggctgtccctgtaatagaataatgctttgcttcttttggaatctgagggaagtatagtattttcccttttgccagagagatcttttgtctctatggagtcaaaagtgggaggggtgggaagagaggttgggaaccaggaaactagccacagtattgagtttcagccaggtgcatcagattgagaatgtaatgtccctagtttattgaacaagagcagaaaaatctcttggagttcaaagcaaccatggtgttgattttctcctttcttgaaaacaagttttgaacttagactgtagaggttggagatttagggggagaagataaccatttaggataatccataaagtttaggacttgacttagttgacctagttaattttagaactaggttgacctagttaattttagaaaatttaacactgctacagtacaatttaaacttgaacatttgatttcaattttttttagagctgcatttttgcaagaggtaacagagttatctcaacaaagtgagttcttgagagttttgaagaaataaagtatccaaccattaagatttatgtcttccagtcttaactgaggttttctatatagtaggaagtgccacatttgctatttgattttaaaagtgtagatagatgttagccatacaaagtgtaaacagccctaattaaaatgctttcattgtgaccgggcatggtggctcacacctgtaatcccagcactttgggaggctgaggctggcagatcacttgacgtcaagagttcgagaccagcccggccaacatggtgaaaccc

SEQ ID NO: 1404 - DNA, 1050 bp, Homo sapiens
gttagccgggcatggtggcaggcgcctgtaatcccagctactcaggaggctgaggcaggagaattgcttgaacgcaggaggcaaaggttgcagtgagctgagatcacgccactgcactccagcctgggcaacagacctcgactccatctagaaaaaaaaaaaaaaaaatccagcagacacctatcaggaacatagaaaataacaagtgttggcaaggaagtggagaagttggaacacttgtgcactgttcgtagaaatatgaaatggtacagccattatggaaaagtgtggtgattcctcataaaattaaaatggaaataccatgatccagcaatcccagtcgacatatatactcaaaaaaattaaaagcagggtcttgaagagatacttgtgttccatggtgatagcagccattgttcacaatagctaaaacatagaagcagcccaatcggccatcagtagatgaatggataagcaaaatgtagtatatccatgcaatggaatattattccacttcaaggaagaaaattctgacactggctacagcatgaatgaaccttgaggacgttatgcagttttacaggatgagttatggagctggatagtggtgatggtggcacattaaggatgtatttaatactgttcttaaatggtacacttaaaaatggtaaattttatgtgtattttacaatctttttttaaattgaagaaaaatcctgtagataaattagaaaattcttcccttcataggtttatctgcatttgattctcccatacttgtacaaggatttatttgtattcaaatggacaaattacgcaataggaaatatttgaaaatatttatcatgggtaattgctattttcattgacttcctaagattttatgtaataatcatttgagtcaatattggtagctaatgtactaatctaatattgaaatcagattgatatctttgttacttaaagataatttgattggatcagcagttatttcaaattgattaaacaaaaaattataaaacacctagtttgtgctaagcaacgtaatgc

SEQ ID NO: 1405 - DNA, 1050 bp, Homo sapiens
agcacaagcccatttccctcgccgtctccccagacacggtgccctcgtacctcactgcctgagagaagtagaaggttggacatcgctgccttcctcctcttgcatgtcccctgtctagggtcagagcttccttcaaacccagctctcccttttgggcccgcgggggcgggggggagggacacacggggaacggggttggagggttgggtgaattctctgtcctctgctgtaggagtgcgggtagactggagcattgctgtctccgggctcacttctgtcagggttcagggtctccctttccttcctttattcccccagttaatagggctgacatctacatcccactccaccttccagcccctttcccgccttctttaccctcatgtcttccgtagcttaccatgtgttcgccttttcagtgttacttttcatgggtctctgcttcttccctgaattttgttagggaagaggtcacggtgtgattcttgttatccttcaaactagcggcttggtaagagtatctcttgcccccttaatcaggaagttaaggacggtgtcttcagccgagttgtgtaatttactgctacggggagaagatgagaggaagacatttgtgcctacaaaatgggatctcctcttagggctgagaaccagagtttagggaacctttgacctcttggaaaaagaactgccattgaggagtaatgcattctgttttgggagggaaaatcattttgttacttctttgaagggaggaggtataagaaatgaaatagaataatagagcagaaggtcaatgagccacagccctacaggtagccagccactcttcttaggtggcggatgatgtttttgttttgattacagtaagaataaagtatcagctcttagatttaacttggggctcctaccttcaaaagcatgaagggccgtctcagaagagatgctgctggaaacaggatttggaaactttctttgggtttcctgtcagaatgtgtgggggtggacatgcctatgtgtagtttttctttccttgtgatgtaatttatt

SEQ ID NO: 1406 - DNA, 1949 bp, Homo sapiens
cacctaggtgtatacgcctataacatgttactccttcacggttttttgcagtgcagtgctgtacccacttattctggaggtaaaagataattttgttcatgataggactgtggttagctgtctttcgttttttaactgttttcttttttttttgttttgtttttgtctttagaaaagacaaaactataaaaagaggcacaaagaactgaatacaactatttggacatatcccaaatgcagtttatatgactctaagttagtagtggaaatctcttattgctgactatacatttcagatatgtcagatgtgtaatccagagagtaaattcactcactgtattttcagtgatattttaaaattcatttatcagtaggatcattctgttctagacaagttggctatattataaaacattaagcaagcaggcactaagttaaatattgtagcagttgaaatttaatgctaatcttacagttttacacagttaacaatctaggccaaatctattgatacctttggaactaccctttaaattccatcctatgcttgtgaaaaggttgcatataatttcttttcctttttctctcttctcttcctcttcttttttctttttctttttctatttcccttttcttcctttttctttcacagagtcttgctatatcacccacgctgttctccacctcctgggctcaagctatcctcccacttcagcctcctgagtagctgggactacaggcgtgtgccaccacagttaattcataatttcattaatagatttcagattcagtcattgaacagatgtttaagtaaccccaaattaggctctttgatggatactgagatgtgaaggtgtagtttctgcttaaaggaatttatagtctagcagtttattttgtttgccacagcctgtcatgtgttttataaatcagtgttgtattttcatgatagagtgaaaatagaatgatactcattttttaagtaaaataaattgtgaacatttcacattctcttagttggtgaacagctattttggtggtcttgttttctaacagcttatgagtattagaccaaatcagtttcccagttgtttaaaatagagttaaataagaattgtttgctttactgcctgttttacttcagtccaagacttattttttgtaaatagcttttctgcatatgtatacatacacacacacacacacacacacacacacacatatgcatgtatatacacacgttgtagggaagttgtttcctggttcagctagcaatttcaattctctgtttaacgtcagaagttgttttgtagaatgggatgttaatatttttttctacactgattaaaatcatcctttgccactaaagtcaagtatctgctaggacagaaatgtgcaaatagcatgcgtaaatgtgcatttttagtgactgttgttagcttgacagttttattttcaagatcctcttctctcccgacctaattaattatgatgtgtttataaggcaacaataatatatttagttagtttgcaaaatgagaacaatttttctggtttttccatttttgcatgttttgagtttggattaattggacttgtattattctcagtagacatatataataaaatagtccatttaactgtgattctttctcttggaacattggctgacttttagatagtgagccttgtgcagtttcataaatacaggtactactgagttttggatgacattctttacacaacctaaaagtaaaggtgagcataatagaagctggaaacaagctgctgggcataatagaagctggtaacaagtctgacgttttctttgcactaggaaatgtatttcttattccaagtaatatgcccttgttaggttcaggatctttttcagtggttataactgcttaaacatttttttttctgtttaaagtaattcatgttatact

SEQ ID NO: 1407 - DNA, 1027 bp, Homo sapiens
ctaaagtgggaagcagatcatcatgtttgaggaagaacaaaaagacccttgtcatcacaaggctaggaaaagcctggtagatgaggttgatagggaacagctcactggatatcattatttctctttatgggtaaatatatgcaacttgtgaatttgaagatggtgttactaataatactcatttaaatctgtagggtaaccagtagtttttctagacatacagaatcactaattcctggtccataaattatgtttttcccagggatctgcagagataggaaggaattatgattagtattacaaaaagtcaaatgaaaattgtgcatttaccctaaatagacttatacagataaaatattatgtatcttttctttgaccagtgattatattgactcaaatcattatcatacattgtagcgatttgcagattgttaaggaaataaaatattgtacttatcccttcaagatcctagcactgggttttgttagtttttaagtctttggcaatttgagaattttgattagcttttacttatgtgattaataagatgtcattgcagttggtagacaaagatctttaaacacgtgaaatccatggaatagaataaagtttttttatagaaaggttgggagccattgattaatgtcctatctgtaatggacctacagggagaagggaactcatatgtttttgagtgtagaccccttacatcctatttaatttgcacagtaaatctacaaagtagatattgttattgtccagtttttttacaggtgatgaaactcaaagtaattatgtaatttgtgaaaatttacacagctctaattatagagaatcacgtgggtagtaaacttccagaagaagggacttttgcaatacaaagcagaaaataggtgatcaatacatatttgtatcttgcttaaatgtaaacatgaatgaatgagtaaatgacaggagactgcctctgtccctatactgttttcagtgagtcacaccatttttctcctaaatgagtctagaaaattt

SEQ ID NO: 1408 - DNA, 1048 bp, Homo sapiens
cccaaccaagaaatgtaaatctttgaattcattaaaggaaaggggtgagttgactgggaatttctagatttctaggctcttatattatttctattacttcagtacataattttttaaatctctcaggccaaattaaaatatatttcctgtctagatttcatatttccatggagtggtgtgatgatgtaagtgtgcttcatttaataaaagctactccggtatacctcataaccttgcagaaatactgattttatgggtctgtgatagggctagggtgctgtattttactcctgtgatcctcagatgattctgatgagatgctttttcaatttatttatctccatattttcattttagtgttatttttaaaaaatggtttgtattatatttttaaagccataggaataaagaagtacattttatagttaataatgaaaattaatgatatatcttagctttccatggttatgttttgttttactttttcaattagttaaatgtacatagattacttaagtcaaactcaagtaataccaagttcactgtagaaaaaaataaagtaccaattagacattatttctcagcctttttagatatttttctaattgtccccctcatgaaattttaatgccacagatataactgtatatttgtttatgtattgtatgtatatctgtgttttatgcactaaaagaataagaattatttttttgcccctcaagagccaattttcaccccattggtggtgatactgctcctgttgagaatgcatgcaataagccaaaagaaaaatcacctttaattttaccttacaacttgttaacattttggtgtacatctttctcagtgatgttcaatgcatatatgccttttctttgatgaaaatgaaatcagatacataatacttcatgctcctgtttttcttaatattttgtgaattttcatgataaatgagtatcttttaacagtaccccatctctaatggataaatactatagatgtatagtagtatgtgaatttgccatcatttgtttaaatgatttgtcta

SEQ ID NO: 1409 - DNA, 1136 bp, Homo sapiens
tttaaataagaaagaataatatgtgacataggccatatgtggctcacaaagcataaaacatttaccatctagctcttcatagataaagtttgctgactatggattagaagaatatatatcatataaaatataaacagagaccttagggaaacgcaaatcaaaaccataatgagatattatttcatacacactaggaaggctgtaatttaggggaaaaaaggacaataacaagtgttggccaggatgtagagagattggaactctcatacattgctgatgagaatgtaaaatggtacagccactgtggaaaacagtttggcagttcctgagaaagttaaacatatgctaaagagatgcaatgaaaaagaataaataaataaaaataaaagaaaaatatagagttatcttacgacccagcagttttgctgctaggtatatacccaagagaattggaaacgtatgtgtacactaaaacttgtgcaagactgttcattacaataaacaaaaagtggaaagaacccaaatgtccatcaactgataaataaacaaaatgtgatatagccatacaatggaatatgatttagccataaaaaggaatgaaatactgacacaacttcaacatcgatgaaccttggaagcatgctaagcacaaaagccagacacaaaaggccacaagttgtatgattccatctatgtgaaatgtatagaaaaagcaaatctttagagacagtaagtagattagtggttgccagagactgtagggagggcaaatggggagtaactgttcatggatatgtttttttttgggaggggtgatgaaaatattcagaaattagatagtgatggtggttataacagccttgtgaatataatttttaaatccactgaattgtgtacttgaaaatggtgggccaggcgcggtggctcacgcctgtaatcccagcactttgggaggctgaggcgggcggatcacctgaggttgggagtttgagaccagcctgatcaacatggagaaacccccgtctctactaaaaatacaaaagattagctgggcgtggtggcacatgcctgtaatcccagctacgtgggaggctgaggcaggagaatccttgaaccgggaaggcggaggttgcagt

SEQ ID NO: 1410 - DNA, 1046 bp, Homo sapiens
cggaatctcgctctgtcgcccaggctggagtgcagtggcgcaatctcactgcttgctcactgcaagctccgtctcctgggttcacagcattctcccgcctcagcctcccgagtagctgggaccacaggcgcccaccaccacgcctggctaatttttttgtttgtttttttgttttttgtatttttagtagagacggggtttcaccattcacaggatggtctcgatctcctgaccttgtgatccgcccacctcggcctcccaaagtgctgggattacaggctgagccaccgcgcccggcctcctaatctctgattaattaatgttccatgtgagaatataagacaaagaaaaaaatgacaactggataaaagtgtattatataaataaagattcattgcagcattatctgtaataatagaaaacactttgacatgcccagcaagaaggatagttaaattactgtacatttattgcaatatctgttaaaatagttatgaaaaacttcagtgaccttggagggagatgaagtaatatcggcgggggtgggggttggtagtaataaaaaacaagactcagaattgcaacaccttaacctctaatgtcaagcagtaaacctagtcttgagaacagttcattctggacaaatacttactgagttgctcttaaatgtttgattaataagtatctactataaaaataaataaggcaaaaccctttttgaaaccacattcccctttcccttgtagtagtgaccacctgatttttctattcctccttaaagcaaactcctcaaaaaaattgtccataatgccatctcccaatttcttgcctcccaatctttcctgaacccagttgtgcttttgtcctgggttattacactgaaattggtttatccagtctccagtgacctccagtggtcaagttctcagtcgcatcttaatttacatgtcagcatttgataattgatcaattcttcctctttgaaatattttcttctctttatcccaagaaactatatacatggttcccccccgccactgcctcac

SEQ ID NO: 1411 - DNA, 1348 bp, Homo sapiens
atcttggttagtgttctctgaacttcctgggtctgtggtttggtgtctatcctctctttattttttagcagtcttttttttctcccaacttgtctcttcgtttggccctgtcttcaaaatgtatgtggaagttaaccaattcttactacctgcactgctactcctttggtcaacattcctatctcttgcattatttcagttgccttccagttcttcctgattctgcccttgaccttctcttttacaaccagagagaccttttaaaaatttcagtggaaacttgacatcctctgctcaaaactgtccagtggcttcccacgcataccaagtaaaagctgaagtccttaccgtggcctaaaagcctgtatttagctctctatttaatatcttaccttctcttctcctaatgacttcctcattgtcctccaattatagtgccctacttgttccttatcgaagtcaccaggcatctcaaggcttttctgcttccctcagatgtctgcccaactctgtcctctaactgcccatcatctttagttgtttactcaaacatcactcttctagattataaacctacatgccatatggactacgatctccccattgctttttgttttctggaacactttaccagctgacttgtttctggcaggagagtgcatgatgcattggagaagatgtaagaaagccagttggctggagtgttgagaatgaagggagcactgttgtgaaataaagccagaatgggagttagggacccaactgtgcagacccttgtaagccatgttaacatctttggtctttatctttaagggaaatgggaaatcactgaagtatctgaactggagggattcggaggaggtcactaagtgattaaatttgtcattttacaaagttcattttagcttcattatgaatatattggagggggaaaagattggatgtagggagatcagatgagaggctattatagggatccaggtgtaagctgatggtagcttatttagtctgttatggttgatggccatacaaaaagaatgattctctgaagtaatgtatttatatacatctgtggtcagcaattcataactcctgattgccaggttaagatttccaatttaggggccgggcacagtggctcatgcctgtaatcccagcactttgggaggctgaggcggggggatcatgaggtcaggagttcgagaccagcctgaccaacatggtgaaaccctgtctcaactaaaaatacaaaaattagccgggcgtggtggcgcatgcctgtaatcccagctactcaggaggttgaggcaggagaatcacttgaaccctggaggcggagcttgcagtg

SEQ ID NO: 1412 - DNA, 1029 bp, Homo sapiens
atctctcatgaaggcagggctttaactaatttccttgtttttcccaaccttctctcatctgaaaaaattaacttgattggccgggtgtggtggctcacgcctgtaatcccagcactttgggaggccgaggcgggcagatcatgaggtcaggagattgagaccatcctggctaacatggtgaaaccccgtctctactaaaaatacaaaaaattagccgggcgtgatggcaggtgcctgtagtcccagctactcgggaggctgaggcaagagaatggcgtgaatccgggaggcggagcttgcagtgagcagaggtagcaccatcgtattcaggcttgggcgaaagagcgagactccatctcaaaaaaaaaaaaaaaaaaaaaaaattaacttgatcagggctaagattgttcctcaatcagatgttttcaaaacaaaggtgtctagggggtgttatttctcttcacaaaattaatagctctgggaacaaaaaatttgtgtagaactgtagcacttacgaggataggaaactcataacactctggccatactaagagagatttgatgctcttatatgagcaaacagatttaataaacagcgattctaatagttttctaatgtggcagtgtttttatcaactaaaacattgattctcttcactttagtttgggaaggaaaaaagcattaagcttctgtacctaaaatatgttattaaatatgttgtttacttaacagaaaccagtgaggtatcttagtccagctttgttgtgtaaataaagaagttgaatattaatgaggataaatgacttgtcttggctcacacaacttatagatcctgattttggacccagatattcctgcaaaagtctctttggttttgttgttgttgttgttgtgtttttgacacagtcttgctctgtcgccaggctggagcaagtggcatgatcttggctcactgtaacctccgactccctgattctagtgattctcctgcctcagcctcctgagtagctgggattacaggcacgagc

SEQ ID NO: 1413 - DNA, 1046 bp, Homo sapiens
tgagaatcctctctctttgtcccttctctggcccccactgctatactcacccactaggtaacaatgtttcaatgaatccagcctccttacagcttctcatacactttagacatgtttccctttggggcctttgcatttgctctttcctgtgcttggggtagtcttcctccacataaccatagagcttattccctcacctccctcacatggttgctcaaatgttacccgtgaggccttccctgagcatagtcttttaaaatataactttatattcctaccctcaaaataaactcccaacctttacttttctctataacatttattaccatcttgcatacttgatttttgtctgtctccatgtatactcctccagggcagaaatttttgcctctcatgatcactaacatatccatagggctacaactatgtcagtggatatttgttgtgaatggatgaaacttgtagaatgtccttaagaaggaggttggcattctcaataggagggaacaccaaccacagcagttctgtaaggacttttcttaaactggattttcagaactcaggttgcctgtatgtttattcttttgatttaataagaagcagagaccatgatctctagagaacatcatagaaatagtgttgctagtatttgtagcacttaacatttgtaagtaaactcatttattatataaacatttggacagtggcagaatttaattggttaccatagtggtgcaattctggaatatgcaaactttatcaatgaaaaatccaggaaacttccagtttttacatctttcccagaaaatacactggcagcagtataggaagctcagccatgttcctgtggcacaccttagacgaatttgaagctggggaaatggctgagtggtagcatagctaactccctggaatacaagaaagagtacatcagccagggtagaacaaccagaactattttagatgtagtagacaaaatagaggtagtggtcatggggaacaaggaagccaaggcacaacaagcttaagaaactttgtggatttat

SEQ ID NO: 1414 - DNA, 1006 bp, Homo sapiens
atgcatttcagttggtggcagataattgcttatttatttttttaaaaggctaagtaatgagtatgttattgttcattttacgtttttttcttcccacaggttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgaggtaacctacaactgctgggcagcacaaacaagtgcctttttagtttgctttaagttaacagccagacttttaagaaaaaatttttatcttttaagcaatcttgattccataattttataggaaacactaagtaattcctggaaactatattttttagcttgcataaggtcactttgatggctgtatgaggatacttaaatttaccttattgtaaaagaggaagctaaaattgaagaatgtgtgtaaaatcctgctaagcctctaagtgatatgcgataaagtggtgtgtaaaaattgttacatcaccttatattgtaataattatttacccaaatgtatataaataggttgtaaagtcaagttggaaaataatatgtttttatggatatcacagaattgtgttctgagtcttacctcacctttggtgcatgactcataagtgggtaatctgtgtgggtatggacatgtacctggaattcactcagtcctttaggcctgatacagctgatgcacaaggcttttgtgtggggcatgggggtggggtcactgggttaagcactccactatcttgaaaacagctgtggacaagaatacttagcaaataagctgcatgcctgggtgtaaagggccaacagtttactagtttactgggcccctaaaaatttagagcaatttccaactgtccccaccagtcaaccttaaatagttcccttgcttttgttaaccttaacataagccttttaaaaaaataaaaacaacagag

SEQ ID NO: 1415 - DNA, 1052 bp, Homo sapiens
tgattagaatcctaaaaattgatgacacagtctgtgtttggtatatattcagattttaccagttgtccctgtaatgctccttaaagccagtccattttttaatatactgcaaagaattatttattccagattagtatcaataagggacttctgtgatatttgtttttattccaaatcattagtaagtgttgtatttcatagcaaagcttatctgtttcatgttttaatactttggcatcagaattaaaatagtctgcttttatgagataagtagcattgtatttttgtctttgatactttgcacttttcatccaaaaatgaatccacaagatgtattaacaaacattatttgggctgggcacagtggctcacacctaaaatcttagcactttgggaggctgaggcagccagatcacttgacctcagatgtttgagaccagcctggacaacattgcaaaacccttgtctgtacgaaaaatacaaaaattagctgggtgtcgtggtgcacgctgtagctcccagccgttcgggaggctgagatggaaggatcacttgagcctgggaagtggaagttgcagtgagctgattgcaccactgcactccagcctgcgtgacagagcaagactctgtctcaaaacaaaacaaacaaactaaaaaccacaaatatttgttatttcaaatcaaggattagcagactttttctactttttacgtttaaccaaaattaacatcaaaaaaaggcaaacaaaaatcatgcgcctccgcatgtgataccttgaaagggagacagtatctcttttgtcctattttagacaaaaatgtatataacctgaatctaatcacgagaaaacctcagataaacccaaatcaagggaagttactagcctttatttttcagaaatgacaatgtcctgaaaggcaaaggccaaagaactgttccagatttttaaaaactaaagtgagaggaaataaactgcaatgtgtgatcctgaatggatcctgtccttggaggggaaagttactataaagtacattattggggcagttgacaa

SEQ ID NO: 1416 - DNA, 1045 bp, Homo sapiens
agtcatggggcaatatttgtaaatttgtaaccatttatgttatatttcatagagcacaacatttggctgatatcctttcttctaaaggctttcctgctgagtgcatttcaggtaagttcatctcttactttaatctttatttagtatactgacttgaagcctccaaagtcaggaggaaaaaataccactttatgagttgtcttgagagtgtgaaattatcttgtatcttttagagtaaaggaattttcaggcttatttttcattggaatttgatatgtcaatattctatttttaaggagtaacttggtatatagtaaaaagttagaaaacgagtgttcagaaagacaattttattagaatctctcttatagccacatataacttaattctataaaaccaagtttgtctgtattgtgttaagataaaaatattttttctttagaatttttttttttaataattgttaaaatgctggagattgctaactgaattgactgttttatggttttgtggaaggcaaaagtgattgagttcttgctgcaaagttaaatgattactgctggcataataagaatgaaagagtcgaaggattttttgatcagtgagatcctttttagagttttgtttggtgtcagcttaatttttaacctgttggcatgagcttgtttagttatggtatatcacgagatactggggagactattttctaatgaaccaatacttaaactatagatcacactttaacaccaaattataaacagctgattaaagcatttttattttcctaagaattgctagttatacttcatatgtaactttgcaaatagaatgttatatattcaggcatggcctgatcactatttaggattgatttttgaatttcaagttgattgcctaaaccatagtttaaaagattttaactttggatcttaacctagatttgcacagaaggacagaattaactgtggttggtgtattaaaagtgttaagactgggtgttatgctttttactttttgtggattggataaatatgtattagcttag

SEQ ID NO: 1417 - DNA, 1042 bp, Homo sapiens
acaaggggggatattttacctcttaaattgttgtgaaggtaattcttgccatattctcctttgtcaccatgtggaaagaacagcatctttaatttgaatactattttgaaaaattggagtgaaatgttttcttttgatttcagttcagtcatttgttctgcttctttttaagtgccctcttggaaacaacgcatgtttaaaactagtaatgatctcttaaaaacaaaaaattctaaaaaacccttgagtggaaatatggcatttttgacgtgcatgttatacagaaaatgtgcactataaatagtgtctattcatatatagatgtatgtctatatagaaaaatacacatataggtcacgcctgtaatgccagcactttgggaggctgaggcgggcggatgacgaggtcaggagatcaagaccatcctggctaacacagtgaaaccctgtctctactaaaaaaaaatacagaaaattagccgggcatggtggtgggtgtctgtagtcccagctacttggaaggctgaggccggagaatggcatgaacctgggaggtggagcttgcagtgagccaagatccgccattgcactccagcctgggcgaaagtgcgagactcagtctcaaaaaaaaaaaagaaaaatacacatatagtatatacatgactttgcagaatataggatatgtagttattgaataaatataattgagtattttaccgactttatatttaattattttacagagctagattaagcacagatctgggagttctatgtattctagtagatcgggttagtaataactcattttatgatcttttacaaatctctgtaattgctgtaagcttagagtcctgatttgcaaagtactttagagtaaatggtctttaggctctatgtcagttctaaaactgtcagttctttctgtgtataagtctattcgtagtctgatatgggaaaaaaattgaaaattggtagaagagggttaagacttcttgtaggattcaatatcatagcatctagtgataaaaattgcctttgga

SEQ ID NO: 1418 - DNA, 1030 bp, Homo sapiens
aggaagtgtttgaagaaaattcagggtcagtcatctaggtttatgattaatctagtcctatgtcctttggtaactctctaaccccttttttatagtgtcctccccgcccccaggaaacattcatgtatattttgattggttttacgatcatctatcaaaatttagaggatgaaaagtaagaacaatttttaaatctcagagataagagtaaataaaggcaaggtattctagctattcatgtttaccaaaaagtgcctcttctagtgtgctcctaaaggttttgtcaagtggtcttcatttcagcaggtgcaaagtgttgattttgacctcatgttaatgtcgttgaatccccagtaatcatctattgctagcgcttttatatattaaaatttaccatgtttttagcatagtttcttttgcttccaatctcaagtctacctcccctctgtcagctatagccaaagctgatggcaataaaatgcaaggagttggaatcacggagggtgattgtaatgactgttgtcttttaccttcttgattagactttctgaaggtagacttcctaaagataattacttttgaatagttaggtttgaagttttcagagccactcggtgctcacaggtcttctcagtgattgtttccaaatctccagtaagaaagtacaaagaagaaactggagggtgtctctagcaaacgcaatgtgtgctgcaatagaagggtaagacgtgagctcccagcaataacagcagaaaaaactaaaagcagaacagaaaatcccaaaaagataagttgtattatatcaacagagaacagaaaataaactaaggtaagagactaagcaaaccaaagttgtgattgccgaggtttaataggaaaaagcaaataatattcttttattatttagcacagtaagcaagatctgtttgttacacttttgggtcttgaaaatctttcctttaaccttttcaacacctgtttggtcatgctaggtgaagaaaagcatagtatgcagaggatagatgtctga

SEQ ID NO: 1419 - DNA, 1089 bp, Homo sapiens
caaaaaaaaaaaaaaaaaaaaaaaaggattacatgaatatacacacatacacgtgcacatatcacaaagcaaggtacccaggatataagaagcacttagtaattgacaggtattattattagcacttggcatgtgagttaaagaatttaatattcaacattattttaccccttcagcattttagcaaaggtgaagacttagtgttggattttagttattgattggttttgttttaaatttttcaacatatgactaagtcctgaatagagggaaacaaagcttgtttgcatatgtcatgatctcaagcatctgagccaaagatttttaggagagtgtgtatctgtcttggagtgtgtgtatttaataattttgtcatgcagattatctttcttgagttttttggtccaaggaaaaaagaaaggcaagggattcagctagccgatgtcttctttctgaattgtcagttgctccactctaagctctactatctttaagtagcatcatcctgaatgtcatataaatggttttgtagatactgtgattaccgtgcagagttataccttctgtgaaatttaagggacttttaatggtaattttgattaaaagtggtttttaccttacttttgaagacagcctcccccactgtcctcaaagtaaggagcgatgataggaacaaccaaaactggagtgagaagaaaacatggataggggagttgagtagaggtgggggaacatgaaaggcgggagtttgtgggttgaagaaaacaagactacaaagaggcattgaactagataatgcaatgcgctgtaatatggctcatctttgccagttatttccaaactctgcatttcaggtacagagccagaacttccaatctaaatgtgtcatttgctgtttaatgaatcctttctgacttctggagccacaaagaatatagttctcaattgttactgaatttaaagaatgcaacccttaattgttactgagtttaatagaaacaagaaaggaaaataggaaagcacaggatgatggggtgggtctacagacaaagactcctgaccgtgagcttcgggagcatctgcgtagat

SEQ ID NO: 1420 - DNA, 1042 bp, Homo sapiens
cattattactattattgtttaaattcttcttagaaaactgctatagaactctgaagtggtggtgattattgctgatagtatatcataattaatttctctattaagcatagatccagataatctggtaacctggaatctgctttaatgtaaatagagcactatgtatttgaatagagtactacagtgttataaatgttgaccctaaaaaatactagcttaattatagagctgatctcttgaggcctgcttcaaagtctatgttggcagtattgaataaacaagcatcttgatcccttggcaccattgtaatttctttgtaagtgcactattcatattatatttcaggataactcaaaacatctttcctcgtgggatcctgaaattgattttctctaaaaatgttcccaaaccattctgttttatataatgctgtctataatatggctgggaaaaaacagactgataaggcaaaataaggcattctgagaaatactgtgttgtagtgctgtcatggtaagaggaaggcttagatcccccttacctacaattcaattagatccagttgttctaatcatctgtcaaagtagtaagtggttaacatgttgtgtgagtttgctagggctgctataacaaagtaccacagatggggtggcttaaaaaatagaaatttattttttcacaattctggagcctagaagtctgagatcaatgtgtgggcaagattggtttcttctgaggcgtctctccttggcttataaagatggctgtcttcacattgtcttaactctgacccgtctatatctctatttcctcttcttataaaacaccagtcatattggattagagcccaccctaatgacctcattttaacttaattatctctttagagatcctgtttccaaaatcagtcacattttgaggtactggggcttaggacttcaacatatgaattttgggaggtacaagtcagcctgtgttatgtgtatttaacacatgtattatagtaatccaaatattccagtaatatctttcaccttcatct

SEQ ID NO: 1421 - DNA, 1112 bp, Homo sapiens
cacgctgccagcgcccattagatggatgggaaatgagtgtaactcattgggaaagatattagacttcaaatcacctaaggcaaaccctacttcctggggcgcgggcgcgggcgctggcgttaggagacgtcactcccgcgcataactgacatggggccctcttggtcggcgtttccgggcgggtccttccgacggccgccgcggtgattccatcactcggctttcttcccggcctgcctcgcgcccgtagccgggctgggccagaacagcccaagatggccgacttcgatgatcgtgtgtcggatgaggagaaggtaaggggtccgcctctctctcttacctcctcccccgacagggaactggggcccggcccggctgcgttgggagcctagcagtgtccccaggaaaaagaagcttcttggtccatgctgacatacgctctccgcagtcgggacgcttccctcttagggggctttcctctgcctcacggtggccccagttcctcgttcctcgactctccttttctctcaggcctgaggcacagcccaggggcctccctgcaagggaacagacgtttcctttattggatcgtgactgtggacttttttctgtaattttgcgagagggtggtggttatgttgcgacatatcaaaaagcagttattttaccgcctttagcagttggggctcaccccatccccccatttgtagatataattggggttagtttagggcgagtcacttcctggtcaggatggcctcttaacttcccttttgctcctccttcctcaggaagtgattttgctgtcacgactcttcgacaaggagaggtcccaaatgttgtccatctccctacacatgcactacttttctcctgtactgtcgcctgtctgattcgctataataaatctgtgagcctcagggcatttgcttcagaatttgaacaccagtctttccctatagacacatcccttttaacgataatttttgaaaattttgtttcttgttaacaaatctagaatagctgatggattttcttaacctccagaaaggttttctgtaacacataataaaccttatgttaacacgttcaagactgaacaaagcatcctg

SEQ ID NO: 1422 - DNA, 1043 bp, Homo sapiens
gtaggtcagtacatgtcacttttctgctcaaagccctccggtggcttcccatctttttctaagtccctatgttctgggatgttacctctttgccatttatctctgactttatctcctacatgttcttcttctggtctttgttccaatcacgtattctcgctgaataatctttgcatttgttcttttctctggagttcttttccttctgtatccctcatttcagatacttaaccagaagtcatctccttagtgaagctttctctggttattctgtccagttgcaaatcctaacatttcttgtcccttttctttgccttgttttttctccttagcatttatcacttgccaggtagtattttacttaatcttctctgttgtctttacccactagaatgtaaactccatgaggacagtatgctagtgagtcaccattgcctaaaacatagtgggtcttctgatatttgttgaatgcatgaatcttgcttggatagcatctgtcttgatttcattgttaactctcatagggcagtctgatttccaagttttgtgaggccatattgaggactccagtacttctgtattactgatagatttttattaatggagctttgtcctcagaaagctttagcaagtggccattgccaatgacatacggaatgaaaccagatttggtattaccatcattactgctatctgacttaccttagttcatccttctcttttattctctccaaatcctctgttctaccaaacaagagagtgttttcccactaccttttttgttcttattccctcactcatagtgccctccctttcctcccttccaccctatctaaagtactttgcagagcccagcttctccttttctctgtagttgtcctccaccaacccagctcaatatccaactccttactcttaagttctgtgccttatgttatctgtactactgctttggcagttttgctgcttagaattatagttgtttttaatttttttattttatttttgggacagggtctcactctgtcaccaagactggagtt

SEQ ID NO: 1423 - DNA, 1944 bp, Homo sapiens
caggcgtgagccaccacacctgcccgaaattttcaattttcagtagaaaattcttcttgaactttagctcagataaattcttaactaacaggccaggcgtggtggctcacacctggaatcccaacactttgggaggccaaagtgagcagatcgccttaggtcaggagttcgaaaccagcctgaccaacatggtgaaaccccgtctctactaaaaatacaaaaattagccaagcatggtggcaggtgcgtgtaatcccagctgctcgggaggctgaggccggagaatctcttgaactggggaagcggaggttggaatgacccaagattgcgccattgcactccagcctaggcgacaggagtgagacttcgtctcaaaaaaaaaaaaaggtgactagacttctgatacacagctttttaaaaaggttgtagaccccacattagattctccaaggttaagaatttcactcttactgactgaattgtgcccagctttcttgatatgatgttgtagaaacgcctgcaattcttaatctatgctcatattaaaggattcatttaaatacagaattaacactctttaactgtagctttctgtaaaccatgtttgtcatttgctataaagttccttgagactatatagcacacataattgtacacaaatctgtgaacattagcatctttttatttgcatgtttagaatttctactcatatagtacacctgaagactaattttacaaagcctgacatttaaaaattcaatctagaaatctgctaaaatttctcaaatttatcctccactgaacattgtaacatttttcctcctcagacgttcggctactacttaataatgacaatctcctcagggaaggggcagcacagtaagtatctttccaaatccacttagaatgttactctaacattggataaactatgttgacagtaaactagcaccctgaaaacaaagtttaaaatacttcaaagtaaagcagttggttttagcaattttcgttgttttttttaattggagaaaacatgttcccccaattgttgtttacttcctcaaagcttactataatatatgaactagtttttatttctgcccacatttgcccgattaaagcagagtttaatgttagctgttaggttttcctttatagttgttctagttcgtgttgaatttttttaaacagctagctatacataggaatgatctgccagtgaggaatgataatgtttaagaatagcaaatattaataaagtgccttaatagttaaaattaaccataagataaaagcatgattagcttacctagtcattgactccttaccactctgaagctaattaatctttctaaaatattttcattgtgtccttgccttcaaaaatattacggtggtgcctctttttttttttgatatcttctataataaaatctaaacttgctgtagctttcaaggctccctgttgtctggctttatcactactctacttttcaacacaaagttctgtttcagttgctgtctacccaactggctcagagttcctttgtaaagagttggataatggctagagtgggtagggatggggagacaggacaaggacatgttgatgcagagcaacaaataattatcataaagtcattgggtatgatatataattggtttagattttagccatagaaaacagttgtaagagctgctgcctgggaaacaataatctgccctgtccatgctgcttttttggaactcattttgggactagattctgcaaacgtagaatttgcacagctttactgtaattgtcatcgtgaatgataccctaattatacattgatttaaggaagctaggctcacatcggagatatactctaatgatggtttctcttagattcatagaatctgccatagaaaaggacattcatgatttgctagtttaactcctct

SEQ ID NO: 1424 - DNA, 1131 bp, Homo sapiens
atctcagctcactgcaacctccgcctctcaggttcaagcgattttcctgcctcagcctctctagtagttgggattacaggtgcccaccaccacacctggctaatttttgtatttttagtagagatggggtttcaccatgttggccgggctggtcttgaactcctgacctcaggtaatccccctgccacagcctctcaaagtgctggggttacaggcttgagccattgcacccagccccctaattattcttactctatactaagttctttttttcccctacctttgtaaatgtaggcattcccccaaagttcataattcatttaatgcaggtaaagtaacacagacttcggtgtcacaaaaacagtgggtttggattctacctttaccacttcctgagtgaccttaggcaagaagctttgtgaacttcaacttcttatctgtagataacactgtatttcatcagatttattagaggaaaaagaaaatacatgtaagaacatattttgtggactataaagcgctattttttttttcttactttcccttggtgattgcatttccattcacctctcccacactaaagaagagttagtgtttctaactactaactagacatctccatctgtaatttccagtttgttaatgacaccaccatctttttagtcactcttgagttccttctttcctttgcccatcatttgcaatatactgctagactttgattgtacttctacattctgtgtgcaactcttcctttccattcccattaatataactctgacttgttgcctagattaatcctgtggcctcctaaccaagcttcagcttttcttcgttttatcttgaataccagtattgattattctcccacaatattagttctagtcatgttttgctgtctctccattgcctatagaataaaatcttaaacttcttactttacatctactattacatgacctaaatctaccatcctgttttgtctttcattagtccacttcacacacaccctttaaacctgacagtcttgttcactgaacaagtccttagtttcctgtcttgcctttattttcagtctctgcttatcagaatctcatctgtcttgtatgacccagcctaaatggcacccgc

SEQ ID NO: 1425 - DNA, 1040 bp, Homo sapiens
tcattttagaaataatataggtgaacttcttgacctacttcagagattggagaggagctcattgaaaataatatatcctgtctatccttcacaggggactcaagcatatccattgactatagcattacttttctgttcacaaccagccccatttctgttcaagcaactcatcttcaattatctattgcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatctttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgt

SEQ ID NO: 1426 - DNA, 1260 bp, Homo sapiens
cacccttactgaggtctcctatgtgccaagcactgtgctaagtggttctctgccgtgtcaaaatctcatgtaaacctcacagcaaccctacgaggtaagtctcgctttcctccaattttatagaggaggaaagcgaggctctgagaggtgaggtcaactgagctgacctggctagagttgtcaagtgggccgcccccctctgcccctccctgcacatgttcttgcgtacctctcacatctgcttacacttcgcgctccctcttgtgcccaggtaatgcccactcatcctcaggactcagttcttatgctgcctcctgggaaggccttcatggacacctcctctgcccccagactgggctcagtgtccctctgtggcactgagcccctctgtggccgatgagctgccctccaagcaccacgctggaatgtatatgttcagtctgtgtgctcctcgaggcaagcgctgagtttctagcatctttgaacccctagcatccagcatagtgtctggcacataacaggcctccgtaagtgtttgttgaattgactgaactgaactccaggcactgagccttgaggttattgtccttctgaccagttttccctgtcttcaccttctctaggcacaaagccaggctatttgatctctggagaaggatcctttcccttcctgcttgggttccacctgcaccctatgacttcgggtggaaactgctgtctgatcagccaccttgcccacacacttggacatctgtactgtctctgatcccttctctcctcaccaacaggctggaccccacatccacccctctgaatcaaatcattccgcttccccttagcctcagctctttcttctgggttgtttgtattttcttttctgtcccaaacagtttcccccacaaaaagaactttatgtctttctctgtcttccctcagtccttccagtcagcagcctgtgattgggcttttcccctcagaaacgaacaatccagaacccactgtttaaaacaactgtattttgccttgggaagtcccattgccttccctgaaaacattaaacattcctccgatccccagcctgagtctctctgtctctgggccccatcctgctccacagcagggctggtgtgtccagcacagagtgaccctccgatgccctttcccacccgccgccctgcctccctcgagccctgccttccctcacttcccagtctcctctgcttctggcagctttgggacccccgcccctggcttctcctc

SEQ ID NO: 1427 - DNA, 1077 bp, Homo sapiens
actgcactccagcatgggtgacagagcaagatcttgtctctaaaaaagatgaacagaactatactgaaactaaagcagggttagggaatgggttggtgctgctttgcagaaggccagttagtcctggcctgtttgaggtagtgatgtttgaacagagaaggacatttgaatgaggtgagggtgggagtcatgagaggattggaggagaatgttctggccataagagccaccatgcaaatgcaagtcgggtgaggtgggggcaggggcatccaaggaagcaggagccaaggcttccttcttcagggcctctgactctcatccacttctgtatccctctagtcttctctgctttttgacgctagttccagagcttcaggtgggagaaggtggatactcctgggcataggggttgtctggcccatcctgttcctgcccccactcacccctcccaaccatcatttccagggcccagctggagacagccctgaagtggaggaactatgaggtgaagctgcggctgctgctgcacctggaggaactgcagatggagcatgatatccggcactatgacctggagtcggtgcccatgacctgggaccctgtggaccagaaccccaggctgctcacgctggaggtcagggctcagattgagtgtgaggagggtgggctcaagccagccaagctagaggctgtgggcagaactattcctgacagcagggcagaacaagaggaaagttgaagtggttcccagggctccgcaagaagcagggtgggcatcctgtgcccaaagatgtgttggagcagggaaatggggaagatctgggttctagtccaggctttgctaccaccttgggtaagtccctggctttctctaagccttagttcccttatctgaaaagcacagagctggactggataattcttagagctctttctggctcttggattttcaatgtgtgcatataagcccaaaattacacacgagaatggatttctacacacaattgcaggtgggaattagagggtgagtttgttcaaggaaagattactgcaggaagtgagttttgaacaagtttt

SEQ ID NO: 1428 - DNA, 1028 bp, Homo sapiens
tacacgcaaggagcgagtttaggagaggagatttcataggcaaaaaagggagaaaaggtctctcatgagagagtggggcgctcgaatgggaattccagcctggggcagagtgcacccgattttataggcaggcttaagaaggcagtgtctgatttacatagggtccaaagattggttggaccaggtgtgacgtttacataacacgccaggtaagctggcttctccaccctaatcttattatgcaaatagaatctttgcctggctggcaccatgttgcctgctccttactacacacgcggctagcaaagagaagggaagatggagccgccattttgaacatgcgtagtcccaggtgtagccttttcctattgccacaactgctggcgttcacccctgcaagcttccagcttgcttgtctatgtttgcagcttgattttacaggatgttctttgttacaaaagaaaattatctgggggctgtttttcattaaaaggaaaaccttaccaaggactcctgtagcttacctgcctaaataatttattcttaatgcctatatcactactaggtatattaccaaaataaaaccggtattcaaacaaacacttgtacagcagcactattcacagtagccaaaagttgcaaacaattcacatgtccatcaatggatgcatagataaacaaatatattatgcagctataaaagggaatgaagtactaataaatcccacaatgtggataaaccttaaaaatatataagtgaaagaagccagaaactaaaggttcaaaattgtatgtgcgataatttcgaggcatttgaaccagagcaactccatcttgaatagggactgggtaaaataaggctgaaacctactaggctacattcctgagatggttaagcattctaagtcataggatgagataggaggtcagcataagatacaggtcataaagaccttcctgataaaatagcttggagtaaagaagccagccaaaacccactaaaaccaagatggcccagagagtgacct

SEQ ID NO: 1429 - DNA, 1099 bp, Homo sapiens
atatgttaatgagttgactgatggttggggactcctggatagcttcaggattgagggctggtcacaggaaagaccaaaccttgatgagagagttgggacttgcaggcacacccctcaacctccacgaaggggaggaaggctgaaagttatgctgattaccaatgaccaatgatttaatgactcatgactacataaggaagctttcataaaaacgcaaaaggactgggtccagagagcttcgagttagtggaacacgtggaggcacctggagggtgtcatgccctgccagggcatggaagcttcatgctctttcccacataagcatttctttcatctggtgttcaacagtctcatttgtaatatcctttataataaaccagtaaatgtaagtaaagtgttttcctgagttctgtgagccactttagcaaattagttgaacccaaagagagggtagtgggaatcttgatttacagccagtcagttagaagcacaagtaaaacaacctggggcttatgattggcattggaactaggggcaagcttgtgggactgagccctcacctgtgggatctgacactatcgccaggtggatagtgtgacagttgagttgaatcagaggacacccaactggtgtccactgaagaatggattggttactgttggggagaaattcccacacacattttggttaccaagagtcacagaatggtgaatatactaaaaaccattgaaatgtacactttaggccgggcgcggtggctcctgcctgtaatcccagcactttgggaggtcgaggtgggtggatcacaaggtcaggagttcaagaccagcctggccaatatggtgaaacctcgtctctactaaaaatacaaaaaaattagccgggcatggtggcacatgactgtaatcccagctgcttgggaggctgaggcaggagaattgcttgaatccaggaggcagaggttgcagtgagctgagatcgcgccactgcactccagcctgcataacagggcaatattccgtctcaaaaaaaaaaaaagaaatgtacactttagctgggcatagtggcttacgcctgtaatcccagcactttggaaggc

SEQ ID NO: 1430 - DNA, 1050 bp, Homo sapiens
gagatgcactctaagctcctccctgacctcccccgtttctcttcagctctctttgctctgttttgacctatcacttatcttaccagcttgcaccagtttagtatcctaatcagttacttctctggcactctactgacatggcatggcgcagtcaaaatagtttgctagaaaacaaaatgtttgcaataaaaatgtcttcaacatgacaaataagtcaaaaattattgtttccaactgctggttttttgtatgtttagttattctggtggccagggatttgctttattgcttctttgggcctttgagaatttttttgtgcacacacagacacacacacacacacacatatatatatgtttcttaaggaatcatattgtacatactgtttctttccactaacacggaatctcactctgtctgccaggctggagtgcagtggcgagatctcagctcactgcaacctcggcctcccgggttcaagcgattctcctgcctcagcctcccaagtagctaggcttacaggggcgtgccaccatgcccgactgatttttgtatttttagtagagacagggtttcaccatgttggccaggctagtcttgaacccctgacctcagatccacccgcctcggcctcccaaattgctgggattacaggcgtgagccaccacgcctggccgctgtttactactttttaaatatttgcaggctgggcgtggcagctcacgcctgtaatcccagcactttggaaggctgaggcaggtggatcacgaggtcgggagtttcagaccagcctggccaaagtggtgaaaccccgtctctactaaaaatacaaaaattggtggcgggtgcctgtaatcccagctactcgggaggctgaggcagagaattgcttgaacccgggaggcagaggttgtagtgagctgagatggcgccactgcattccagcctgggcgacagcgagcctttgtctcaaaaaatatatatatatatatatttgcaatggcttgataatatgaaacatttacgttgcttcttaataattatctaaga

SEQ ID NO: 1431 - DNA, 1060 bp, Homo sapiens
tccccaaggaagagttgaatatcagaatgagggtcattttggcagtcccatccctgtatggagacagtcctttcgttgttacttttggcagatgaggatttgagtttaagagacctggttgggggggaggggggagggatagctttgggagatatacctaatgctaaatgacgagttaatgggtgcagcacaccagcatggcacatgtatacatatgtaaccaacctgcacattgtgcacatgtaccctaaaacttaaagtataataataataaaataaaaaaaaaagagagacctggtggatttccgtacaacttcataatttccccctatccaagacccatggttccatttttgtcaccgtggccacagtggctgaaatggctcacttcatcttttgcactaaacagccttcagccccacactgcaccgctaaatggacaagttcttttttccctagtgtcttaaattcatggcctcagtctgaggcctttagttttatactgctttgggagagtcctctttacagtcttagagatatacatatacctcttactgtttaccaccactaatttaatagcaagaaagaaactggaaatcttgtaggaatactctgttcctttttttgttttttgagacgaagtctcactcttgtcaccaggctggagtgcaatggcgcaatcttgggatcttggttcactgcaacctctgcctcccaggttcaagtaattctcctgcctcagcctccccagtaactgggattataggtgcctgccaacacgcctggctaatttttatatttttagtagagacgaggtttcaccatgttggccaggctggtctcgaacacctgaactcaggttatctgcctgcctcggcctcccagtgtgctgggattacaagtgtgagccactgcgcctggccaaggaacactctttgttctatgctacctactaggacagctagtctactcagttaccccaaaaccaaaaggatagtaactcaacaagctcagaatacaccattctgcttgcagccattgttttcaccactaccccatt

SEQ ID NO: 1432 - DNA, 1156 bp, Homo sapiens
agagatcgcagtgagctgagatggtgccactgcactccagcctgggtgacagagcgagactgtctcttaggaaaaaaaaaaaaaaaatcattggcttgtaagttaaaatctttatcttgctctaccttctctggaatacctacatctctgatgtttttttaacattacatattcacaagctttaccaattcatggaaaggattcctctaggattttggtggatctcttgaagcactaagaacctcaagcaaaaatgtatgcaatctttgtactttaaaattaaagcatttcaaccaggagcagtggctcatgcctgtagtcccagcgctttgggaggccaaggcaggatgattgcttgagccttggagtttgagactagtctggccaacatagccagaccccgtttctttaaaagaaaaaaaaaaacaattagctgcatgtggtggcacacatgtagtatcagctttgggaggcccagatgggaagattgcttgatctcaggaggttgaggctgcaatgagctatgatcatgccactgcactccagcctgggtgatagagcaagaccctgtctcaaaaaaaaatttttttaatagataaacattcaggcattccaaactcctaatgtattgtctactattaagaatgcatgctggctgaggcaggagttcaagaccagcctggccaacgtgatgaaaccccatatctactaaaatacaaaaattagctgggccaggtggtgggtacctgtaatcccagctactcaggaggctgaggcaggagaatgtcttgaacccgggaggcagagattgcagtgagccgagatctcgccactgcattccagcctgggcaacagagtaagactccatctccaaaaaaaaaaaaaaaaaaaaaaaaaagaatctctggaatttaacattcctttaaacttaaaaaataagaaaaaataaattaaaaaaaattagaagaatgcatgctggggtctgctcagtgattcacaaggcaggaaatctcttgagccaaggagtttgagaccaacctgggcaaagtggcaagaccctgtctctacaaaaaaattaaaaattagcagggcatggtggcacacttctgttgtcctagctacttgggaggctgaggcaggagagtcatttgggctc

SEQ ID NO: 1433 - DNA, 1805 bp, Homo sapiens
ttgcctacttctttcaaagagattgcaaaacgattttaactcactaaagaacatttttcacctcttgattgtccagtacaagtgtagtacagttctttttttatgtatcctccctttgtttttatagactggaaggtatccagaaataaggcattcagaaatggaggcacacatagatgaaggcaaaggccattcctatgaaggcaggtctgtaggcagctggttatttgtttttctcagcctctcttggcattctaccttcatctggaaaaaaatttaaaaaggaggatactttataggtcctgtctcaagtatctgacttccctgggaagcttgattctcacattcaaaatacatggggagtttggttcagttaaattttatcacaccagaattgttgaaaagcaataaattattactgtataattggtgcctgtttgttatcttaggtattgttatttctgtttttaacttgtttggaaaaccatagaccataaacttttctgaacgttcgatgcagagctccaaccgaactagcaaagaacatttcctcaaagaaacggagtatttttttctgtaacaatgtaactttctgtctttcattcttcaaaatgtatcactataaatttcctacaaaaagagctatttcttctctcagtatcatacagattgatttgtatagatgtatatgtatggctgttaaattgtttgttggtataaaatggtgagtgtcagtataataatgatgataataaatagcggctaacatttaaagcgcatactctgttccaggcaccgttgtaagcattttacatcgagttgctcaatctaaaaccacttttatctggttgtctttatttatctagcaaaacttttaagaatctatgctgcaataaattccacaactcagccttcatcttcccaacaaaaataactagaattccagtgttttctctttatcagtttgtcttcaggaaaccgtcaacattttagaaccatgctagtccccaggacttgatctgaatatacaataggtagctgcattgcctatcttaggacatagaccagtaaacaaaatcaaaggtaactttgcacttagtataagcccttgatgttagcttcactgaagtaggagaggcaataaaaatgttgacttgaagtctgctctacctttcaccatctttcagaaaaatgttgatcaggactagcctcctcagcaaatgtaggcatatataaaaatatatttcttcatcctttatgatgtaataaagactaatggcttagacttagaaatctaacaaagtgacaatagtttttttctcccaattcagacctatttctgttcttaaaaagacatttaagccaggcacagtggctcacgcctgtaatcccagcactttaggaggccgaggtgggcgaatcacaaggtcaggagttcgagaccagcctgggcaacatggtgaaaccccatctacagtgagccgagattgcaccactgtactccaacctggatgacagagtgagactccagctcaaagaaaaaaaaagacattaagtctcatacagttatgaaatttcacaattccagaaagctttagtaatcaaaatatagatttaagacacttattcagtcatttcacttaattcatccatctattcatttattcattcattccatctttattgaatacctactatgtgcagtgcagttactccaatcttatccaacattggactactaattagtaagatttttgtaattctgtttttaaattattcctttacatgggacaaaattcaaaagg

SEQ ID NO: 1434 - DNA, 1030 bp, Homo sapiens
gcaccactgcactccagcataggcaacagagtaagaccctgtctcaaaacaaaaagaaaaacagatttcaaaacactaaatagaaagtgatcacaatttttttaaaagaaatatgcataaaatgaacacaaaggcaatattagattataacaaaatcctttggtgataggattatagggggttatttatttccttctttgtctcttcatttggatctttaaaatgtcaacatggtgccatgactatctggagaaaaaaaggcagacattctatacagagagagagctattttattttaagcatctgtgatgagtgatggagcatttcacacacaacaaggatgaaaagagggagggtttgtcagatgaaatcatagaatattcaactggagggtgggttagaaataatttaattcaacttcctttgttttatatatgaaaagattcaagtttatccaaggccacacaggtaatgtttagaatccagaataacaattggattttctactttccaggatctttagctcatctttcttcctttctatttatgtataatgcaggagctggcaagtagagctcttttaagtctgaaaaaagagatagaaaatgtttaggataaagagaaagagaaaagctatatcttaaatagcatggtgacatggcttttcttttcttttttttttttggagacagggtctcgctctgtcgctcacgctggagtgcagtggcatgatcataccccactgtaacctcaaactcctaggctcaagcagttctcccacttcaaccttctgcggggctaggactacaggaagacaccaccatgcccagctaatttttaaaattttttgtagataaggggactcactatgtttcccaggcttgtcttgaactcataacctcaatgaatcttcttgcctcggcctcctgaaacattggaattgcaggcgggagccactctgcccacagcctcttcctatttttgaattggcatttgccaaaaaaaataaaataaaataaaatgaaaaaac

SEQ ID NO: 1435 - DNA, 1053 bp, Homo sapiens
actctggttgccaaggctggagtgcaaaggtgcgatcttggctcactgcaacctctgcctcccaggttcaagagattctcctgcctcagcctcccgagtcctgggattacaggcacacaccaccacgcctggctaatttttggatttatttagtagaaacgcggtttcaccatgttggccaggctggttctccaactcctgaccttaagtgacgcacctgcctcggcctcccaaagtgctgggatcacaggtgtgaaccaccacgcttggcctgttcaaccagttatttattgagctcctaccatgaggctgattctgtgctatccctggatataaaatggaaattgaaacagacctaaaccctgaccttggagttcagtctagtatataatagtctctacgaaattatacatataagtcaggaatcgtatcttattcatcagtacaatgaatatagtaggttttctttgaatatttgtagactaaatgaatggattttaccagacgttaccttgccataaactaagaaatagttactattactccagacatatatgtacttatggaggtttgagaaataatgtggactaagaagcccttatatagcctcacccaactttagcatgctccttccagagccaacccatcattcaaataatccaaaattctgtctaatatctggttatgaacagattcctgagacaaaacaaaatgtggccacctattaataaagcaaacagtcttggtgttcagacactgctgccgtttagttcagaacagattattgtcattattataattttgtttattaaaaagaaaactcttggcagccgagcgcggtggctcacgcctgtaatcccagcactttgggaggccaaggctggtggctcacgaggtcaggagatcgagaccatcctggctaacacggtgaaaccccgtctgtactaaaaataaaaaaaattagccggccttggtggtgggtgcctgtagtcccagctacttgggaggctgaggcaggagaatggcatgaacccaggaggcagagcttgcagt

SEQ ID NO: 1436 - DNA, 1115 bp, Homo sapiens
ggaggctgaggcaggagaatcacttgaactcaggaggtagaggttgcagagatggtgccactgtactccagcctgggtgacagagtgagactctgtctcaaaaaaataaaggaaaatgaaaaataaagtggtgcttacctaggacctccaaaagttagcctctattttgtcttccaaaggtaagagagtagattgtcctctgggctgatataaatggggaagacagtactgtatgtgaccttgtgttctgacatgattctggcatctgtgcagaatctttttggtagcatgtgctttgtcactttctagcaagcagggagactaggcaggcacctagggcctgagagtcaaccagtccacacgtttccaaaccatgagggtaggagaaaggggtcccaatattctcagcatttgggtagttactactccgagatgggttttaaagccagttaataaaaaggcaccatgccaccggaagagatatgtgagcttggatctcaaagggtatgtactctgaagctgaaatcataaaccagagcatctgatgtgtgtctcatacacaatgagggaggaaggactgctgacggaaatgtcacacgcagctgcttttagcacttggctctcactgatgaagcttccctctctgccactacacaccaccctcttcctacatgagagacctttagggctctttagttctcatcctgaaagctgtgggacagattataaattgatatcttttatatcagtatagctcatgcttggttgatgtgcctgatgggctataggagtgattgactcagctactattttggtgaggaaagagagtcttccttagaaagagaattgtgtgccttgccctaaaaaggttaggaatgcggcctatggtcctaattaagtgccctgttaaacagtgtcccttgaacaagtcactttcttcttctgcaacttctccagctatataattaagcatgtaatcctgtgtgacttcatagtagggttgtgaggacaggctattcccaccgtctggagttgtcttcccctcacttttccattgccaaataaatcgtccttatcttttggagttaagttgaaacatcaatttcttgagattg

SEQ ID NO: 1437 - DNA, 1515 bp, Homo sapiens
cagttttaagacacatcttggccgggcgcggtggctcacgtctgtaatcccagcactttgggaggtcaaggcacgtggatcacgacgtcaggaattcaagacaagcctggccaacatggtgaaacctcatctctactaaaaatacaaaaattagccaggcgtcgtggtgggcacctgtaatcccagctactcgggaggctgaggcaggagaatcgcttgaacctgggaggcagaggttgcagtgaccctagatcgcgccactgcactccagcctaggcaacagagcaagactgtctcaaaaaaaaaaaaaaaagacacatcttgatttctgagatattacaatataactatatatttcttgggacagataaaatgcagtattgttattttattaatacaaataaaggtatataataataaggccctgataacctcagctacacaggaactcacagatcattctttcttttccatctcattcttagcacgctaatccaacctttgcaatcttaaatctaggacaaagcaatagaaggatttgggctatggagaaaagagaactcattttggtgtctaaagacctggatctgactttcagccttgcaatacttttaggaggtgaaatcactactctgggggaaatatctgattcagaaggttttgggcgggggggatttaatgtatgcagaagcagtttgtaaactgtaaaatctctatacaagaggaagagaactggctgcactccagcctgggtgacagagtgagagttctgcctcaaaaaaaaaaaacaaaaaaaaaaagaactaatatttgttgagtgccaggaactgagctgggtatttgggcattatcttatttgatctgatgtaaatgctaaggcatatcatgtctggatagtcaccttgctagctaatccattctgtggtgggtttttttttcttcttcttcctgaaataaccctttcattcccttaaaccttaaagcagaaatcttctttagttactgttcctatcacaaaccagttgatgactatgagctcatcacaaagctgcagcctctcactcattgttgccttgtagtaagacacatgatgaaataagagacccttaggctaccagtgtgctgtgtagaatcttccctgtgattcttttgccagaactagcccctgggaccttggcagaaaatttttacttatactatgataaaaattccaaaaataggctgggcgcggtggctcacgcctataatctcagcactttgggaggctgaggcaggcagatccactagaggttaggagttcaagaccagcctgggcaacatggcgaaaccctgtctctactaaaaatacaaaaattagctgggtgtggtggcaggcgcttgtaatcccagctactcgggaggctgaggcaggagaatcacttgaatctgggaggcagaggctgcagtgagccaagattgcgctattgcactccagcctgggtgacagagtgagactccgtctcaaaaaaaaaaaaa

SEQ ID NO: 1438 - DNA, 1070 bp, Homo sapiens
accccactccaagtcttcaatcaatgtgttctaaaaggagagaaagcctaagagtatgagtcaactttattcctggtactgaactttgtttgttctcatgttagttgcccgaaggaacagggaagagaagcaaaagggaagtgattaacaggtcaacctatttgactaatttaagagatcaatttaaaagaaaatgataacatagcaaactcctcttatatgcacataaggcattactaagtatctattttatggtgcttgacatgttacaattgcctttttttcttcttttttttttgagacagagtcttactgtgttgcccagactggagtacagtggcgcgatctcggctcactgcagctaccgcctcctgggttcaagcgattcttgtacctcagcctcgcgagtagttgggactacaggcgaccgccacaacacctggctaatttttgttgtatttttagtagagataggatttcgccatgttgcccaggctggtcttgaactcctgacctcaagtgatctgcccacctcggcctcccaaagcattgggattacaggtgtgagccaccgtgcctggccacagttgccttttttaaccttgatgttggcttttttttttttttgagatggagtcttactctgttgcctgggctggagtgcagtggcgctatctcggctcactgcaaccctgcctccctggtttaagtgattctcctacctcagccctccagagtagctgggattacaggggcccgtcatcaaacctggctaatttttttttgcatttttaatagagacggggtttcaccatgttgcccaggctggtcttgaactcctagcctcaagtgatctgcccacctcggccttccaaagtgctgggattacaggtacgagccaccgcgccgggtcagatgttggtttcttaagcaaaaacagaatcaggatatcccaggaagtcaacagacatctatctggtggcctcctaggtgaaaatgctctccttcaacttagcaggtgtgagcattataactgtaacctgtcctttttttttttttttttttttttt

SEQ ID NO: 1439 - DNA, 1015 bp, Homo sapiens
ctacatcatcaagtgtttcatgtacatgccaatgttcaaaaactttttttaatcaattagtcaaactttgctaaagtggtagcttgtcactactgccggggtttgttgaagtgtgccactctgcatgccagctaataataataacaacaatagcagttaacctgtgaaaaccgtgaacagcaactcccctgagagccaatgacaactagagatatggcaaggagtcatgttggaagaatactcatccagacccttgctgaaatagacccagaaaacggctctgtggagttacacccagaatggagcctatggagaacacccatattcaacaacagtggctgactttcagcacgcagcagacagcctctgagagactttgttctgtgtctcacccttctcttatgcagtgaggaaagggagactctctaggccaggcagtaaccctgagagcttccctgacagaggattgctgagagactgagcagatgcaagaggaatgcctctgttcttccctcactgcctattttggccatctccctgcttttagactttgcagtggaggggccagaggcttgagccaagccaaagatacaggagaaggatctggaatccacctcagtgggtagggccaattaagacaagaggggtgtacacagagggaaatgttcagaaaacaaacctcttgcaagaatctggaggtataacagggccaagtcttcatactgagttggtgggggcttcactttaatatgtgaatgttggaaagaggtgggatatgaaaagaaatcacaataccttgatcaccagcttctaccagagggatcttgtctcttattgctgctgtgagtactttggggcctcatgagtgagcttggctgtctagaaccctagttggccttgagtgaagaaaatcagtaactgtagttagactcccctgatctgccctacccgtctgtcctagcatcatctagagaacactctaggaagaggctgtgggtataattgagtgtaccca

SEQ ID NO: 1440 - DNA, 1091 bp, Homo sapiens
cccctcaccatcagtcatctcactagcatacaaaacccatcactttggaaactgtaaggcttttttagaagttgtaggtcaagaaatggggttgaaaaccaaatatatgtattacaatatcacactccttttttatagctctcactagatgttaggtattgtgctaagcactgataaacttgcccaaagtcaaacacttggcaagtggtagaaccaggagttgaaccaggccaaagcttatgtatttgactaatgggctaaactgtctctgatggtttaacaaatacagcaaaacttgcagttccaaagtgttttgtgccttttaaaggaatagatttggaagaatatatatttattcttaagtttacttgaagctcttcttttggaattacctgagaaatccttgatatattttttgaacatccttaacaagggcaaatttttgttctttaagatttgatcttcttaattaccaaaagttgcttagtgacaaacacagtaaataagttggaaaatcacaatagatattttagtccatttttttgttgctgtaactgaatatctgagacttgagaattcatgaaggacagaggtttattttttacagtctggaggctgagcaatccaagagcatggtgccaacattcagtgaggcatctcggcatcatagcatggcggagggcatcaatcacatggtgagagggcaagagcatgcatgtcagctcaggcctctcttcctcttttttttttttttttttttaatctttccgagacagtgtctcactctgtcgcccaggctggagtgcagtggcgcgatctcagctcattgcaacctccacctcctgggttcaagcaattctcctgcctcagcttcccgagtagctgggattacaggcatgcaccaccacgcccggcttctttttttttttttttttttttttgagacagagtctcgctctgtcgccagcctggagtgcagtggcgcgatctcagctcactgcaacctctgcctcctgggttcaagcgattctcctgcctcagcctcccgagtagctgggattacaggcatgcaccacagtgcctggctaatt

SEQ ID NO: 1441 - DNA, 1177 bp, Homo sapiens
attcaaatcatagcaataggaaataccatctttggtggaaaaacatgtggcttagaaagcaagtctatggttttgatggaagtagcaaaatactttatcatcacaaagcggtatctattgttgccaactttactttcccatcacattagccttgtattagatgaagtaaagaaatatgagtttttaagtaaattaggttaaccagaaatgcattaaattgttgtaagtaaaaattaattaatggattaatataaacataaagaaaagtttccaaagaaggctttgtccttttaataattctgcaattgacatgaatgaagtcctagaaagtgtgttcatcaaacctaggaatcaaagttgggaataagtgattttaaaaaaacagagagagtttgaaaactaagtttaacaaagttaaatgtaagatcctgcacttcaaactaagaaaaaataactgcactagtacaagataaggaatatagcctaacagaagtacatgagaaaaatgcttctaagttttagtagatgagaacttaatcgatgttaatgacttccaagaaaaatattaagatattaggctgaattaaaggaagcatagactctagaacaaaggaggggacgcatccactctactctgctggttatttctagaaactacaatttaagaggaatacggtcaaataaaaatgtattcagaagagagtaatcacaattataaaagaatatgagaaatgttaaatagggagaagacgtgttgtttgaagattaaaaagaaaaaaaatactgctggtagggatggcattggcagggcactgtggctttatactgttaatcctagtactttgggaggccaaggtaggaggatcccttgaaaccagcctgagcaacatagcaagaccttgtgtctacatttttttttaagtttctttaaattgggggacatgatagatttcttttttttttttgagatggagtctcgctctgtcgcccaggctggagtgcagtggcacgatctctgctcactgcaacctccgcctcctgggttcaagcaattctctgcctcagcctcctgagtagctgggagtacaggcacccgccaccacgcccagctaatttttgtgtttttagtagagacggggtttcaccatcttggccaggctggtcttgaactcctgac

SEQ ID NO: 1442 - DNA, 1058 bp, Homo sapiens
atctcaaaaaaaaataataataatgataaacaaagctgttgtaagctaagaaaaggctgttgaaaagcaaatagtcatcttccatcctcttataagattttgaaattatttattattattattattattattttttgagacggagtctcgctctgtcgcccaagctggagtgcattggcgatctcagctcactgcaagctccgcctcccgggttcaggccattctcctgcctcagcctcccgagtagctgggactacaggcgccagccaccatatccggctaatttttcgtatttttagtagagacagggttacactgtgttagccaggatggtcttgttctcctgacctcatgatccgcccgtctcggcctcccaaagtgctgggattacaggtgtgagccaccgcgcccggcccccttataatattttaccaacgtagtaacagtcatatcccctatgtggttttaatgcacactaaaagaatagggggctgggcatgcctgtaatctcaacactttggaaggccgaggcgggcggatcacgaggtcaggagttccagaccagcctgggcaacatggtgaaaccccatttctactaaaaatacaagaattagccaggcgttgtggcgcatgcctgtaatcgcagctactcgggaggctgaggcaggagaatcacttgaacctgggaggtggaggttgcagtgagctgagatcgtgccactgcactccagcctggtcgagagagtgagactttgtctcaaaaaaaaaaaaaagaataccacttagcatgactactgctagaattagcctctctccttactctagtgtaggtggagaggtggagggttattggtttatgtcccttcagagttatcaccctagtacttggaaactgcatgctgttcccaggagcatcatatgctctcccccaaccatctgctccatcatgggtccccactcacttaattgcagatcactgccccaaactcctggacacactttcttttgtaggatattattccctgtgatgggtgtagcaaaagagtaaatgtgaggca

SEQ ID NO: 1443 - DNA, 2840 bp, Homo sapiens
gattagtcatactaatggatcaagttatggattttttgtacatccaagttttagagtatcagtgatggtcttgctaaatgacctttctgattgtcccaggaaagctatcaagatattacttccttcccagggggttgccttgtagaaaacctaatttataatctttttaccctacccacaggtctgacagtcctgccatttcctaacttctcctgtgtggtcatccacctacctttgggaacctccagtcattactcacagagttggtctcatcctgggaactctctcttgcctctcccagtggttcattctccaagtctgagttatttggtcaaaaaaacctccaaatgcttcagacaactctcgcaaacttgtcatagcttttggtattccaggccacagaagagcccaggtgggtacatgggccctccaagtgtttgtttcctcaccactgtgagtgacaaatatgcttctttatccttaaaattgtccagccagtaactgttggaacacactgacctagatccacacatgcaaacacacctttcaagggcaaatgttaattcacaaagacaattgtaaaatctaagctaaagttcacaaatgggagctgcctttgaagtgaattcagcccacagacatctttgattagcaccgtgtgttgttgttgttgctgttttaaattttttttttttttttttttttttgagacagcgttttgctcttgttgccaagactggagtgcaatggcgcgatcttggctcacaacaacctctgcctcctgggttcaagcaattctcctgcctcagcctcccgagtagctgggattacaggcatgtggcaccatgcctggctaattttgtatttttagtgcagacggggtttctccatgttggtcaggctgttctcgaactcctgacctcaggtgatccacccacctcggcctcccaaaatgctgggattacaggcatgagccaccaagcccagcccttaaaattatttttaatgtctttagaagaggcatgcaatttcggatgggtgcagcactcacgactgtaatcccagcactttgggaggccgaggtgggtggatcacctgaggtcaggagttggagaccagcctggccaacatggtgaaaccccatctctactaaaaatacaaaaattagctggccatggtggcgggcacctgtaatcccagctacttgggaggctgaggcaggagaattgcttgaacccaggaggcggaggttgcagtgagcctagatcacgccattgcactgaagcctgggcgacaagagcaagactccatcttaaaaaaaaaaaaaaaaaaagaggcatgcaatttccattccccaccccccacagtctctactcctccctattatatctaattgcttcacccatgtatagtatagcctgtcctctgaaataattggagtttaagatccctgaatctaaacctgtaagcaggaaaatagatattttcctaatgccctataatacataaacatgtttccattttctccttctgcttttatttttatttttatttttttgaaatggagtctcactctgttgcccaggctggagtgcagtggtgcaatttcggctcactgcaaccccacctcccgacttcaagccattcttctgcctcagcttcccgagtagctgggactacaggcacctgccacctagtagaggtagggtttcaccatgtttgccaggctggtctcaaactcccaacctcaggtgatccacccatctcggcctctgaaagtgttgggattacaggtgtgagccactgtgcctggcaagaaggaacatttatgggtgcttgggtgtagtagttaagagtggttccacagaggccgggcgcagtggctcacacctgtaatcccagcactttgggaggccaaggtaggcggatcgcctgaggttgggagttcgagaccagcctggacaacatggtgaaacatggcgaaaccccctctccactacaaatacaaaaacttagctgggcgtggtggcaggcgcctgtaatcccaactactcgggaggctgaggcaggagaatcacttgaacccaggaggtggaggttgcagtgagccgagattgtgctatatagcacttcagccggggcgaaaagagtgaaactccgtctcaaaataaataaataaacaaatatggaaagggggatggctagaatgaactctgcagtgctggatcagaattggaaatatcaatgggagcacatagttttataaatttgtgtgtgtgtgtgtgtgtgtgtgcgcgcgcgcatatgtgtgcatttgtgtattagtgtgatagtctgtcctctgaaagggcctacaagccatgatactccagtacaaattagtacacctagaacccagattgttctaaatacaattctccctaaaggaaccagggctttttttttttttttttttttttttttgagacaagagttttgctcttgtaacccaggctggagtgcaatgccacaatcttggctccttgcaacctccgcttccagagttcaagcaattctcctgcctcagcctcccaagtagctgggattacaggcgcctgcaaccacgccaggctaatttttgtatttttagtagagactggtttcaccatgttggccaggctggtctcaaactcctgatctcaggtgatccacccgcctcagcctcccaaagtgctgggattacaggcatcagccaccgtgcctggccttttttttttttttaagacggagtctcgctctgttgccaagctggagtgcagcagcgcgatcttggccactgcaacctccgcctccctggttca

SEQ ID NO: 1444 - DNA, 1973 bp, Homo sapiens
ctattaagggaaaagtaaaggccaggtgcagtggctcatgcctgtaatcccagcactttgagaggctgaagtaggcagatcacgaggtcaggagttcaagaccagcctggccaacatggtgaaacccccatctctactaaaaatacaaaaaaaattagctggtgtgatggtgggcgcctgtaatcccagctacctgggaggctgaggtgggagaattgcttgaacccgggaggcagaggttgcagtgagctgagatcgtgccactgcactcctgcctgggtgacagagcaagactctgtctcagaaaaaaaaaaaaaaaaggaaaaatagtccttttaaagtgaagaaacctggtagacatccccttaaccaagtaatcaaagttaacttcaacagtaatggaacaagtcaactaatattatgtaggggtcacaacatcacttctgtgctattcctgctaagaatgcataacctgaatgtaatcgtgaagaaacatcagacaacccaagttaggggacactctataaaacaactggcctgtaactcctcaaatatgtcaaggttgtgaaagacgaagtgtggaaaattctattccagattgaaggagactaaagacacttgacaactgaacacaatgtatgatatagaatttattttaccataatggacattattggaacatttgagcaaattcaaatgaggtctgtaggttagaaaatattattgaatcaatattgatttcttaatttttataattgtggttatgaaagagaatatccttgtttttagaaaatatacactggcggggcgtggtggctcactcctgtaatcccagcactttgggaggccgaggcgggcagatcacgaggtcaggagtttgagaccagcctggccaacatggtgaaaccctgtctctactaaaaatacaaaattagctgggcatggtggcatatgcatgtagtcccagctacctggaggctgaggcaggagaatagctggaatccaggaggcagaggttgcagtgagttgagatcacgccactgcactccagcctgggtgacagagcaaaactctgtctcaaaaaaaaaaaaaaaaacaaagaaaagaaaatatccactgaagtgcttaatggaaaggggcatcatgtctgtaagttattatcaaacagaaacaagttcagaaaaaaattatgcacatacacatgcacagaaatacagtgagagagagagagcaagtgtgcagtaggtattagcctaggttgctaggagaattaaagttaacaagcaattaattcatgactaacaccagaaacttggagaatatgcccaatgaccttttatcaagtgcccagtgccaatttatcacttaagatagcactccacatggcagaaagacttaaacgccagtaagtcactctgtatgtttgggacatctatagaacactttttttttttttttttgaaaactcctctagcaaaaaaatgtttaaactttcatcttcacgttgggtgattgcagtcataaatttcacacaatgatcctgcttgtatcatagaataacccattttctgatgaacaggttgaatccaaataaattccaaacacgtgtataatgtagagttaaaacattttagactcaaagctcaaagctaattaagaaccggcatgggccacagtttgaaccagcaccaacttgtctttgctctgttattggtttgctgtctttgcctgttattccatatcacttgctggaaggaagcagccatactgaaatacaaattttgtttgtttcttttttaaaaaaggaaacaaatagatggtttattctaagaatgtacaggaacttatattctaaacgtccataaatgcatattctagggactcttatcatctcagaaccctactacagattctctttaatctttttaaacatcctgttacataaattgcagctgtatctatagcaggaagaa

SEQ ID NO: 1445 - DNA, 1030 bp, Homo sapiens
aaaaggctgggtgcggtggctcacgcctgtaatcccagcactttgggaggccgaggtgggcggatcatgaggtcaggagatcgagaccaccctggctaacacggtgaaaccctgtctctactaaaaatacaaaaaattagccgggcatggtggcgagcacctgtagtcctagctactcgggaggctgaggcaggagaatggcgtgaacccgggaggcggagcttgcagtgagccgagatcacaccactgcattccagcctgggcgacagagcgagactctgtctcaaaaaaaaaaaaaaaaaaaaaagcaaaagaaccataagtatttgtggaggtctactgagttctaggtactgagtggggttagagaagtggaaaaaacagaccacaccgagactctcacgaaatttacattctagttgatgagatagatgtaaataaaaattcaggtcattttatgaggaaagtgaaatggagcaacactaaacagaataatgaggagaaaggcacacaacttctgaaggcactagccatgtgaagactgggagtataccattccaggcaggggaacagcaagcacaaagtccttgaggaagggatgggcttaaaaaaacaaggagggcagtgtacctagagcaaaatgtgaacaaaggcaagtagaggaaaggtagacagaaactagattatgtaaggtcttgaaattcttttatttactcacttacttttttagagatggggtctccctgtgtcacctgggctagggtacagtggctattcacaggagcaatcatagcacactgcagcctggaactctgaagctcaaacaatcctcacccctcagcttcccaatagctgagactacagactcacacaatgtgcttggcaaggccttttattctaaatgcagtggtgagatggacaagagatgtaccatccatatcctcctttaaggaaggacttgatgcccagatgtaaagagtgtagtcaccaaacagccctttcagaatctgccccagacacagagagcccc

SEQ ID NO: 1446 - DNA, 1030 bp, Homo sapiens
tttttttttttttttttgagacagagtttcactcttgttgctcaggctggagtgcaatggcatgatctcaatcttggctcaccgcaacctccgcctcccaggttcaagtgattctcctgcctcagcctccctagtagcctgcctagtaataggcatgtgccaccatgcccggctaattttgtatttttagtagagacagggtttctccatgttgatcaggctggtcttgaactcctgacctcaggtgatccactcaccttggcctcccaaagtgctgggattacaggcgtgagccaccgcgcccggctgccattgaaggatttttaagcaaagaattcaaatggcctgatttacattttagatcactctagctgctgtatagaggatggactgtgggaaataaaagtgaaaacaagaccagtagcagtagcccaggggagatggtggtgatttgatctagggaggagaaagtgggaagtggatggatttgggatataatttggttgtagaagtgataactgcgcggtggctcacgcctgtaatcccagcactttaggaggccgaggcaggcggatcacctgaggtcaggagttcgagaccagcctggctaacatggtgaaaccccgtctctactaaaaatacaaaaaattagccaggcgtgatggcgggcgcctgtagtcccacctactcgggaggctgaggcaggagaatggtgtgaaccaggaggcagagcttgcagtgagcctagatagcgccactgcactccagcctgggtgacagagcgagactccatctcaaaaaaaaaaaaaaaaagtgataactggttcatcccaaccatttttatcagttaccttgcagaaaacaaatttagtgtgttgaaggaaaccaaaatatttctcgctaaaatactggggattttagtttaaaagcttaaaacacatgggcacactgcccttcctaactctgccttcatccgctcagaaacagctcagcggtgccagaggatccaggagcagactttactcttccc

SEQ ID NO: 1447 - DNA, 1022 bp, Homo sapiens
aaacactgtctctactaaaaatacaaaaattagctgggtgtggtggcatatgcctgtaatcccagctactcaggaggctgaggcaggagaactgcttgaaccgaggaggtggaggttgcggtgagccaagattatgccattgcactccagcctgggcaacaagagtgaaactctgtctcagaaaaaaaaaaaaaaaaaagaatttataatcaagcagcttcctcccctccccaatgccctgccactgatcccttatgaacattatttaggaagaccctttgcctctacttgttttttaaaaagtgaaataacagaaagtgaagaggttttctcaggatgttagcaattctccactgttaagcaggtcttctctaggtttacaacagaaatagctaaggaggcagagctcacacctactttgtctatctttctaatactgaacaaaacctttactcaattttgctgctttctaatgattctgtcctatttctactcttttttggcaaactcctctagcaaattatctgcgcagttatcgtcacctcttaatgtcaaataacaaataatttggttttagtctctattgaaatataattaagggccattatctactcctgaatagccacattaaaatgcctcttctcagtctttactgagttccctattgagtttgttattgcaaaccactctattaaggaatggtttttcttctctttataattaaagaaaattacatgaacagtatagcaacattaatacagctctagataaaagacagaaaaagtcacccacaatgtcactacccatccaaaagtaaacattttttaaaagttgttgttgttgtttgagacagagtttcgtcttgttgcccaggctggagtgcagtggcgcaatctctgcttaccacaacctccatctcctgggttaaagcgattctcctgcctcagcctcctgaatacctgggattacaggcatgtgccaccacacctggctaattttgtatttttagtagcgacagagct

SEQ ID NO: 1448 - DNA, 1098 bp, Homo sapiens
caatccccttaacagagaaccacaatgatgtatattccaagtcactttcaagttaaatttcattattggtatccttacattttcctttaagaaaaaagaaactctgggccaggtgcggtggctcacgcctgtaatcccaacactttgggaggccgaggaggctggatcacgaggtcaagagattgagaccatcctggccaacatagtgaaaccccatctctactaaaaatacaaaaattagctgggcgtggtggtgcacactgtagtcccagctactcgggaggctgacacaggagaattgctcgaacccaggaggcagaggttgcagtgagccgagatctcgacactgcactccatcctggcaacagagcgagactccgtctcaaaaaaaaaaaaaaaagaaaaactctgaaaagggtaaggaggaagtgggattcagtaacctacaaagcatttaggcaggacgcttttcaaaatgcagttggcagaaatggaagttgaactgagtgtggtttccagtacagggcatctggccaccttcacctcagtaaatactgctgatcgactctctctggctctggctgtcctgccagagacagccaaacacaggagacatgacaaattactatcatcttttgcttctttatttttattattattatttttctttttgtggagaacagcgtcttgctgtattgcccagcctgatctcaaactcctgggctgaagctgttctcctgcctctgcctacccaagtgctggggttacaggtgtgagccactgcactcgacctttatttttattctgtatactcatcagtccccttgtgccctgataatggctagaaataggagtttctcttatatacagtagcagggacacactttctctccttctctttcctttctaaaggacaatgtcaaggacatgtccaggacaggtcagagaatgttatatcagagatactgctgctatatttacccccacttgcctttcaagcaaagcaatttatatgattaaaaacaaaacaaaacaaaacaaaaaacagcagaggcaaactgtcctgggtatcttcagagaagaaaaacattgaatttt

SEQ ID NO: 1449 - DNA, 1073 bp, Homo sapiens
gtgacattcattgagaagttattgtatgtcaagcatcttgtagttcaaatgtattatctcattcatctagttggcaagcctatgagatagtttctattattttacaaatgagaaaactgatgcacagagaagttcaataatttgttaattattaatagcaagtggcagagtcaagatttgaactatgtctctttactattaaaagtccattattttggccaggtgcggtggctcatgcctataatctcagcactttgggaaggcagaggcgggcagattacctgaggtcaggagttccagatcaggctggccaacatggtgaaaccccaactctattaaaaatacaaaaagtagccgggcatggtggcatgcacctgtagtcccagctactcgggaggctgaagcaggagaatcacttgagctcgggaggcagaggttgcagtgagccaagatcacgccactgcactccaggctggttgacagagtgagactctgtctcaaaaaaagaaaaaagtccattattttaaccaccgtagactactgattctacattagagacctagatatcaaggccagtgtatcttcaattctttaatccatacccttctcctgaaacgcaacagcactgttgcctgagtgtttgttgaagaggtttatttctttggtttaagactttgttcccagagattaaattgcagatccctaaccttctcactactaagtagctcttaggagtggatctcaaagcttgaaaagattttagcctgccagacaaatatcattaattaatcccttttcccttaagacagccaggcctaccacactaccttgatgggtttctggacaaaaaaaaaaaaaaaaagcaaaggtagcataaatataattgatgatttctattagacttctttggaaaggagaaaacaactcttacaccttcattaacacctccatggagcctccaggttagtggtagtaggggttcaggacttacattagaaatccctgttttgaccttttctgttagaatgcttgactgcctggcattttcctattaatactaggatttttttttc

SEQ ID NO: 1450 - DNA, 1420 bp, Homo sapiens
taaaatatatgtagatactagtgtactttattatttactgccataaaagatatataaatccattataaaaagttaaaatttatcagaggccaggcatggtggctcacacctataatcccagcactttgggaggccaccaggcggatcacctgaggtcaggagttcgagaccagcctggacaacatagtgaaaccctgtctctactaaaaatacaaaaaattagtcgggcgtggtggcacatgcctgtaatcccagctacttgggaggctgaggcaggagaattgcttgaacccggaaggcggagattgcagtgagccgagatcatgccattgcactccagcctgggtaacagagcaagactctgtctcaaaaaaaaaaaaaaaaaaaaaaatcaaaacttacacataagtacacttacaaacacttgcaccattcacagtggaaataaatgcaaacaaatatagagatgcagtattaaatcataactgcatacaattaactgtagtaggctgggcacagtggctcacacctataatcccagcactttgggaggctgaggtgggtagatcaattgaggtcaggagttcaagaccagcctggccaacatggtgaaaccccatctctactaaagatacaaaaaacaatcagccgggaatggtggtgcacgcctgtaatcccagctacttgggaggctgaggcaggagaatcgcttgaacctggctactcgggaggctgaggcaggagaattgcttgaacgcaggaggcggaggttgcagtgagctgagattgtgaacattgccctccagcctgggcaacaagagtgaaacactgtctcaaaaaaaaaaaaaagtgatctctcagttctcacatagttttcatcatgtttagtgcaataccataaaccttgaataacaccttgggaccatatgaagtgccattagtgatgctggaagtgctcccaagaagcacagaatagttatatcattacaacaaaaagttgaattgcttgatatttccacagattgaggcctgcagcttgtacttgtctgccatttcgagataaatgaatccagcataagaaccattaaaaaaaaaaaaaaaggaaaggaaatttgtgaaactgtcactgcagctataccagcagtcatgaaaaccttgcactttttgcaaactacctttatatcttgtattgaaaatgcaacttttatattgcatttattttatatttattttggtgcaatatatttatattggtgcggtattgctataagaaattcatacgtatatagtctaatatgattccagaaaaagcaaagtcattatatgacaacttgaagcaaaaagaaggtgaaatctaaagcgagagaatttaatgctagcaaatgattgtttggtaattttagaaagaggtttgggttta

SEQ ID NO: 1451 - DNA, 1050 bp, Homo sapiens
caataaattcctgctggagaaaactgtgtccagatgttgtgcatgacttatcaggatatatgacagaagcaatcaaggaaatcatgaaagagattgtggatgtcccaaaaaaggtgggagataaagggtttcaagatacagatcttggataaattcaaaagctaatagacaccacacctgaggaattaacagaagatgacttgatggagataagtgcttccaaaccagagccagatgaagaggaagaacatgtagaagcagtagttctagaaaacaaattgacattagacaatctggcagaagggttctgattattcaaggctgcttttgacttcttttacaacatgagcccttctgtgatatggacactaaaactaaagaaggattggtaccatatatggaggctgggaagtcccaagatcaagctgccaaagagggctggttcctcataaatgatgctttctaaatgtgtctcacagtctccctccagctctgttttttgagacggagtcttgctctgacgcccaggctggagtgcagtgtcgcgatctcagctcactgcaacctccgcctcctgtattcaagcgattctcttgcctcagcctcctgaatacctgggactacaggcatgcgccaccacgcccagctaattttttaatatttttcgtagagatgtggtttcaccatgtttgccaggctggtctagaactcctgacccaaagtgatctgcctgcctcagtctcccaaagtgctgggattacaggcgtgagccaccacgccaggccccccagcctcttttataaggccactaatcccattcatgggggctgtagccttctgacctaatcaattcctaaagtccccatctcttgattggtatcacatcagggactaaattccaacagatgaatttgtggggacatcaacattcagaccatagcagcacttctgtctgtcttgttatcttctgctgcataaacagaagggagtagtgcctttaaatcagcccaagcgcctctgggtatcttgaagataaccagctctttccac

SEQ ID NO: 1452 - DNA, 1031 bp, Homo sapiens
tgatttttatgttatgctaaactatgaaaagtactgctatgtgggattctctctctctctcacacacacatacacatacacgcacaccacacagctacctaaaactcctgcagctgctaatgccacttggtcattttcctgtggttttcctcagcagggccctgggatttgtttttctccactgtggaccttgttcatttcctgctgcttccaagaggttgggagaggaaagagagcaggaatgaaggcgggagggggaaggggttagctaaggcagtgtagctttcaagaatgaaaaggaaaaagcttagtgacagtgttcctttgtgaagaattcagctttatgttgatggagctgcaagtcattagcaacccaggcatatggcccgagttgaccgggtcattctccggggccagatcgccctctgctgctgactgataaataacactctgggactcgaactgccaaggaaaagaggaagagtctctggggctagggtgggagggaaagaggacatgactaaggctaagagatcacaaagtcaccaggctgtagaagaatcttgttaaattcctgtgtgcaggaaaggaagaagtagccaaatgagcgggcgtttctaggactcattcaagaaacagtaggattcacccaagatctccactagctcctgtgatcctagctcccagcttaatgaggctctgcaaccattctcccttttattcctcacctttacctcacttggaacataaagggtgtttaaaatgggaagacaggctgggtgtggtagctcacgcttgtaatcccagcactttgggaggcccgggcgggtggatcacctgaggtcaggagttccagaccagcctgaccaacatggtgaaaccccgtcactcctaaaaatgcaaaaattagccaggcatggtggcgcacgcctgtaatcccagcttttcgggagactgaggcaggagaatcgtctgaacctgggaggcagaggttgcagtgagccaagatcgcaccattgtactccagcctg

SEQ ID NO: 1453 - DNA, 1034 bp, Homo sapiens
tacccagctaatttttgtatttttagtagagacggggtttcaccatattggccaggatagtctcgatctcttgacctcgtgattggctggaatgcagtggggtgatttcagctcagtgcagcctctgtctcctgggttcaagcaattctcctgcctcagcctcccgagtagctgggattacaggcacccgccacgaggcctgactgatttttgtatttttagtagagatggggttttaccatgttggccaggctggtctcaaactcctgacctcaggtgatccgcccacctcagcctccctaagtgctggattacaggcatgagccactgtgctcggcctccagccacccatttctaaagttgagatacttcaaaagtattatggatgtctctcacataatctcatgtaatagaaagattatcttttttagacagtagcagaaacagcagttttagtttgcaaaagaaacactttaactggatattagtggccaagtaaaaaaattaagtaaataaaagacgtagtaaatccctaaaccaaattgggcatgaggcgtgggaaaagctgctatgtttccagaatccaatatactttgcccctggcttgcatgatactgttacaatgaactgtttcacttgcaacagtcatttcaaagcatatacgatgctttcactgtattaaggattttaacatattttgtcttctttatcctggtatatctggggaagtggtaaacagcaaatgtgagcctttaaaatctagtgatatcttcaagacatttttgttagtttataagatatctgaacaagaaaatctgcaacaagagagcctaaagaaatctgatctaatacagatctgatacagatcacctgggcttggttgttacacaattataccctggtgtattagtctcttgcactgctatatacaattaaatcagactgggtaatttataaagaaaagaagtttaactggctcacagttctgtaggctgtacaggaagtatggcactggcatcagcttggcttctggt

SEQ ID NO: 1454 - DNA, 1156 bp, Homo sapiens
ttttttttgagatagtttcactcttgttgctcaggctggtgtgcagtggcaccatcttggctcatggcaacttccgcctcctgttcaagcgattctcctatctcagcctctgagtagctgggattacagccacacgccaccacacctggctaattttttatatttttagtagaaatggggtttcaccatgttggcaaggctggtcttgaactcctgacctcaggtgatccacacgcctcggtctcccaaagtgctgtgattacaggcatgagccactgtgcccggccgagtattatttttaaaactaaattatgctaggtacactcttaacaaggcaaggatttccattcacaaaaggaagcgtaaattatgcaggctaaatgaagcactgtcatacccaaaatattagatacaatattttcttatgatttaacttttacaaagggcctctttgtcagaagttgctgaagttcccggttcagcctattattgctgcatattcttgaaaacaaaattgttgatgattcagatgtatgtgtgactgtgcgaagaaaacccctccatttctgttgctgtaggactttgttgcaattagcttgctgaacttgattttctctttgaactgttgtgattgctttgtacatcctataaataatttacccctgatggtactaaacgactacattaatggcacctctggctccacatgatatcaaggacattaataattcatcatttattacagctacatccttgtagattagcatgagtgggaactgagtttacaacattgagatcaggccctctgagagacctttactcctctgtcatcatatctataaatattcagatattagtggtgttagaaaataaaggaaggactgttacagagctagactttaggtttaagtttattaagcattaggtttacagcctgggcaacatagggagaccccatttctacaaaacagaataaattagctgggcttggtggcatttgcctgtggtcccagctgtaaggagactgaggtaggagcattgcttgagcctgggaggtgaaggctgtagtgaggtgtgatgtcaccactgcatttcagcctaggcaacagagctttagattacttcaagttcttaagtacattttagggatatttga

SEQ ID NO: 1455 - DNA, 1116 bp, Homo sapiens
tgagagttgtcacaaagattctttgcttgaccaacccgtaggcaagcccttaaaccttctcctaggcctagctgtgtaaaatccaattttagcacaaaccctgtaaaaccagtttagcaagaactcttcctcattgtagaccattcccaggtgatgtctgatcaccctggcctgtcttcagcaagaatcctgttagggtttagccagagtcttccttactctggatgttattttttagtaatttcacatccactgagtgggatgaaagcaaacccaccttgctccttggctatacttgcccttgctgtttccctactgtctctccctcactgagtcgaacccagtctctctccccagctgcaacatcacattgccgtggtccctatatctattgagatgatcctgaataacgtctaccttaccatgctttaacaagtatcactgagtaattttttatttaacagttacggtgctgtgactccgataggatcagattcatcattggacccccagacctctcacccaggaccccaagtgtgcacctttgaagccattgtcttcactcctgactgatagatcggggatccaatggtgagtcagactaacgaaccattgctccggacaaacatctgttgaagctggtaaggaaagatttcgattctcaagattgtgaatatattctctggagttgggctagaggccagacttcttttgaaaggtacctcctgggcttgaaggtcttcttcctggctctctttcctgagtggggtttattccctgactccctggactaaaagtccttggaactctgtgaggctactctgttgtctctaatggatcctacttctcccatggcaatttctctggcatctgaatcccctctgtttgagcccctgctaactatattgctccaccactggttctgtccacctcctccttgttggacctttattggcctgtttggaatacttaagatctccccagactgcatcctgtaagctgtctttcttcccattgctactgctccttattcctcctcttaccacctttaatgttccttccagttcccttgagccctttgatatgactcccttcaaattcttacatcctccatcc

SEQ ID NO: 1456 - DNA, 1029 bp, Homo sapiens
aactgataatgcttgagaaatatattctgagcacacaggtgacagtaagggctagtagaaaagtgctggatcctgaagtcaggaaacctgagttccaatccaggctctgccactgactgacatgtctttgagcaagtcatttgaattttctgggcctcatttcccccatctttaaacaagggaattggactgtagctctgtagtctctttcaactttaatatgccactttgtaaacagaacacacaattttatagtattttttaaaattgaatctaaagcaaaaataaataactgacttggctacggatgcatttttttccccttagatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatggtaaggaattatgctccttgattttttttagtttagaaggatttttcatgttcagttttgaatcacttgagagaattagactaaatctgacatttaagtaggactcttactgttattgtcttttgagttgtgataacttatcaagtgggtgggatttttggattagtcagtctgcccacttatggtctctaattggtctttggttgaagggtaagtgctgtggccctaggagatgtgctactttcactgctgtttatgcttttgaagacattcttatgaaattctcagttttcattccagaaccataaatctctcttgataactatgaaatttattcctgatgggccttctaataactgggaatatttaggacatttttgg

SEQ ID NO: 1457 - DNA, 1050 bp, Homo sapiens
atttgccatctgtttaaaagtgctaggtgatactccctttctaacataaaaagcttgttctttcagagcctggcagtcctgtcacagctgtatgcacctagaggaaaacttgtttggaaattcctttcatttcctccccctctccctccttccctctttttttttactgaaacagaaattgattgaggaaggttcagtcattccttcaggaaccaatgagttagatcgggttgttactttatgtataatgaacgcttcaaaaactggaggctgatttaaagattgcagaacttgagtcagactcataagcagtactgtgacatgaattggagccagaacagttgctgatatcagaaccatctctttcattctgtgactttgctcttgccatgttctgactggggtgagccgctaggatacaaatcactatcactgtccatatttgagtctgcaaatcttgtcattgtctgctttaatgctctttgagttgcaacaggtgtattatttaaatgagtatttgaaattctgtgaacaggaattcttttggtagtgaaataggtgctcacacctgcttgctcagaatgtgaaaatattatttctgagttctctttgttcactttctaaagtgactgttgtttggtgttggagatgttaactgggttctattaggtgtgctatatcttggcaaatattccccatgatgaactcttcctactatcacaatcaggactatgactggatttctcagtctcagtgccccagattcaccatttctgattgtgtctggagaacgttttcctggaaaggcattccatgttccaaaagctacaaaaacatgccactttgcaactatgggtcagttatttgctctctcaatgtctcatgttgctgagttctagaaaatctctgtctcatttaccaggggtcattcaaaagtctgagatgtatattatcatgaaatatttgtgaaatttctcaccatgaatttggagggaacctacttttatttctcgctctggttctccattggtctgggctcctgcttctcag

SEQ ID NO: 1458 - DNA, 1081 bp, Homo sapiens
ccaccttggcctcccaaagtgctgggattacaggcatgagccactgtgcccagccctcttgataatttttattcttgtttcttcttatctgtgggactccaattagaatggggttgagattgtggcattcagttttataccaatattttacccaagtgtgtcatggccttttttaatcattttaatatccccagaaatgctagaagtgtaaaggaataacagaggtaaatttgctgtcattttatgccacatcctcttttcttactttgcttcttgatacagattatagaggtaattgtgaagacagttgaaccttagaagattgagctaagattctttttttggcaacctgcaagtaatgtttcatttttctattacgtgatctctttgcccatacagttggcagatgttttttccccctttttctaccttaaacttttttgtttggagtacagtctaaaccaacatcagttagccttgattttctttcttttttggacaattgtctggttcattgacaaaagtaacaagtttggaactaagagatatgttacaagctgcacttaacaccacctgaaaacccaagaatcatctgaaggttttgtcagtagtaaggtaggttttgtgtgtgtgtgtgtgtgtgtgtgtgtgtgtgtgtgtgtgtgaagatggaatagggtgaaggtgaagaaacagcttgacttgtgcctgttttcagataaaggagtaaagtgatctacaaactgtaactatcttgaaagagaaattgatcatcagatggtcgagtactcttggaatgtctctttgctgtttactgtggcctctttacaatggtgagacttatttctaccctctactttccactattatttttttcccctattggataatactagtctgagcagccctaatactagatgtacctaaacagagatacaagccaagtcattgttcagtgtagtcatttcttagtatctgtttatattttgtcacacatcagaatgtatattttatagagcatgtgtttgtctacttgtttgtctactataatatgtctttaataaagctaaaaacattctga

SEQ ID NO: 1459 - DNA, 1030 bp, Homo sapiens
cttttgttacagccacagccgactggcttccagtgagaagggtggcatcattatatctccattcttccctgaaccctagcaatttatcctgatgcagccactcagctgcattgcagtggtttccaggagcaacccacttacctgcagcccccacccatttcagtcatcccaacatggccaggggaacatagattacattttgaggaccataatttgacttatgacatatctaaatacctgagaaaggacacgctgtccttataggtgattaggtacttgttttattaacacatactgagagatattgttttagagactctgtatgggttatgaagggttaaacttttttgccataatttgtttggagtttagggtttggttttaaaaaatatcatgcagtggtaattggaaaaaattttgtttcaaatttattaataattaagatcttttctatttggaggcttccctttttattgtcttgggtatacaatgtgaacggtaaccgatctacttaattaaaactttctggcattttagcctctttgcttttgctggtttttttgcacataatttgaaacacgtaattattattttctggcttcaggggagtttgtgagaggcaagcctgtatctcgttgttctgattgggaattacacatgactatgaaaaatgggattttactatacataatggcatttaacagaagtagttttatgaaaggaaaatatcctacaaggtaggaaaaaaacaagtatttattaatgcttcattttctgaacttaaatagaattaagctaaattggctttgctttttcctccaataaaataacttttaaaaattcactttaatggagtagttccagagatatattactctttggatatggttatctagtttgcagcaagtatcttgtgatatatagcttagatctcagcaggaaagaaaaaaatcttaatttacatatcagtttctgtatttgtaagaattctgtagcaagtgacagaaacgctgttgagattaatgtaggc

SEQ ID NO: 1460 - DNA, 1053 bp, Homo sapiens
agaacagcatgaatgtggacatgaaaaaatctttctgcaatccatttaccacatactcctttgcaatatcagtcagggttcagtgcaggaaacagaaggggatataatgcagggaattaattgcttagggaatcttttgaaagggctggagggctgggctctagactgagcctctgagaatgatttccaggacaccttgaaacagtccacagtgggagctgccacctctgcttgagtcaggaaagtggcaatcaggaggttgctactgaaacagtggcaagaaaatgctactgtagctgtgatccaggtgatcagggcagccactgctgttaacattgtaactgctggaagtctggaatgtaggatctggccattgctgtgacagcttctccttgatgctcgtgaactggtgactagatgctgttatgatgaatctggtccctgctgcctttgccattgtctctaaaataattagaaaatgattaattatgtttttaatataatttaattgtaattttatgcaactaaattcttaatagtggctgtgtttgacaactgatttgtgaaattcataaaaatttaataattggccttgcaagagagtacagccaactccattgcatcactgtaaaacctcctagctgacggttctactccttaattgaaaattctctcttttttgttttagttcaaagctggagactggatactgacatgttcatgaccttgtgtacaagctgaaagctgctgaaagctacaggccaatggggctctgctttacttctgccttccatatcttgtgtcctgcatcttaatggtggaatcagatttgcatccagaatactagctataaaggagtctggaaaagacagtttttagttttccaacttctgcgtttcaggaaggcatactacaaggaggaagtcgctgagtgatagctgatcctttcccaggcactcatcttcttaaacatagtatattaattacaatttagcccattcttgatggctcattgtcatttctgtgagcttctcttttcataatggcctgtag

SEQ ID NO: 1461 - DNA, 1031 bp, Homo sapiens
aaaaaaaaaaatttcctctgattacaggagataggtagaaaaaatgtgttacagtgcagatgagaatttccttagcacttttaatgtgaagtttatttagattgggtggccagggaaagcatccctgaggaggggacatgtccattgtgagttgaatgactgggaggcaggcatctgccctctgaaaattttttactcagagagaattgtaaaacacaaatatgagaacctggttcgatataggaatagaaaggctgatatggctggcaccaactaaatgaggggtgaaagtgagagggatcagattgaagaagtagacggggaccagtgggggtctgttagccacagtaaggggtttggattttatttattcttaatgccactggaaagtataaagttggagaatgattggtatgtatgtcaaaaagtcattgtttgtgatgtggaaggagggcaagagtggaagaagggaaaccctttagtttggatgaaaataaatgatggcttggacttataagaatagtggcagtgaaatgaagtggatagatttgagatatgtttttaaagaggaactaaataagacttaactgattgattgcaggtaaggaagggagaggacttcaagagaacctctaggtttttgctttgagtaactggtggtggtactatttccaggaataggaaagacaggaggttgggtggagtgatcagattttttgtgtgaaggagatatatctaccaccaagattattttcttaactttttactgtacttgctttattatacattaacctattcctccatccatcaatctgtcttttttttttttatgcctttcaatgtaaattgcaatgcatttccacaagaaaggcttttaagtgcccagtttttctaattttacagatgagaaaactaaaccttggagaaaaatatgctcaaggtcgtatagctagttactggtgaatctaggatcagcatgcaggttaccattagttcaggactctaatttgattatattttagcttgtaaga

SEQ ID NO: 1462 - DNA, 1005 bp, Homo sapiens
tgtattcaaaagttccataaagaatcaggacaaaaaattgctactaaccatttaccacccagaagccataataataattaattttatttttcttttactattttaaattattttggctgtgaccgtcctagacgtgtgaatacatggtcaaaaaatgtgaactttttgggagatcttgataatgttacattgtatctttctggctctagagctcttacatttttcatactaaattgtctcagtctttggggctttattattattattattttattggcagtgttagatcttgtagccaaaaaaagatttttttttcctcttttggttccaaatagtcatctgttattttggattatttgctggattgttaactatacaggaaacttccaggcctcatctcacagcaatgactgtcatgttgataaacaattatgatatcccaggttatgttaaccctgcctaagtagttacatggcccagtgaggatgcctagtagctataggtgattggttctgttttgtctcctacacctaaaattttgccataggtaactgttttgataaacataggatagcgtccttttattctgtatgtaaaaaagtactatatgtaaaaaaggaacttaactcctcactaccctgtttctgtcctctagacagccagatggatcttgtgtaaaagtagaagtaatcttggctatagaacaagaactgttgatatttccattttaaaaagttgaatcagtcttaagtttgagttggtgagtaaaacaaaaccaaaaccaaacctgggataagctaccaataagttaccaaagtatttaaaaacttgacagatgtaaaacattaatatataatttattcttagcaacttaatctgtttattgagtggcagtgtttcagtaataaagctgagctatttggatacactgaccttaatctagtggaaaacaggaggcttttaaattggcacatacacaaatcatcttaggatccataaaatgcc

SEQ ID NO: 1463 - DNA, 1043 bp, Homo sapiens
gatagtttgctgagaatgatggtttccagcttcatccatgtccctgcaaagttcatgaactcatccttttttatgactgcatagtattccatggtgtatatgtgccacattttcttaatccagtctatcattgatggacatttgggttggttcccagtctttgctgttgtgaatagtgccgcaataaacatacgtgtgcatgtctctttatagtagcatgatttataatcctttgggtatataccaagtaatgggattgctgagtcaaatggtaattctagttctagatccttgaggaattgccacaatgtcttccacaatgattgaaccaatttacactcccaccaatagtgtaaaagtgttcctatttatccacatcctctccagcacctgttgtttcctgcctttttaatgattgccattctaactggcatgagatggtatctcattctggttttgatttgcatttctctgatgaccagtgatgatgagcattttttcatgtgtctcttggctgcatagatgtcttcttttgagatgtgtctgttcatatcctctgcccgctttttggtggggtttttgtttgttttttttcttgtaaatttgtgtaagttctttgtagattctggatattagccctttgtcagatgggtagattgcaaaaattttctcccattctgtaggttgcctgttcactctgatggtagtttcttttgccttgcagaagctctttaatttaattagatcccatttgtcaattttggcttttgttgccgttgcttttggtgttttagtcatgaagtccttgcccatgcctatgtcctgaatggtactgcctaggttttcttctagggtttttatggttttaggcctaacatttaagtctttaatccatcttgaattaatttttgtataaggtgtaaggaagggatccagtttcagctttctgtatatggctagccagttttcccagcaccatttattacatagggaatcctttccccattttttgtttttatcaggtttgtcaaaaatcagatggt

SEQ ID NO: 1464 - DNA, 1016 bp, Homo sapiens
tcccccataaaattccctggttcctccctgtaggttggtgatcttttgagaatgcaatttcaccttataatgtatttcaacgaaataaaagttttcagttttaaacaatcaaattattatagaagtggattttggagtatagccacgtcttaaattggggaccacatttattgatttctgatagattaatttttattttcagagacagggtcttgctttgtcacccaggctggagtgcagtggtgacatcacagctcactgcagtcttgaactcctgggctcatggtagcttaatttgaatttcttgtatttaactgagcaatttaagaacaggacttaatgtaaatctacacttttactttcctactccctcctcccctatcctttttcccatttaattttctgcctaaaatcagtttcttctcatgatctctgtgttgggctatgtattcctcctgtatatgtttcttccctcattcatagcatttatcacactattataactgatagttacttgtctgtcccgttagtctgtaagtctcactgaggtgcttcattgtcttgatcattatttgatccctatcatctaactcagtgattggcatagtaggtaatagatattttctgaatgtgtttttcttgtcacctagactcaaatactttagaataatattagactctttaaagcctcttcctaaaagaaagaaaacctaattaccaagttttatcagtttttctttctttataatattttttatatcctcatccattcatttttattttcatattcacttccttgtctgggctttttcgacctaagacctggggtccttggtttcagtcttttgtttttgttttttatcttgtatactactgctatttcagttttgtgtaaatttttctcttattcagaaagctcagtgggatctgtgttgtttaccacagaaaatgtaaacttatgtgtctagcattcaagacctttatcatttatttaaaaggttttagtgtctgataac

SEQ ID NO: 1465 - DNA, 1065 bp, Homo sapiens
acttcaagcctgtcccacatggtaaatatgcttaagggtcctcttagataaatccaatgtcaagttaaaaattttgtgctattcatttgacagtgaaaaagagatagtcccatttgaggatatgaccagagtataaatcattaagtaatagtattagaaagggctttgacaagttgtctcatctaactctctgctttaaagaggcaagtgacctaattcgttagtttcctcaaaatgcagactctaaaccgaggtttcataaaatccaggctttagagccttcaagaaccctctgaagctgcatgcaaaatttctgtgattgtgtctttttatgggatgagggtccatcaacttttatgtattcattcatgaattattccctacctttcttcagtattttaataaatgttatgtgaagcttgtaccaggtacttggaccatactcttaatatatgattcttcataaacttgatcttttgttttatctacagccagtaggaagtagccaatcttaaaacaaggaaccagatataagggactatggctctgtaattacttctgtatttgctttgaggtgtatttctggactgctcttggattcttgctatacgctaatgtctgaaaccaccttgatttttttttttttcaatctatatgtgtttggatttggctttgcttactgattgtctgatgtggaatttggtgacctggatgctggactgagtgctttcttagaattcatgttgtttttggaatttcacctcttatcattagtgtgaactgactttaaaactttatgtaaaacatgccctgcccatctctctctctttacccttttactgactgtaagggagtaagcttagatagcaattcttgttttttatttaattggaacttttattgagctaactaaattcacatgtagttataagaaataatagagatcttgtatacctttcccttagtttgcaccaatggtaacattcttacaaaactacagtataatatcacagtcaggatattgacattgataccaccaatcttaacagatttccctagttttac

SEQ ID NO: 1466 - DNA, 1034 bp, Homo sapiens
tgtcaggctgcgtttggctcatgatgcctgcccggatcccatacctgccaagggtgagccaggacagagcggtgaggggcatgtgagtgagcgagtgtggggtctggccactgcgcacagacaggcatgccagctgctgcggggcagggtggcggggcaggcagctcccggcgctggcacaggcgcctgctccgtgcaagggtgcatctataccagacataccgcaagcagcttctgctgcgggcactagtgtctggataagggaacgtggtggcgcctgaaagctgagagataccaggaacagcagaaccctattgccctcagtgtggcgagtgggggaggcatgtttcggggggcatgttttggcccaattgtgttatagctctttcagtctcactacccagctctggcttgcagctcctgggctgatccggccccaccgctacttcccattgcatgtgtggctgcctggtgcggtggagggcgggagggctatagtgttacagaaactctggcttggggaatcctgaggtctgggcccccagaagggttgccacccttcacttctgcagtctgagagtatgtcactgcccacagcttggtgagccgaccaagaatgtgttacatacccctttggctcctgccattcagtaggtcctgagttcttgtcccacatccaggaagaatgagattatgtggacaactagaggatgagcaaggcagagaagaactttattgagcaacagaacaactctcagtggagaagagacccaaagcgcgtagttcctatctgcaggcaggttgtcctggtaagtattcgtttttttttttttggggggggggttgtttttgtttttgtttttgagacgtagtctcgcacttttgcccaggctggagtgcagtggcctgatctcagctcactgcaagccccacctcctgggttcacgccattctcctgcctcagcctctcgagtagctgggactacaggcgcccgccactacgcccagctaattttttgtatttttagtagaga

SEQ ID NO: 1467 - DNA, 1054 bp, Homo sapiens
aggaaaaaaataaatttggctaacttaaagagttatttatcaggagacactattaaaaaaaggcaaatcagaaatttggagaagatatttttaatactgataataagacagaattgtaccctgtaaccataaatatgtagaatttctaccatatcaataaggtataagtttctgttgctccacatcctcttgcacggttggtattttagacttttaaaattcttctgccaagcacggtgcctcatgcctgtaatcctagcattttgggaggccaaggcagatcacttgaggccaggagttcaagaccagcctagggaatatagtgagactccatttctacaaataataataataaataaacattattattgttattattctgatcctggtggtcatagaatggtatatgtatggttttaatttgcatcccttgatttttaatgagggtaagcataatttcctctattaatggccatttgtgatattttcttcagtgaagaacctgtgggagatggaacatgaggctgacagttggcattatgttgagcttgtgagaggtgatgtgattctaccttcaggtactactgggtctgtgcattctataaaaccagagaggcaactatgatcagatctcctgctctggctgattttttatttctaggagatttttcatttgtttgttttcatttagagctgtactcctgagtcattaaatagaacactataaatttgctggtgcaggtcataacatttgaagggattaacatttggtttattctctctaaatccatagctattaggaaataacctaaaacttcaggatttactttgcagaaatgatttccttctaatgtatgctctctcaaaggaatttagaatcctgttacataagaggctatacagctttaatcccattcattgatatttagtgaccagttaaacttcaaaacaatttttaaaaatttccctaatttaaaaagtaataataattatgtgaaaaaattttggaaaatacaaactcatagataataataaaccatttagagaactgtga

SEQ ID NO: 1468 - DNA, 1055 bp, Homo sapiens
tcatgaaacttactgcaagtgcagtatttttaatcatactgctttttagcaagtttagtatcattctgctttttagcaaggccttgttttttcattttggccccaaaccattttttatccatgagccttttaatgttatattcttgcaaaatttttatctttagtcatcacttttgatttttatagttacatatttagttgttatgcaatatgtatgttttacataccaagtatgtttaagttaatatactattttccttagtagttaactcttttcttggttattcacttttgtcccccgttagcagtatgtcttacgtattttaagattcagagttgaaattctaaattccttttactcacgggaaattagattttagtgttttgcacaatgccaaatacatagtggacacttaataagcgttcgtttgtagtaatagcctctttggttttctatttcatagaatttcaccaaagatgattatttttgactgacttttaaatggctacatgaattcttgaccctcagcctaagtaaattttttcattgtggatcacaatacctactttctcttttccttcttcattttactcttaaaaatattaatgtgcaaatttggaagtgtcagtttcacaattgctaacctacttgaagtgttttgaaaaatgaaattaaggaaaatttagagaagtggtttattaccttaaaataattaatagcaagattcttcttaatatgttatgtcatagtcacatcatttatttatttactgattcattcttggttcagccagtcatccatttaataaatgtgtttcagtccttatcatatgtgcaaggtgctagtattatgaagaggaattcaacacagctgatatgtggagggatgtctttaatttatatttaaatctctgtgtgagatttgaaatattacaaaagactagagtataaatcaggtggaaaaagggacagcaaagaactgcaaggaacttaaccttttctagcatccagcttgaccattctataaaatatatttagcaaataatattctgata

SEQ ID NO: 1469 - DNA, 1035 bp, Homo sapiens
caactatcagaagaggattttggtaagacggagtgggaagcatcagaaggtcttacctcacctagacaacaactgcactggcagaatctgtctgatataactattttggatctctggagtctactgaaggctttcactttccagggagaagatttggatctaattgtggttatttttggtcagttacagctcttcgcatggtagcagctacccatccactaccccagccccatggcaggcagttgtgccaacaggtgttccagaaacagttttcacacagctcatgggagctagagtgggcaaaaagcaccttgtcctccaaatattggggatctgtgctctgattgctatttctgctcacagaggtgcagagagaggatggcagcctttgttgtatacctacccccattgttgcagtcccctcccccttcagctgaagtgattccaggggatttaaagggttagcacctttacctcctcatttttctctttttgggagcagacatgaaaggctagaatattcaaaaacaatggcatatgtgaggaaaaattagaaagtgactgtgcatgcccagggaaaggcacaggtttggaaaagacctgggaaaaccttaagtttacatttcaggctgatcattggcacaaagacaataccaatcaagacaaaaacaataaatagaaataacaacaaaacccagcaaaccctgaggaaagaggagaatctgatttccagagtaaccatattattagattctagttttcaacataaaaatgacaaggcatacaaagaaacagaaaagtatggctcattccaaggaaaaaactgaatcaacagaaactcttcctgaaaaagacctcatgtcaaatctacttgacaaagactttgaacaactgtcttaaagatgcttagggaactaaaggaagacgtggggaaagtcaagaacataatgtatgaacaaagtggaaatctcaataaacagaaaacctaaaaagaaaccaaaaagaaattctggagctagaaaatacaataattaa

SEQ ID NO: 1470 - DNA, 1050 bp, Homo sapiens
ggatggataataaacgtttcttcacaattacttccttagctctcaaaagggattctgaagcattccattataagtgctgcttacagacatgctgaaatgaccactttttgctctggagtgatattctttgcttaataaagaacaagagatcacaatatctttctttcctgagcagaagcagggcaaactgttgattcctttttgtttttttcctgcaaagaaaggaccttgcttatgtcacccaatttcccctttcaggaaggggaagtaatttttagtaagtcaaggtatgtagtagccataaggtcttctgtttaggattaaggttcagtgaagtcatttggcattcatttatttttggagttttgatccgaaagctgcttcattgcagaattttagtctgaattatgttctaaagattgatgatctctctatgggacttcactgtaactactccattaggacatcagatttagccaagtatttatgtgttaattttgttggattaacttatgtgcatagacatacacacacacacacacacacacacacacacacactgaagcctcattgttcccttaaattttaatttttatttgatatcttttcataatctattgagaaaagttatgatgggaatgcagtactgtgagtttgcactgacaataaaggttgatctatgacagcctcttagaagcaactactttaaaatattttatagtgggaaaaaaccccacaaatgcagttgttgttttgtatacttttttctctgttgacctgaataggattaaataacctctagggtgatttgcccattcagcaaagtggcacaggccaaaaaggagattaaagtaggatgagggggaaacaaggaaaacatgacaaaggaaaacccaagattagaaagactcagtgaagaaattttactcaaagaaataaagaggttttttcttccttcagtatccccaaagcaatatagcaggaaatcttactttgattatccatcaacaagcaagagtggaattaataagttgaccagcaaattgatac

SEQ ID NO: 1471 - DNA, 1027 bp, Homo sapiens
taatgaatgctgtttgctgaaatgggcaactcttgagattggaagtgaagctatgagttgagagcactttctctgttttggctgtgttaactctcagtatcccccggaagtcattattatcatttgccatctgaatccattataccctgtttactttcaatttttatgttttttacttttatatttttttggagacagtatctcactctgttgcccagactggaatgcagtggcatgatcatagctccctgcagccttgaactcttgggctcaagtaatccttccaccccaggctcccaggtagcagctaggactacaagagtgtgccactgcacccagctagttttaaatttttttattgttttgtggatacgaggtcttactatgttgcctaggctggaatgcagtggcacaattatagctcactgcagccttgaactcctgggctcaagtgaacttcctgccttggcctcccaaagtgcagatattacaggtgtgagccactgtgcctgttcattttctaagttattttataaataattaacacaagtaaacaatgaaaaacaaccttattagaaactttaataagaatttaaccatagcaaacccaattttttttatcctgtaagttcctggttttgaagacacatacatattcaaaatgagaaaaagtcctttgaatataatcatcaattgctatatacaaacctgtaacatatacattatataaatactgatttccagatttaaaatgaatctcttaatatgttctgggtttatcattacttctggtttttgcattttattgtcaaaaggcagtatttttgaaaactttgatggctaagattttgttgaagaaaggataaacactttcaattgaaaagtatttttgttttttagatttatcaactaatgagaatgatcgatttaatgaaatttgttatttctacatcagttattttttctccacactttttatatagatacttatcatcagcatttgtctacctatgaacttcatcaagta

SEQ ID NO: 1472 - DNA, 1027 bp, Homo sapiens
tgcacattgattttgtatcctgagactttgctgaagttgcttatcagcttaagaagattttgggttgagacagtggggttttctaaatatataatcatgtcatctgcaaagagggacaatttaacttcctcatttctgaaccgaataccctttatttctttctcttgcctgattgccccagccagaacttccaacactgtgtcgaataggagtggtgagagagggcatccctgtcttgtgccagttttcaaagggaacacttccagtttttccccattcagtatgatattggttgtgggtttgttataaatagatcttattattttgagatacgttccatgaatacctaatttattgagagtttttagcatgaagggctgttgaattttgtcgaaggccttcatctattgagataatcatgtggttttgtcgttggttctgtttatgtgatggattacatttattgatttgcttatgttgaaccagccttgaatcccagggatgaagcttacttgatcgttgtggataagctttttcatgtgctgctgggttcagtttgtcagtattttattgaggattttcgcatcaatacagggatattggtctaaaattctctttttttgttgtgtctctgccaggctttggtattaggatcatgctggcctcataaaatgagttagggaggatttgctctttttctattgattggaatagtttcagaaggaatggtagcagctcctctttgtacctctggtagaattcggctgtgaatccctctgattctggactttttttggttggtaggctattaatttttgcctcaatttcagagtctgttattggtctattcagagattcaccttcttcctggtttagtcttgggagggtgtatgtgtccaggaatttatccatttcttctagattttctagtttatttgcgtagaggtgtttgtagtattctctgatggtagtttgtatttctgtgggatcggtggtgatatcccctttatcactttttattgcatct

SEQ ID NO: 1473 - DNA, 1064 bp, Homo sapiens
aagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaacaggaagaagttgaatctctgaatggaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggac

SEQ ID NO: 1474 - DNA, 1137 bp, Homo sapiens
tggaaatgtaagagttattttatctcttttttggaaggcaatctggcaatatttattaaaatggaaaatacacatactctatgctccagtaattccacttcaggaaatatatccctaagaaataaaagtactggtatgtacaaggatgtttatttcagcactgtttataatatcaaaaattacaaacaaaataatgcttattaatgggatgggtaaataaattatagtatattgcggcacagatcattatattactatcacaaaaagcactatatgaattagagggactttctgtgaggtactgttgaatgaggaaagaaagatatacagaagtatgtattaatatatccaattcttttgtagaacagtgaccaaaatcctgtgtgtgagtttatgtatgagtgtgtgaacctacacatttatatgttcatatggcagggcagtatgtagcaaaagagaagaattcatactcagtggttagcatgtttttagagagttataataatacaacaggagtaggaaggaaaagggaggtaggcccataccaggtaattagatgtgagaatggaactcaaagagcaagtcaagactcaagatttaaatttgggagtgaactatagaggcaatattagatgctaacaaaaccgaatgtaatggctaaccctttaacatctatctgtattttttgtcctatattttaatcagtttctgcttcaccttggtcagcaaaagctcagcaataggttttgtaatattttctgttttaactagctcaaataaacacatattaattgaaaacttctaacagcttttatttattcaacaaatatttcttgatcacctgctttctggcaggcattgttatggcccctgcaatgacaaataagacatacagggtccctacataataaataaataaataaataaataaataaataaataaataaatatataatgtcagatcacataaaagctatgaagaaaaagcattttttcaacggataataagggacagagcagggaagggaaaaggagaggaggtttaactattttggataaggtagtgaggaaaagttttctttcagaaggtgaatttgacaaaagagctgaatgaaatgaagaaccagcccaactgta

SEQ ID NO: 1475 - DNA, 1099 bp, Homo sapiens
taggaagaatcaatatcgtgaaaatggccatactgcccaaggtaatttagagattcaatgccatccccatgaagctaccaatgactttcttcacagaattggaaaaaactactttaaagttcatatggaatcaaaaaaaagaccacgtcgccaagtcaatcctaagccaaaagaacaaagctggaggcatcacgttacctgacttcaaactatactacaaggctacagtgaccaaaacagcatggtactggtaccaaaacaaagatatagatcaatggaacagaacagagccctcagaaataatgccacctatctacaactatctgatctttgacaaacctgagaaaaacaagcaatggggaaaggattctctatttaataaatggtgttgggaaaactggctagccatatgtagaaagctgaaactggatcccttcctcacaccttatacaaaaattaattcaagatggattaaagacttaaacgttagacctaaaaccataaaaaccctagaagaaaacctaggcattaccattcaggacctaggcatgggcaaggacttcatgtctaaaacaccaaaagcaatgagcaacaaaagccaaaattgacaaatgggatctaattaaactaaagagcttctgcacagcaaaagaaactaccatcagagtgaacaggcagcctacaaaacaggagaaaatttttgcaacctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaccacttttacaccattggtgggactgtaaactagttgaacccttgtggaagtcagtgtggcggttcctcagggatctagaactagaaataccatttgacccagccat

SEQ ID NO: 1476 - DNA, 1046 bp, Homo sapiens
aaaattttttttttgatctcacggcagcaaacttccaaaggcctttgatgtttgccattttgttgtgatagttaactaatctataatgtttgggactattgagttttgtgatttgacatttgttgtattggaatctgatctgtaaactagtagcatggcttgatgtagagctttgactaaagagactgagagaatgaagactaggaaatgaatttttactatctcttctcaaatgtttgtctaaaattagtcaagaacttcatttcattaaaaacgttaaagtttttttatttatatatgacctccaaaaatgattgaatattttttgaatacaaattctgtgccagtcagcacaccagctttttacatgattatctcatttaatccttaacacaacctcatggaatagatgttatcttcatttacagataaggaacattgggttcagagagagaagtattttgttcaagaccattttttcagctggtaaatacatgacagaggtaggactcaaaattcaggttttgtctgattccaaagcctgtgtgcttagtcactattataaaaacaaactcatagttcttgagtgagggaattatttaaggcttaagttacatttaccttttagtttaaaagacagtatatgtagtgactgtgtatcatgatgatccgtggtactgattattgaaatcattccacagaggtaggcatgtgcaggttgttgaattgtactattatagatcaattgtgcctggcactgttaacattttgaactgggtaattaatttgttctggaggactgtcctgtgtaccataggatgtttagcagcatctctggctacactcactagatgcgtataccactcccttgtgacaatgaaaaattgtcacgactttcagaaaaatcatcatccttctatctccaacagaagagtgaactcatgtttaacttcatgtaggtacagatgggatatttatcaatatgtatatagtacatagattaatagacacacatatttccttgttctgtcagctgacaaggtcta

SEQ ID NO: 1477 - DNA, 1104 bp, Homo sapiens
tacaggcgtgagccaccgtgcccagcctgtgtatcgctttggaatccctgccttgaaaaatcagaaaattgttcgggagtagaaatgaggagaggataggtagaggtttatttgtgcacaccagtatgtttattattttatatcttgctgaagaaataacccaaaagaaagttaaaatggtcatgtacaataacatatgttacgtaataattattttttttctaagaaatggttttatataaagaacatcttcccaagtcattggctattaagcaaactcctttattcaattgcttggaactatattaagaaaagtgttatagatcatatacttgcttttacttttctccaacatggttatttcccaagaatgtaactcctttccagattgatttttccattaggtaccttttaatttctatcattttttctgcatacaaaataaatcatgtgtttgattcatttatttattcaacaaatatgtagtgagcacttactagaatactaaatgccattgtgctaaatgctagcaataaagcagtgaacaaaacggacaaaaacctgtcatgaactataccttctggtgggagagacagaactggccaacttaaatgaataacatacatcgtgtgttagatggtgctacagagaaaaatgaagcagagcaggaggtggtaagatgtggtggtcaaggtttgcaattttagacagtgtggaagaaaagacttgaaagaatcaagtgagtaaactcaggatatctgggagaagagcattctagacagacagaactggaggtacaaatgcccagagatgggaacatacctagaatattcaggcaatagcaaggaaaccagagtggttggatacaatgtggacaatgcattctatgtggttggagcagagtgatggaaggcaatagaatagaatagtaaccaataagatcatttagataatgatgggcatgaggagggaagaatgtatataataaagcatcttgtaggtcattggaagaattttgatttttattctgaaatgagaaacgattatggggttttgattcaaagagtaacatggtacaacagtttttaacaggcttattgtgac

SEQ ID NO: 1478 - DNA, 1052 bp, Homo sapiens
catggaccacttagattcagttcatggctttgctgtttattggcagtgtaattttgactaagttaacttaacctctctgtgccttagttttctcagtctataaaacaaggagattaataatagatactcacagggttgctgtgatgattatgagttaacatacagaaagcacttaaaatagagcctgacacataaaaggactacattagtgctgctgtagctgctgtggcttattaggatttatactgaattaattctattgttgttttttgcttctttccaagactagcatcagaggtgctatacagagttaattgtcaattactaggggaaaagagttgaatatgttggttattttaaaatttatagcagaatgtggacataatagacaagaaatttgccatatttatgtatttggaatttttttagaaaggaaaggtgctgtttgaagaagaatataactttacccacttttcacacctttctgttttgaacaatggcagaaaacagagagaggcattctgagtcatctgactggatgaagactgttccaagttacaaccaaacaaatagctccatggactttagaaattatatgatgagagatgagactctggaaccactgcccaaaaactgggaaatggcctacactgacacagggatgatctacttcattgagtaagcaaatgtctctatctcttctaatgtgccctaacatgttgaggattgtctaagatttttttaaacctcattttagacacatacctttttcagaagactcattttttttctttctttaaaaatatttttcataaaactgacagttgatttttaatcagatttaatctgacacttcatttttatttgacttggataaaggaatagtgtatttgacttctggttttataagagcaggaggatcaaaaacagttcacgaatggtgaaaaatgtaaagaataaagggtattttgcttggctttttaaaaagcttttaggtagattgtccagcttaatgagatttcaagaattgtcatcatgagtaggagcatatt

SEQ ID NO: 1479 - DNA, 1051 bp, Homo sapiens
cacggtggctcacacctgtaatcccagcactttgggaggctgtggtgggcggataatgaggtcaggagttcaagaccagtctgaccaacatggtgaaaccccatctctactaaaaatacaaaaattagccagacatggtggtgggcacctgtaatcccagctactcaggaggctgaggcaggagaattgcttaaacccaggaggtggaggttgcagttagccaagattgcaccactgtactccagcctgggcaacagagcgagactctgcctgccatccccccaccccccctccaaaaaaaaactcacaggacctataaagcaatagcacagtaaagaaaacaaagtactaggtaacaatcaacatgatgactggaatagtaccttatatctcaatattaatgttgaatgtaaatggtctaagtgctcacttgaaagaagaagattggcagaatggataaaaattcacaaaccaaatatctgctgtcttcaagagattcatctaacacataaggattcctatagactcaacgtaaaagagtggaaaaagatatttcacacaaatggaaactcaaagtgagcaggagtagctattgttatgtcagagaaaacagattttaaagcaacaacagttaaaaaaaaagacaaagaaggtcattatacaatgataaaatgatcaacaagaagatattgcaatactaaatatatatacccctaactctagagcccccagattcatgaaacaattactattagacctaagaaaggagatatcaacacaataatagtaggggacttcaacactccactgacagcactagatagatcattggagcagaaaatcagcaaacactggacttaaactacactctagaacaaataaacctgacagatatttacagaacaattctaaccaagaactgcagaatatacattcttctcatcagcacatggaaccttctgcaaagtagaccatatgataggccacaaaacaagtctcaataaatttttaaaactcaaaatcttttgtgggcatttagtgctataaattt

SEQ ID NO: 1480 - DNA, 1013 bp, Homo sapiens
attatttgtaattatggaaaataccaagcattcttaatacctcaatgccctttaatctatctggaatcatctccctctccctaatcccaacttatttatttatttatttatttatttatttatttgactcggtctatcaccaggctggaatgcagtggcacgatcttggctcattgcaacctccacctcctgggttcaagtgattctcctgcctcagcctcctgagtagctgggactacaggcgtgcaccaccacacccagataatttttgtatttttagtagagacggggtttcacaatgttggccaggatggtctcgatctcttgacctcatgatccgcccgccttggcctcccaaagtgctggaattacaggcgtgagccaacttatctttaaagactgcttaaacatcagcttttagcaggctttcctgatagcaatcttaccaggcaattggtattcctctgcactccccaaaaaagattatgtttatctttatcttatcatttatctcttctgtcttcctgtctagactataaactccttgaagtcaagaactgggttatatttctaatttttatttctgcataaggatgatggggagaggaggatgagaagggaggaaggaaaaaagaataaaatgaataaatgaattgatccactaaatagtgtataaagttgctaggtattttagtcttgatttttattaccttcactttaaatgagcaaataataaccacttctttatctgtattaaattgccctgtgtgaaaacaaaacaaaaccaaacaaaaaaaacttgctaatggtatcagtggtaaaggtgtaaaattaataaagtaacccagaagataaatggctgcatttgtttgccctcctaaagaaaggactgttaatctcttagttgctaattaccttgagtgctaactaaaatgctaaatcaactttcaagttaagattaaaatatatttatgttgatcttttatccttactattagtacatcccttttagt

SEQ ID NO: 1481 - DNA, 1070 bp, Homo sapiens
ttcattgaccttgggcttcctggaagttggctttgaatttctaaatatagagaataagggggaagttgcctagacaattaatagctagagatggtattgttactactacagcctctaaagagaaagtcagttgatagaaaactgaaatgagggcaacagactagatgaattatcaaggtcatttccaacactaccactgtatccttctgaaagcagtggaagatctttagggcattataacataattatctgaagttttgaagcatacacctaaaggtgtgctctcttttaaggagttattcaaggaaaacttagtattctttttaggggtgaaagttgcttcttaggcagctgctatggttaaatttaaacataaatatatattggagaggagtgccagacacctgcctatgttagccagagaaattaagctaatatcaatgtctaattttgccttctcttttctttatctaattgctacaatgttatgaccattgggattgctttctttccagatgctaaacactgaatttgacctcaagcgtctagcagcaggcaaatacttctatcagaaacattactatttacctggagactaggagttaaacctgctgcctaggtagcaaagacaaaatgttattattacctgaaaaagtaacaaacacaatcatctttaattttataattgtttcttaatgtttcaacacttataggcataaaccaatgccatttcctggtagttatccctaaagtaagtatctctgactcctgttgcaactgtagtctttattctattgtgcaggttgttacttgagtcactgtggttagagggatttttggaatgacttcttaaaattaaatgtgtctcctaaggaaatgactcaattagattgacacttaagtatataactttagaatttcaatatcttggttcctttgaaagctatgctaattttgtttccattgtgttacttaatgtcttactgatactgtgatgtaaaaagtatacagcagctcttttattattattttttcctaagacttattttgttaaaggaagaaacaaccat

SEQ ID NO: 1482 - DNA, 1121 bp, Homo sapiens
attaacattctaaatttgatttctataaatttagaaaattccaaatctgattctagaatttgattcttgatttcaagatgtccagatcttagttagtagccatataaaactttcctgtgtaggatttttgtgagtaaacctgaacattgccacttcctgttgtttgttgtcatctgtcctctcatcaactctcacatggcagtactgggtacacgttaggtattttacaaacgaaagaatcacttagcaaggttgaatggctcaagagctgacaaaagcagaatttacaaaggatgcatagtttcatgttgttcctgtgaatgttctctgtctaggttggtgaccagattgttgaaatcaatggggaacctacacaaggaatcacacatactcgagcaattgagctcattcaggctggtggaaataaagttcttcttcttttgaggccaggaactggcttgatacctgaccatggtaagtaaagtagcccactagtagctgaaaagttgtatattagggaggggacagaagaaaaaggaatatatatttggagaggatagatattttactagttaattcagaggtgaatgctagaaccatgaaaagctagttacatagcagagttatcataaatagtattagaaaacaagtgacttaggcaggactttcgttggaatggaatgtattttaaatttaatcagaaaaaacatatagttgtttttgtagagaaatgtacctattaaaaaagtgtattagaggcaaacaatttaaataccataaaaaatgttttaaatctcttcaaaatatcccagctttttctcttacttagctaattacacattaccaaccaatatttttatttctgtaaagcaagataagtttatattataatgaatgcgcagcatgaaaacttaggcttttctggtgactcggcaaaaacaagttgctatcaccctacctggagacagggagttggacctgagaccatttctgtcctgtattaatgttaaacttcctgggtttccatggcatgttttgaaatatcatggtatttgaaagtcactgttttttgagtgcactattctagaaataaaggcagtaccacacccacgcagtacttg

SEQ ID NO: 1483 - DNA, 1028 bp, Homo sapiens
cagccccagcaaaggggaaaataaaagttgtcaggtcagcaccagggcaggctctggacaagatcagtgcagaaaaagcagaggtcggtcggccagcccaaaaaagcagcaaaaaattgaaggaagcaaagctccatcaaatgctgaggccaaattattagagggtaagagtcgaagaatagcaggctatacgggcagtaatgctgagcagatcccagatgggaaggaaaaatcagacgtcatcaggaaagatgcaaagcagaatcagttggaaaaaagcagaacaaggtctccagagaaaaaaatcaaaagaatggttgagaaatctcttccatccaaaatgactaataagactacaagtaaagaagtatctgaaaatgaaaaaggaaagaaagtaaccacaggagaaacaagttctagtaacgataaaataggagaaaatgtccagctatcagaaaagaggctgaagcaagaacctgaagagaaggtagtttcaaacaaaacagaagatcacaaagggaaagaactagaggcagctgacaaaaacaaagagactggaaggttcaaaccggaaagcagttctccagttaagaaaacactgataactccagggccctggaaggttccaagtggaaataaagtcacaggcactattggtatggctgagaaacggcagtaacctttagtataaaacaaagaaaaacaagttgtaatcttttcttacagcagcatttttccagaaaaagcctttttttttttttcagatattctgaaacagataagtacatgttaatgtgagcctcaagttacctaggctgcatgaagggcctttaggattgctaagaaccaactgtccccctggccggctgccctccctcgctctcaggaaggagctgcatccacatgctcatctgacccgccctgctcaggctgcccagctcgtcttcatgagtgtctgaacaaatgacatatgttgatattaacaatgtggtcacaactcactttgtatttgtgccaagttatctact

SEQ ID NO: 1484 - DNA, 1004 bp, Homo sapiens
aaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtgataacgaatcctatttttgttaactgtgacataactttgatgtcatatgttgtcctatgtggttcttcctaagtaaactctgtactgattatatactgacttagcaatgtggccttggaatgctgagcaaaatgtggatgtactggttgtaaatgtttatatattgtacagtacctttatatatacacttgaggttctgattagagaaagatctgtaaattgctcattattttttatatagatatttaaaaaaaacagtttatggcctgcatttcttttactgtcacattggtttaatgttgctttctaatggtggagctaggtcccatcatagtctgagtcctcaaatagattttgtccctccaagtaacaaactttcaaagtcctaaaatcaggaagagtcttataataatgattttacctctataggtatacttttatttatttataaatagagtttgaaattctttagagttgaatatcattataaccatttttcatctttcat

SEQ ID NO: 1485 - DNA, 2046 bp, Homo sapiens
gagcaaaggattactaaactagccagtacatgaatagattaggtttaatgaattaactcccaagtgacacactgtatttggaagagagactcatctagcctattatgagtgtgtagatctaaaagttttcacacataaatttcattaatttgaaagattatttttaaactgcataggtccacttgcctctaaataaaatgaacctaaaataaaaacaaactatactttgtgagacatcctggtatttagaatttttctacctgtctctgaaagtcagaaccatactccaatgaggcaagtatttggttattcaacttctcaaagtgtttatattatacatgggccatattgtacatatttagaaagtctgtagatcagcagtccccaacctttttggcaccagagactgatttcatggaaggcaatttttccacggacctgggggcagggagaagggatgcagggagggggtggtttcaggatgattcaagtgcattacatttactgtgcactttattatttcattgtaatatataatgaaataattatacaactcaccataatgtagaatcagtgggagccccaagcttgttttcttgcaactagacgtcccatctggaagtgacgggagacagtgacagatcatcaggcattagattctcataaggagcacacgacctagatcctcgcatgcacagtccacaacagggttcacgctcctctaagaatccaatgctgctgctgacctgacagaggtgacctgacagaggtggagctcaggcagtaatgcaagcagtgtgagcagctgtaaatacagatgaagcttcactctcacctgcagctcacctcctgctgttcagcgtgggtgtgggtggctggggacccctgtggtatattatacacccacagcaactttaggagagataatttttcccaatataactgcagattataaaattaagtcaacaggtatttttcttacccttctatggttattactattccaactaaatgtatgaatggcctaatctaattgtttttacatcttggtttaatttctcagtaacaagtaattatcaccaaaatctcattccttttttgaaatcaaaacaaaagcccaagttcctagaaattattatacagggataaatgaggcactgaaggtgggagaaccatgaaattacagttgatccttgaacaacatgggtttgaatggtgtgggtccacttatatacaggcctttttctgtaagtatattggaaaatttttttgagatttgtggcaatttgaaaaaacaaaccatgtagcctagaaatatagaaaaattaaaaagttatatagatactagcctattttatcatttactataaaatacacacaaatctattataaaaagttaaaatttataaaaacatacaaacaaactgtacatggcaccattcacggttgagagaaatgtaaacaaagatacagtattaaatcataactgcataaaattaactgtagtacatactgagctactataattattttgtagttacctcctgttgctattgtggtgaactcaagtgtcaaaagatctgtttaaaacaccatgtgatgctaatcatctctgtgtgagcagttcatctctccataaaccgtggatcacagtaaaaagtgatcccttgcggttcttgcatatttttcatggttagtgcaatactgtaaaccttgaggacataaaaactgcaggacccatatgaagcaccaccagtcatagaagtgctcccaagaagcacagaagagtcatgacattacaagaaaaagttgagttgcttgataccatagattggggtctgtggttgcccaccatttcaagataaatgagtccagcataaggaccattgtaaaagaaagaaggaaagagaagaaagaaggacggaaggaagggagggagggagggagggagggagggagggagggagggaggaaagaaaagaaaaactcatgaagcttttgctgcagttatgccaccaggcatgaaaaccttgcactttttgtgaa

SEQ ID NO: 1486 - DNA, 1066 bp, Homo sapiens
tcttttatcaagtaaaagtgtgtgtgtgtgtttgtgtgttttaaatctaagccttgtatcttttatccttgtggtctaattcttcctttctctcaatataggtatggcatcacagctgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcaaatttcaacatccctgcttacgaccagggcctcctcctcccagctcctgcagtggagcatattgttgtaacagccgctgatagctcgggcagtgctgctacatcaaccttccaaagcagccagaccctgactcacagaagcaacgtttctttgcttgagccatatcaaaaatgtggattgaaacgaaaaagtgaggaagttgacagcaacggtagtgtgcagatcatagaagaacatccccctctcatgctgcaaaacaggactgtggtgggtgctgctgccacaaccaccactgtgaccacaaagagtagcagttccagcggagaaggggattaccagctggtccagcatgagatcctttgctctatgaccaatagctatgaagtcttggagttcctaggccgggggacatttggacaggtggctaagtgctggaagaggagcaccaaggaaattgtggctattaaaatcttgaagaaccacccctcctatgccagacaaggacagattgaagtgagcatcctttcccgcctaagcagtgaaaatgctgatgagtataattttgtccgttcatacgagtgctttcagcataagaatcacacctgccttgtttttgaaatgttggagcagaacttatatgattttctaaagcaaaacaaatttagcccactgccactcaagtacatcagaccaatcttgcagcaggtggccacagccttgatgaagctcaagagtcttggtctgatccacgctgaccttaagcctgaaaacatc

SEQ ID NO: 1487 - DNA, 1048 bp, Homo sapiens
aacttgctgtgtccattggccctgggcatggctaaatgattcaggcagtggaaataatatactttactctctggctcactgtaaatgtgcacagactccaagcaaagctcctgtctttcgggcttgagttttagagacaaaggtttgccatgcttacaggctgaatgtttttccctactgaacaaactagccagcctttatttcaagctgaatcactttgttacttacggaaggaaaaggtctagagaaggaaaacgtatcttccatttatcctagacaaacaaataatctaatttcctctggcagtcaaaatatagtttcacctaagccactgatgcaggaagttaggttttatgtaacctctctaattggtaagtaagtaggtttgatgtctctgagataggaagaaagaaacgaaaatgttcatgaaaataatcagagtgatttgtgttaagtgatcctaaccttagcttgctctgggtgccagtgaaattaacctcaacaatgttggttggaagaatttttcaacttaaagaagtttgaagttggggaatcaaaaggcagggattgttgtttctatcacttagctgtaataaccagagcctgtttagtatttgttttttaaggatgggatgtgtcttcaaagaggagacttgccatgttcaaagcacaattaatgccattttcctactgaagtgaacactgccagtttttaacagtttctttcactttcctgtgcttctgtagataaccttttttactgcccagttgttggaatgttacagctggaaagggacctagaagagtaattatctaactctgtttccttattacacaaatgaggtagaaccagagttttacgtgtctgtagagtttatattgagggattaagaaataaggaggccaagaggaaagatgtaatgaaaataattctaataattataatctggattcacagtttaaagtattcagtccttagagataaacctgctctagtgatgccttactgttcagtaaagtagaaaataacttgtctttttgcttcgta

SEQ ID NO: 1488 - DNA, 1033 bp, Homo sapiens
cagttgtcccattgcagacaagagagagagcttcctgatgccaggctactgaatagaattattagtacctccgtgtgctcttgggtccagagaatataggctatcacatgagacactgaataaatgctctggttttcctaatgggaacacagaagcaagcaaaatttcacattcagctgtcctgtaatttctaagaatttgaagacagtaagtgtccaacaagatagaattttgccttcttttaaaccctcttgccactttaatatcctaagaattaccaatagctttctcagcttcacattatcatttctgtgcttgtttaatcccttcctacataaaactataaactcttggagagagggatggtgtcttagcatatttgtatttccagtcgttccttgtatataacaagagattatagttaaaatatttataatatttatttaagtgaacattttgaggatcctatgtggagatttgtgccaagacagaaaagaaatgggtgataacaggttattttcttctgatgtaaatagaattgagaccttaatgcttgcaaactacatacagatgtggactaattaatatgatgccatctgaggttagctcagtgatgtctactcataactattaagcctggtgcttttttaggtctcctgagcaataagactaagccagtcgcttcagtgagtgggcagtcatctggatgctgtatcacccccacagggtatcgagctcaacgcggggggaccagtgcagcacaaccactcaatcttagccaggtaagtgctatgggctactgccttctgtttgggccctgcactgttgttactttctggagaaccctgcttctggctggatgctgaataaagccaaatgaagccccttttgtgtcaaacaattttgtgttctatggcttacgtcgtaccgcatatgctgtgtctcttcattcactctgtaagtgtgttcaggatgtacattctaggttttccatcagacctccctaagtctaccctggaaggttagagaaacg

SEQ ID NO: 1489 - DNA, 1052 bp, Homo sapiens
cccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaa

SEQ ID NO: 1490 - DNA, 1050 bp, Homo sapiens
agcgagcttgtgctggagtccaggtaaggctttcaaataaggatgagaaacagaaggagctcggggcaggtgctgctggacggggcctgtggtgacatggcagagcccagctcctgagacagtcacaaaccctctggccataagaattgaatcacacatttcagctggtgggtaaacttaccagatttagttatgaaataccagaaacagctgttttaaaataccaattttgtttagcactaccaattcccttgtcaataccaggcttccctcatccacaccacaatgacagaagtaggaatttgggattccctgggtgcttggggatgaacaaagcaggttggctttgcagtatcctttgtgggaaccatctctgggctcttttgtctacactcgagttctgactttcacgcttcggggcccattgctacgctctgctatttccttaggcctcttggggcctccagaaattgatattccaatgcccttgtagtaactttaagagactgtaacttccaattaaaacaacacgcagaatttttaatgcattcttggacccatatagaaagtacttggcaaatgttaatacaagctgagtcttttaatcaattattcaaaaaatgttcctggatatctactctgagaaaagctctgagagaggagatgaaccttagagatttgtaggtgcactccatgggttctttaaaaaacaccactaccacctacgggtggtggattctccaactgactgcagcatagggcacagcaactgtggggtgagaggcaccatccctagagagcacgggctgtggtgtactttgctggggcctaaaggatgttaagcagtagggttgccccccacaggcatgagagcaggccccaggcccagctaagggtattttgtccaaggagtgttcctgtgaaggctgccctgctcagaggtttgttgggaacttgaatggaagggtaggaggcgggttggggttggagggggaccatgctctttggtaattttagtcagagtccaactcagggaggaataatgaaatg

SEQ ID NO: 1491 - DNA, 1037 bp, Homo sapiens
aaatctgtaatactttggctaaaattcataaagtaagccctagagaaaatacttgaccaccaaatttttgcccaactatcatcacctcccttcccccgcctctgttcttgccttttgacatctacatggaagacaagttctttacagcaaatggtaagaggcaggtgacctggtgtgtttgctgtgttgtagttcattgcctggggcttgggactccttttttaatggagagactagctgtgcaggtgtgtgttggatagggataaagtgctcacccctgccctctctacagtagttggtggtagatttctctctcattttgcctcataatcactttcgagtgcatgtatttacctaagggctgtagctctgtgggatgctaccagcatattggactgacagaaattgattaccttgccactccaacctacgtactgagtgagtgctccagccactcagtgaaaccaacaaaagtgagtccttggtttaccttccaatctgggtcctgctgtgtaagtatccctaagtggggatgcatatttgtttgtgcgtttttatttccatatatgtgagcatttctctgagtgtattaccagacggatagcacatttatatgtcagacatcttaacatctgtgttatctgtagcaggtgtgtagctcagcagatacgtgtcattgtgtatatagctgagtgtgtgagggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagccttactagatatttcttaaggtaacttaaaaattg

SEQ ID NO: 1492 - DNA, 1044 bp, Homo sapiens
gagggcctccggcgaagcaacccggcagccgcggcgcccgagggcctggcgctggtctggggctgcgccgggggcgcctggctctggggtgcggccggtcaggaatccccatcctggagcgcaggcggagagccagtggctgggggcgggaaggcttcttggacccctcgcgcttctccgaaatcgtaaagaaatgactaaacaaacgtgggggagcctttaaaaagaaaattgactccgatgccctcgcaggctcccggagcaccatctgtcacgcagacagccacacacataggggacctagggacacggcgacgtgggatcagacaatgcgcccggcagtctggcgaccaccttgcgggaaaatgccggcagccgggccgctgagggaggagaggatgcagagggaagggaagagaagggaagggcccggggcggggcaggcggggactagcgggtgcagcgcgtgttgtcccggcgggagctgcatctctgccggcaaagttcgggcgctcccggaaccggagctcggcaggctgcagctgtccccgggtggcctggccaagtccgggcatgtcggtgcttagccttcctctaacttaactgtgccctcttggaaacgccacctggccaggcttctctggggcgcctggagcactggcccggactgtgcgccttctgggagggggccgctcagaaccgctgggcttccgggtaattcgggcttcgagaaagggcccggcaggaggagaaaggcccctgcaggggctgcacgcaccgcccctgggcgtcgggagtgaggaccaggctgagaactcggggccccggcgtgggcagcctccacgacgctcggcacgggagaaatccgcgtcggcgacgtataggagcgtttgcttctagagaaacaaaagcaaggggatgggtgatcggttcccagcaccgcacttgcagaggagcgaattgggccaaaacagctttaatttccctgcgaggaaatcaggtcctctacggcaaaataaaaacaaatgctcccagagagctgca

SEQ ID NO: 1493 - DNA, 1033 bp, Homo sapiens
atatatataaacagtatagaaatataagaacatggagtagaaagatccacacccaattcatgagattggttgcctcttgggaaggaagggaaggggtgggcttaggggagggtacaaaggagattgcatctgttatcatttgttaattgtgatagtagtttcatgaatcttattttttgcttttccatattaaatatttttaagtgaaaagatggtaaagggaagaagatatgcatatctaagagagaatactatagtttgctgtatgagaataatggttcattcttttttaaaaatcaatattcctttgatcaattatggctgtgaattgtggtcctttaaacacaggagggtggggtagagtgagttttattcagcctgttttgttaaacttcatgtagaatgctatcacagcttaccttccctatctgcttatacgtggcaccatgtccctccacaggaaattcttaggtctgatgagatatggctgagatcatagctggttcttctaacctccctggcataagcaagtgatgaagttcacaccataagcattagtgaagctcttgttcagttataaaagactaactgtcatccccaggatgttctcaccatcactgaggcttcagccatgatgagaacctatggtcttactaagaccctttcatgagtccaaaacatgtggccatttaccagggctctctgtcagtttgagcaagttttatgcagctcctactgtcaaattttatttcaattagccctcacacagtggcctggaggttgggtctcctgagggtttatggtgatctgggaacttttgcctttcaccagtttaggtgggtggggcaaagagacaaacacagtggtttggtcaaagaaaccaaacccacactggcccccacaccctcaggaaaactgttgttgtccatagacagacactgccccctagtgtaaagcagataaagttgttgatctattagacagattttcctccagggaggctgtagagatacaggaggcctccagaagggtt

SEQ ID NO: 1494 - DNA, 1047 bp, Homo sapiens
cccgggttcacgccattctcctgcctcagcctccccagcagctgggactacaggcgcctgccaccacgcccagctaatttttgtatttttattagagatggggtttctctgtgttagccaggatggtctcgatctcctgaccttgtgatctgcctgcctcggcctcccaaagtgctgggattactggcatgagtccagccaatgtagatagattaaaatgaggaagaaacagtatttagaggcaccagttactccgggtgtgttagtgtgtctcaaattttacacaaaaaaaaatagctagtattagtaagtcaaccaacaaatatttattgaatacccactttgtgctggacactgggcatataatcctgtcttcatgattatggtcttgcttatgtaatgcttttgattgagtcaattaggtaactgagtactaaatgcataaaaaaactaaaggtaatggcaacaataaaataatctttgattcctcccctccctttattttctccgaaaaaagctctggccccaaagttaagtggttctcgttctcatcctggttttgcaattagtgttttatataacattgaacaatttacttaatcgttctgtatctcatttttcctacttaaaaaaataaacattgtactgaaccatgacttcacagcacaaggtattgtgatgagataatttataggagacttttttggtttcctgagaagtattataagagctcttaatggtgttaatatgaaattactttaaaaaccttcacttcttgaaactttaaaaatttcaatcccctagtgcattttagtcatttttctaattataattacattgaaagggggaaaaaaatccagccatctgtggcacttgttctccttccctagaggtagagctagagaagataatgatttatttgagatgttgttattcccactctggtagacaatggatagtggttgctgtttgtggctttaaggcccatctgctgatgggtgcaattttattaggcaaaaatatgtgggtgaatgtgtgcatggtagt

SEQ ID NO: 1495 - DNA, 1030 bp, Homo sapiens
aataataatgggggactttcagtactccactgacagcactagacaggtcatcaagacaaaatcaacaaagaaataatggatttaaactataccttggaacaaatggacttaacagatatatacagaacatttcatgcaacaaccacagaatacacattctattcaacagcacatggaactttctccaagatagactatatgataagccctaaaatgagcctcaataaatttaagaaatttgaaattatatcaagcactctctcagaccacagtggaataaaactggaaatcaactccaaaaggaaccttcaaacccacgcaaatacatggaaattaaataacctgctcctgaatgagcatcaggtcaaaaacaaaatcaagatggaaattaaaaaattcttcgaactgaatgacagtaatggcacaacctatcaaaacctctgtgatacagcaaaggcagtgctaagaggaaagttcatacccctaaacacctacatcaaaaagactgaaagagtacaaagtggcattctaaggtcacacctcaaggaactagagaaacaagaacaaaccaaacccaaacccagcagaagaaaggaaataaccaagatcagagcagaactaaatgaaacaaacaaacaaacaaatatgaaagataaatgaaacaaaaagccagttctttgaaaagataaatataattgatagatcattagcaagattaaccaagaaaagagagaaaatccaaataacctcattaagaaatgatacaggagacattacaactgacaccactgaaatacaaaagatcattcaaggctactatgaacaccttcacacacataaactagaaaacctaggaagagatggataagttcatggaaaaatacaaccctcctagtttaaataaggaataattagataccctgaacagaccaataacaagcaacgagattgaaatggtaatttaaaaattaccaacaaaaaaaagtccaggaccagacagatttacagcagaattctaccagacatttaa

SEQ ID NO: 1496 - DNA, 1061 bp, Homo sapiens
atgttctcactgatatgtgggagctaagctatgaggacgcaaaagcataagaatgatacagtggactttggggacttggagggaagcggggcaaggaataaaagactacaaatagggtgcactgtatactgctcgggtgatgggtgcaacaaaatctcataaatcaccactaaagaacttactcatgtaaccaaataccacctgtacctcaataaattatggaaactaaaataaaaataaaaatgaaaccacagtgggatgccacaggacactgattaaaatgacaaaaattacagagaccgcaagtgttggtgataaagaggaactgtaactcatatacattgctagtaaaaatacaaaatggtatagacacttcagaaaatgtttagcagcttattttaaagtgaaatatacacttactatatgacccagctttactcatgagaagtggaaacctagatccacacaaagactttgatgcaaatgttcatagtggatttattaataatagccccaaactggatggaactcaaatgcccttcagctgatgaatggataaacaaattgtggtatatcaatataatggaatattagtcaacaacaaaaaaggaaagaactatgtcctactgtgctgagtgaaagaaaccacacacaaaagtctacaaacagtattatattattgtgaaatccttgaaaaggtgaaactatggtgacagaagtttgtgtgtatatgctttttataaaaagccagagggaagcaaaatgcattgtgattcttaccccatttatgtatcatagcagaggacctgtacctgtcttaaagatttttaacatgtgaacaatcaaaatgaacaattttcttgtaatcacacagtgaatgagtggatgtgaaagttgaattttttgccattttgggtcagtgaaatgtgactatatcatactaagacattttttgctggtgatcccaaatggtatctggaaaaccttccagaaaaatagttctgaaaatgatgtctgtagtagtcgcatcattggaataaatgtataacctccttgagtta

SEQ ID NO: 1497 - DNA, 1071 bp, Homo sapiens
aatactgtcatgttttcttgcacactgacttctggtttccactgtatcagtatgtacctttgtaattgttatttttatgtcttttatgcccttgattattagttgggctcttcataaacagaggccatctctactactgtttatttttccctgctgtgcccagaacattggcgtagacacagtaagaacctagtaaatattactgtttctagccatcagggagattgtggaactcctcccagtataatttttacaaactccaagcaaatctgacccaaactcccaaattgtcaagtcctgcttaactttctctggaaaatagaccccttctcaacatcagaataggaagagaggaagaacttacaaagacacttaaaagttattcttaaatggtggttgggcatttaaaacagtgaactaacatatatataatttttgattagttggagctttctttgtattataagagtaatatatctcattacagaaaatttggaaactataaatttagaaacgtatcacccatacgtccaacatcgaaagaaaaccagtgttatgactttgttccatttgaagactaattgggagtccatctctctattggcactgggttcgattgcctctggctaatagagttcaattagttctatccctgggtttcctttcttagctatggggtggaagataggagggggagatctacaatttgaatatgtgttacttaataaggctaggctggccatcagttgcttatttcagatgtgtcactaaattttccttctagatggtccttgagcaaaacttaataattactgttttttatttccactgcctttataaaatcaaaattttctccttttgataaaaactgttgaatactattgatgtagagaatgtgtatatgtgtatatttgcattgattaaattattggaaaacttttcattgacaggtaatgtattttggttgtgcggatggtttgtaaaaagtatcctgtttttttaattctattcaaaattaaaaattttttttcctaaaataaagcaagaaaaataaatgtaagatatataaga

SEQ ID NO: 1498 - DNA, 1033 bp, Homo sapiens
cccaggattttaactcaaggctgtctgattgagaatgcggactcataagcacaatattgcactctaagttaataatgtaaagttagtttcattctttcagtagggaagatggaaggctgcagaatagggattttgatagcaaaaatctcctcattaaccccaaaaggaagtggcactggcagggccattctgaagcctaccggtagcttcagtattgttcttaatgctcttggatggagagaatgtatcttgagccaatgtattaatagtagattgctttgcttatgtagtaggcaatatatgggtatacattttcctgactattatcttaatgactattccaaattatgactaccttaaaaactaccaaaatcccctgctccagaattttcagtttcagatgaggttcataattcatggcctcacttttcccacattctcctacaggttggacgtgataagtatgagcctgcagctgtttcagaacaaggtgataaaaagggcaaaaagggcaaaaaagacagggacatggatgaactgaagaaagaagtttctatggtaagtactaggaggaatattgtattccatccttattaaaaatccatgatttttaatcccccaggcctcactgtattcttcaaagaactgctatatattaaaagagatcatagcagctgtacagatctcatctagtcgtagaggttaatgttgaacatatactttttaaaagctgttagagggtaggaaaagttattcagtcactctggcataaccagagataacagaaggaacttaggttgataccatgagtctttgcttttctctgtattatatcaaacattgggaaattcagcctctccaggcgatggaagcttccatagacttaacctgtctagaatcgacctggtcatcagagaaggcagataaggttttactagatccctgagagctgctgggtttctctgaagtgttatggcaaatagtaatgggccacggtcactcagctttagccattctccagtgaagagctgtc

SEQ ID NO: 1499 - DNA, 1012 bp, Homo sapiens
ctcttaatttgcaaaactgaatggatttgtgaaaatagatacctttttggcagaaatgcaatttggcattaatcccttgatctaaaacttagaagaaaccaggctgaattcaaatttattgatggatcaatttaaagagttttaatctgggtgttatgagttccttgggcctattgtttgcctgaaccctgtggggactggctcatcagcagaattattcatggaggaatttgctaggttttaccttggctctctagcttgggacattttgtttcttccttaaatccttattgcaaccgtccagctaccaggtaggtatattgccttgtaagtgctggtacagtttgccttatttatattccactgcttctcagggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatgtgagttctgtaattcagcatatggatttgtagtacacatcagatatcttctccgtctttgtctcccacttcttctcaattaccactcattacttaatggttatgaactcattacttaatggttatgaacagctgttgccttcaaggctcatccattcttccttcgtttccatttcctctctctaccacccacgttgtagatgctcttacaagtgggatgcccacctgcatgtgctgctgtgagcaggcagctctgctcaggccccggccgccacccactggatggcagagcacagcgattcatgttggcacatccacctgtccagaaatgcttggtggccattcttcaaaatccacaagttggttgaaaaacaatctttgttttataaagcaggagaaactgatgcatctagaacctttccaaacgtccagtt

SEQ ID NO: 1500 - DNA, 1049 bp, Homo sapiens
cttcaaaaacatggtccctcaggtaccagacgctttgtccttccccagtggatgacttgacagccccaagcatgtcagcctgtgaattagtgtgaagttaaggttttccaagtattacatgactcatcagagagatggatgtcttctaccccacccaaaaccaacctattttccttctatccaaaaagtggtagcctttcttttgaatgtaaactctgaatacaggcacaccatgtaacagcaatatctcttaaactggcgagcaagcttttgtaacttgtgtaaataaaaaagtgaataatatctttgttttgtattcaggtaattaggattatgactatttttattttcttgttttggacactaccttctctttgttggtatactaacggtgtaaattgtttcttttccaaagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtagctcttttattttaacaaacctcatagctagctctgctgttcgggcagcttgatttgaggggtacagtagcccatgataaggctggtgtattcacatgacatttttcttcttttcctcacatataggtggataactcctcgctcactggtgaatcagaaccccagactaggtctccagatttcacaaatgaaaaccccctggagacgaggaacattgccttcttttcaaccaattgtgttgaaggtaggccatttttgggcactttgagcatggcgtggtatttctcttgggcattaacaaaatcaaaaccataggcacaatctcttgttttattggctccatttctgagaacttgtgtcaagcacagagcagaggtgttttcctagctggcaggaaaccttgtggcagtttcccttccctccacctccaccctgcctcttctgtcaacaacaccagtctggcatgggtgttggagctgctgtcctgctactggag

SEQ ID NO: 1501 - DNA, 1767 bp, Homo sapiens
gttacactcttccgctatcctattctaaggtattgccaacttatgttttattctggatgtttgatatagttcttcttgagagccacatcacgtggtgaattttgacagtgagaaaacctcagcatttgtttatacgtaagataaccccaaagcatacattttgcttttaaattatcacgtggtcctgaacagtgcagtggagaaaggagaagaacttgggatcaagtagggggatagaatatggtagaatcctgttattatttttcttaatagattgcttttctggaaggaaggggaagcctcatgtatgggttccccttattatttcttcaaacttcagaagaaggttggagagatttaattttagacaaatttcttccacattaggatatagcaagaatctgtatagaattccagcctggttgagtgaagtaataatcttcctaatattttttaggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtaaggccagggttaccacacacctcagccacctgctgacttcgcttggttttttttcttttaagaaattgcatgaaatttcttttttttttttaagctcatggcagctttttctttcttttttgttttttttttttttatcatttagtgaagagtcaagggtatgggatattgattttttgcatgtcagtagaaactttaaattgccctacaaacgtgactgaagaatgcctaaaatgtgattggtttcattaattgggaaatgagatgtatcactgcagatttctatgggactttaataggagaactgagaacacagcctttgaagttaatgcattgttgttctgttgtgttttcttgcctccatcaggtgtctcttttgacaagacttcagctacctggcttgctctgtccagaattgcaggtctttgtaacagggcagtgtttcaggctaaccaggaaaacctacctattcttaaggtatgctcaagagttaactaatggagggatgtagacagcacatgagaactgccatttgagtgttaaaagtagcaaattacctttgtggtctgtgtgactgttcactgtagaacacctggagtggtctgtgcagtactttgctgtgtgtaacttacattgtgttgcctgtagatcctgatgtattataggaccccctgctccatataggttgattaaaaagggaagatgcagtaaaaatctgaccaaagtgggaggggaggagacggaagacagtctttattggtgaaaaacctaattcatctgcttttactactcttgagtttatatgttatcacctaacctagtggacagtgagagctgagggctgcagtgactccataatcgtatttgcatattaggatacagtagattccagtaactcctttaagccatttattttcctgaaatagctcagcttatcttatcttattggttcttagcttgtttactaatgatgtaaaaataagctccaggccaaaataagcccagccttagcctgtggaattctgatgcagtttgaaatgattgagattttactatgctgcccaagtgaagatgcagtctcagaaggatcatgaattgtacaaagtcc

SEQ ID NO: 1502 - DNA, 1046 bp, Homo sapiens
tgcccttgattaccatagaatgccataatttagttgaatatcagcaggataaatgaagcctcttgcaaaacactgttgagcccttttgaatacttgtggtttggggtgggtgtgggcatgtggggaggtggctggaggtatgtgtacacaagtgttccccaatccctgtgttctgaaatttcgtatgttcttttttaatgtgaacaaatgtcaggaatttatgaatatatcatagtgctcatttttttttttttctgtagcattcaaagtatgttacaggtgtaagatacttcagagttcagaaagaagggatcttgggtcttttatagcaaatactaaatagtaagtgaagctttgttttccaccatggactgccacacatccaaccatccaatgtttatgtctcaacaatccttcacagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtatgcagataacctggtaacagagtgcctgggcacgtttttatccagtaacctagtctggtagacagttaacaagtgatcctatgaacctctatgtcttgttgaccttcctctacatcttttaggggcaatcctcctatttgtttatttgccccctattattttgaaaacaataagtgctgaagaaatgttcagcgtattgggctgtgagaaacaacgtcctgatggtttgcttctgacttgtacttagacctttggtctcatgctagtcagttctgtttgtttaaaaaaaaaaatggtggaagaatatctttcttatctaacctttgttgctgtggacatgacttataagcctaattaaagttaattaattcttagtgtgtctaagttagacatactatttcctgactgccttggaatgggtgtgaattt

SEQ ID NO: 1503 - DNA, 1048 bp, Homo sapiens
ccgcctcccaggttcaagcaattctcctgccccagcctcccaagtagctggaattacaggcacccgctaccacgcccagctaatttttgtatttttaagtaaagatagggtttcgccacgttggccaggctggtctcaaactcctgacctcaggtgatctgcccacctcagcctcccaaagtgctggggttacaagcgtgagccaccacacccggcctactctcaggattaatactgccctgaaaagctttgtagaagttatttcctcaccattccgactgcttctttttaaagtatattctaagtataatcactgcatcaaaaaataacaattttgaattcttgtcacatgttgcttttcctccaagttgtgccaatttgagaatgctagccagtagcatgtggtgtcttcacagtcccaccagcatcagatttttatcctttttttttttttttttttttgctggttttagtaattttcaagtatttttatgtaactctgtagaaggaaaaatagacattgtgtatgctagtgattgtataccaagataaaacctgagtattgcctttgtgtttcctttctgtggatatatatgtttatatttttggctaatcgatgtttattagttttatatttgcattcctttccttttgatagtctaagccgaatcatccttagtatttactcttgcctactggatataagactttaaggtcatttacttggcagttgcattcaacacattgtcttgtttattacaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccaggtaaggcaggaagctcaaatcacagtctgctgtgaacaagcaaatagtgatggtttaaaatcttcagcgtggttctataatggtttgcatctaggcttgctctgagtaggaaatgtacctgcactgccagaaagcaaccttgtcattcc

SEQ ID NO: 1504 - DNA, 1506 bp, Homo sapiens
gtgctcagtgggggcatgcatcgcactatttccatcgctaggaaaagtgattggtattaacccgttttcccttttctggggtagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtgagagctatttaaggtgtacaccaagatcttattcagatactgcccattagcatccatttctgtatacttcttggatatgttcagtttccagtgtgcttgtctcataagctaacagtaaaaaatcttggttttcataggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggtgagtgtcacaacagtcacagatcgatagtagtgaggtgtgagctgtgtcttcattcactggcactatgctcccagcatccatgaggctggcgttgggaaaagaaattctcaggaccagtatccagtgtgtgtcccaatcccggcttcacagaatcagtattaccactcttcaaggcagcagttaacatttgtttatcagatgggaatctttatttttgtatacttcacctaaaagatttttaaatgggagggcaagaattttataacaaaaggttcacaatattagcttccttatttttagtaactaaattccttctccccaccccttcccaggttcctgccatctccctggcttatgagcaggctgagagtgacatcatgaagagacagcccagaaatcccaaaacagacaaacttgtgaatgagcggctgatcagcatggcctatgggcagattggtaagctgcagcctggagtgggaagctggcacatctaaggcatctgaggtgatggtgtccacctcaggttgaggttgatttcagagactgcaaatccaggcgactttcaggtctaggatgagccctaacggagtgagcctgtggagtttctctgaactctcttccatgtgagaatacatctgttgctgtttgcccagttaccttttgtggaaactggttttctatactgagcaccttggaactgggctcaactctgcctgagaaatgaggatgtccttcctcactgagccttgcggaacaggaggcatggttctaaggaattgtgtgtactgacgcacaggctgctttccctggagatacacacttatctgtcactcacttggatggagttaggcattggagaaagtatatgtgtttgagagtttggctggtaggtcaccaccaaagggtgatcctccatccacctcacactggacttctgcccccacagtgcagcatg

SEQ ID NO: 1505 - DNA, 1250 bp, Homo sapiens
agggtcctgaaggtggggaggagagtcagaaagtgccacagtggctagaaaaatggcagcatgtaggaattttgaaagatggaaaagaagttatcatttgtcagagattaaaaagtagggaagtggatttcccctaaaggtcatacccttagaagcagctggtcaagtaacaggtgggcattttgagagcaaggcacatgtgtctttgtgtaggctccaaaaagtgactcaaaaagcagagggccctgagattggagtgtatgcctggggtcctccatcccatccctcatagcctgtgagtgaccaggcaattctttcctgtgcttttatcaaccagggggaaacactcctccatatgtgctctcccaggcctgctgcagtaatcagctgaaggctatacaggtacccttgtgtgtgaggttctagtaattgggttgttttcccaacttaggaatgatccaggccctgggaggcttctttacttactttgtgattctggctgagaacggcttcctcccaattcacctgttgggcctccgagtggactgggatgaccgctggatcaacgatgtggaagacagctacgggcagcagtgggtgagtgggcacctctgacctgaccagtgtcagagctcctcaagccccagaagactgaggccacactgccaccagccatgcaggtgaagagccagagctcatcttctgtcttctgcatttcagacctatgagcagaggaaaatcgtggagttcacctgccacacagccttcttcgtcagtatcgtggtggtgcagtgggccgacttggtcatctgtaagaccaggaggaattcggtcttccagcaggggatgaagtaagtaatgaaggacatgtcaaggccttggctcaaagaaggggactggtgatttgtaaaccctttgccaaaaactaaacatatgacacatatagccaggtttctggaatctctagtttatagagcaaatttaggaagcaagaaatgtagctttctagttttttcatctgacctccaagttttcaagtacagctaatacataaagatgttgatctgccattttaatgcatagcattagaagataaacctttatttgcaccttttaagttttttctcccctactttgattttaggaacaagatcttgatatttggcctctttgaagagacagccctggctgctttcctttcctactgccctggaatgggtgttgctcttaggatgtatcccctcaagtaa

SEQ ID NO: 1506 - DNA, 1292 bp, Homo sapiens
ctggcggtaattatgggcattctgactttggttggaggaggagtgggaggggctatagttctattggttttttgtttccctcaaggtgtctaggctccctcagtggtcagtctgattagctaaggtgactggaccagcaaactgaccatagtcacatcttcagaatgtagatctcagttacagtttgaggactggtcatgttttagactttaaaatacaaaccaagtatgatttagtgaaaacttgtcagaatctaaaccatctttccaggtaacttggtattcctaaaaacatgtaaataagtacagttgaggtcccatgtttggattttaacacacccgacccccatcatcctccggttggttttcatccctgtttccctctgtaatgctggagcgaggaagactcactgtagtgtgtcttgtctgtctctttgccacccacaggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctgccttagcatctggctttttgatggaagagcacctcgcctaaaggatttccagaccctcagagtatactaaactgcagatgaggcccttctctttcagtctaaaagagacctgaagccttcctgctttccctccagagatcaccaccacatctcaagtgtctcta

SEQ ID NO: 1507 - DNA, 1155 bp, Homo sapiens
atctctgtctctgacccccctttcaaatgccttcctaacaaacacttctgaccacatacctttttcagtatatgggtcctcactgatatgttcaacttcttaaggtccttctcagcatttaaattgcggtcttatccctctcacatcctgacccctacccctttctctagctgtcaccctccctcatggacaaacttgtagaagagtcactgccactcctcctaattgttcacctcccagtcatccctctgcctcttccagctcccatgaacaccagtccaccaaaattgcctggttgaggccatactgacctcctgatgcatcttggtccttccttgacctctgctgcatctcttctgtccatcacacccttcctgaaaccagacctcccgtctttctgtcattgtctctgtgcactccttagctctcagccccctcttcacctgctcgacccctcgtttcctcagggaggcctccacaccttctctccctgcttcatactcttcctggcatgatttccagctctgatctggtcctctcctgagccccagatgtacaaatccagtgtgtcctagacatctgcatttgttcagaaagagcatggcacacttgagtcttagtaccaatggcgagcctaagtttgaggttccacaaataaatatgctttaggcagtgatgacatttggcaccctactgcccaagcgagaaaccggaaaggtgggtgagccctctcttttcctgctctgccccccacccaattactgtggattccaatgttgtggtagagaacatggactttgcgtcttttaacagacacagacagtgtcccatcactggctgatgaagggcacataatttagcctctttgtgcttcctttactctagaatatttcagagctgttaaaaggattaagtgaaattatgcataaaagggagtctcatagtggctgctgttcaatagttcattctctctactgccggtgtcctttacatctgggtgctggaagcggctttttggtggtatccctaatttttgcctttctctattccggtagttctcaaagtgtttctggaccagcagcatcagtatcacctgggagcttgttagaaatgcaaattctgatgcagacctattgaatcagaaactggaggtga

SEQ ID NO: 1508 - DNA, 1030 bp, Homo sapiens
ctcctttcctttatttacttgatgttttaaaaggtcctcatcttattggggactcatctccttccaacttttctataagtcaacatactgtttcatctttatcgactctgacgcttggccaggtgttagctcatcaactttccgtgatgatgtggttctgcacacagtaggcgtgcagcaaaaaaatactgaatgaaggaatgaagtatcagactgtagttaaagtgttccttaaagggcatgtgaacccagagtcttttttaatttaattccctgcaagccaaactgttaaacaacactgtactccttactgagcctcatcagggaagctcggcatagacccctcatcacccatggcttctagcactgtgtctacaaatgagaagggcaggcttaaagtgttgttggggaggaggggtggatgaggcaaaggaggagcagacagtggatctagggaacagtcaaataacgggagagaggacagagctgcccaaggaagggagtcgggttggtggggagtttccccaattatctcaggtgccttttatgctcatatgcaagtttaaacacaatatgaatctcccattctcttaaactagaggctaaaaagaggaccaggtgttcacacagaacttggcagatgatgttggccagtttgaacgtggagaggattgaaaatggctgagcagggagggatgctgagcggtgcttgggcctctagcagctgctaattttatagaatgcgctaaaataaaccttgtggatagatcttgcctcagccttttctatctctggtccttggacagagaattgtttaagtcatttcatgtttattgagttattttggttaatcatcagtacagattgcctctaagtggtttttgcatcttttttttattatcgcttggtcacataacttctcggaacctcagtttccttatttaatactctcaaggttgaatattaaatcatatgaacaggatttgcaaactataaagcaatgctatgcatgtaaggtgtcttttttttg

SEQ ID NO: 1509 - DNA, 1024 bp, Homo sapiens
tgaacaactactattttaccaggtcctgttctaggcactgtcattcagcaatggacaaaacaaaaatcactactcatatggaacttacattctactggggaaaaaagaaaaagaaaacaaataatagtgaaaacataaatgttcataaagtattttagtaataattgataaggagaaaatttggcaggagcaagaatggggatgtgccactttagggtgctcaggaaaggcctcattgagaaggtgacattagaatatggatctgaagctggtgaaggagctagtgggatgaatgtctgagagtgtcctgggttgaggaaatgtgcaagggccctgaggttgcagtaggtgaaaccttgggagcagagcatggctggagtatagtggaggaagaggaacagacaggaagtccaagaaacaaaaacggccaggtcctgtaaggattgcctctataaggatttcagctttcatctgaatgagatgggaagtgattggagacctttgaacagagtaagatataacccaacttaaatttttcaaagatcactttgctgtattgagactagagaacaagaatggaagccaggagaacagtaagggacactgcagtaatgcagatgagacgggtgctggccggggccagggtgacagcactgggggtggctgatgggttgattttgtcctataggtgataaggagccattaaagacttgatcagtgaagggacatcggatttgtatgtggaaaatatgattttggcagccctgtggaaggattggagagttcagacaaggagatgaatcagtttctaaagctctgatcactaaggataaagatagagaccttacaaggatgcagtctcatgcttgtgggtaggttgtccaccctggccagcttcttgacaagggataggaatggaaaagattaacacattaggaaattcctctgtaaacctagccaaggaagcaaggtgaatgactatgatcaggtttatcctagaggtggcctgctcagcacataaccg

SEQ ID NO: 1510 - DNA, 1039 bp, Homo sapiens
tgacctagctttctctctccgcagtgctggccgactccctgcacgtgggccccagcgcgcggcccccgccgagcctgagcctgcgggagggggagcccttcgagctgcgctgcaccgccgcctccgcctcgccgctgcacacgcacctggcgctgctgtgggaggtgcaccgcggcccggccaggcggagcgtcctcgccctgacccacgagggcaggttccacccgggcctggggtacgagcagcgctaccacagtggggacgtgcgcctcgacaccgtgggcagcgacgcctaccgcctctcagtgtcccgggctctgtctgccgaccagggctcctacaggtgtatcgtcagcgagtggatcgccgagcagggcaactggcaggaaatccaagaaaaggccgtggaagttgccaccgtggtgatccagccatcaggtgagctggaaacgatgcgttataggtgatgttattttgtgactaatgatagtgatacaaagaaccgggccagggagccccatggccttctgacaagaactgtttctgcttcccatgtgaggccttatttttaggggtgaagggagtagggtgttgagaggttggaggtgggcggggttacatttgttttgtgctgaggatgcctgtcgttttgcttcgcagctgcttttatctaaattcatgtccatggaaagccacagcctgcacataacacgaaggcagatctttcactcagagttgaggtgctgtggtccctcagccagattaggtaggacttggtgttcagtggagctttggggtgaaggtgccacaccctgcccctaaactttatcgggtttgatgtttcctgagtcctttgacgtgcctttctctgcagctgttggagtgtgtgcctggctcatcccaaaacctttcatctaacttgtatcctctaggcctgcctttcggtcccctcagatgtgcttttcctggaagggggaggagctctctagggcagggccgcttcttgctttcctgtatcatacagaccacaggagcatcc

SEQ ID NO: 1511 - DNA, 1017 bp, Homo sapiens
gttgtcagcaccaaaagaagatttttcatctctggagctgaatttgtctcacagctctgatccttagtgtattgtatggtgctgtcaaatcccagcactggctctccgtacccgctcccccttcagcttctgaatcccaactcgaggacttttttttttttaattgaaagtgctgcttgcactccaatttgaggcttctttgaagtacgtgtgcattgatcccggcatacccggggggagatgcagggactgtcagacaacaggagcggagctctaggaggaatgggctcctttaactggaagggatttgttggtagctgtgttctccagagagtgaaaagaaataaagagactaaattgtggaaaaggctcagttactatccaaaggatcccgtcatttgttttcctttggagtgctactaccattgtgaaagtcatcagtgtgcttttcctgactgatgctaacagatacagaacctgcaccttccctgctgctttgcatgtaataagcactcaataaatattagctgaacgggtaaataaaccagtacccacacatggattttgttaaaatatgtgcataggaaagctagaattgctaagaaagcagtaatgttcaactcctaggatattcagagatatttgcccctgagtaaacctaacgaaagagcgagtagtatgaaaaacaattgcattcttttttttttcttcctcttaagacttctcctccttccctgtgcctatgactcagaccattacagctgcttggacacttgtcaggagcgggtagggcatgagcatagcagcagacccttctcaaagacttccccgctggactctgtccagaagccagtgagcctggcctgacactccatggttgtctctagatatgtaatgtgcatgtatatgcgtacggataccataccacatacaacttgggaccaatataaggtaaccgagaagtgaccaaaaaagatagacagacaacctgacaagcactctgttgatataggtggt

SEQ ID NO: 1512 - DNA, 1044 bp, Homo sapiens
tcacaggggaagaggaatgagaagccactcctgtacctgagatggggaagactgaggacagaaagcagaattccgaagagaaagtgatggtaaaactagaagagactaccggggaaaagggaggaaaatccttttcaaaagttgggaaaatgcgataccatgtttgcccttaaagttcatttatgatacacacaaaaataaatcctttaaatgctctttctcagtaaattaataggtcaccagttgtgcctttaatataaaagccttttcctccagtgtaattaattgcaaaagctataggtagctgttatctttcagatcacaattttccagaattttgcactcttggactgtgtggatggaagatactgaattattaaacacaagttgtaatttagtttttcctcacacatgctgtgggctgtgagggaatgctcttttgtgaaggacatgttgcataagtgatttgtgggccaaggtcctctgtgctgagcaggggtggggacagcagactttggcccttctgaggcagtatcttaggtcaggttctccgcaagcaaagacagacaagcacgcgagtgatggattgagggagtgttctcaggagaacactgagggagggagggacttgagatagagctggagaagaaggcaagtcgaggtgtgaattcagagcaagtccacctccccacggggagttctggagcatgagtgtactgcagagtaggcccaccggagggaaggggactgggcttttctgtcccttcactagtcagtcattgtccacaggctgagtggcaaagaagcgagagcagttcataacctccaggtggcggcttccatcagcctaagcccggcctctggaggggggagggtacaggtgtgtgaattttaacagccagtacctgcagtggccagaggcccagcccaccagctggggtggactggccaccagctgcatttgctgcagctggtaatgcccttccccttagcaggtctgtgtgtaggagcatgtgtgttgagctgtggagataatgttgttca

SEQ ID NO: 1513 - DNA, 1033 bp, Homo sapiens
caatagatactgtgaactactggagaggggaggagggcatgggttaagaaactatctattgggcactatgctcactgcctgagtgcaatatactcatataacaaagctgcatatgtaccccctgtatataaaataaaagttgagatgaaaaggaaaggcattctagatacgaagtttgtattaatattttatatgaagattaattattttgtctttaggatcctgattccaaagaacattctgtatccaataagtctcagcatgcatctgagacatttcatcattcttccaactggctgagaaatccattcaaggtacttgacaagaatcaagaaccagctctctggaaacagctcatcaaaggtgaaggtgaggaaaagaaggctgataagaagcaaagagaaaagggagatcagcttttcgatcaaaagaaagaacagaagcctgaaatgatggagaaagacctctcatctggcctggtaccaaagaaaaaacaatctgtagttcaagagaagaagcaagaagagggagcagagattcagtgtgaggcagagactggaggcacacacaaaagagacttttctgaaattaaatctcaacagtgccaaggtaatgagcttacaagaccatctgcatcttctcaggagaaatcaagtggtaagagtcaagatgtccaaagagaatcagaacctctgagagaaaaggttacccagcttttgcctcaaaatgttcacagtcacaactcaataagcaagccccagaaagggggacccctcaacaaggagtacacgaactgggaggctaaagaaacaaaggcaaaggatggccctagcatacaggccacccagaaaagcctgcctcaggggcatttccaagagcggccggagacccacagtgtgcctgctcctggaggaccagcggctcaggctgcaccagcagcaccagggctttccctgggtgagggccgtgaagctgccacaagcagtgacgacgaggaggaagatgatgttgtttttgtttcctctaagcctgg

SEQ ID NO: 1514 - DNA, 1029 bp, Homo sapiens
ggttttataggtgcatgttcagtttctgccttttcccctatttatattttcaagattggtaagccagctgggttaaaatttaaaaaaggttctggtttttgcacacatatttaaaagaccataatttcagagtttgggtgtttcaggctattttaatctgaaactattcatctaacagtgtgagaggagagatccatttgatggaatctgtttttcagagcacactggcatcagtgaacatccaggctcttccagacaagggtcagaagttgatcaaacaaatccaggagctggaggaagtactcagtggtcttaccctttccccagagcaaggtaaagtggcttatgcctcagaactccgggtttgcatcgactttacaagagacattcgggaagcccttttaataaagaatgtgttgattcattcacttttccattttattatctgcttctgagacttctttcacattacacctatggttcataaaaaactttctcctgtttcctgtggactctactttcttccccattgtttaagcaactgttaaaatgctaccttctctaggaatccttcatcggaatggtgatgatccctctctcttgacctcacctccacacatatggtcccttcacttagtttgctgaactttaatctgctcttcccttgttttctgagcaggaactaatgagaagagtaacagtcaagtaccacagcagagtcacttcaccaaaactaccactggccctccccacctggtgcctccccaaccccttcctcgtcgtggtacccaacctgtgggttctctagaactaaagtctgcctgccaggtgactgctggaggatccagtcagtgctatcgaggtaagacccaagggcctgaccctgctgtgaatagccacccctgtgagttacgtgccacccggtacagtagtcacctcttatccacactttcagttaaccttagtcacctgtggttcaaaaaaaggtgagtacagtacagtaagatattttgagagagaaagagacag

SEQ ID NO: 1515 - DNA, 1031 bp, Homo sapiens
ggctgaggcaggagaatggcgtgaagcccggaggcggagcttgcagtgagccgagatctcgccactgcactccagcctgggcgacggagcgagactcccatctcaaaaaaaaaaaggaaacccaaatttgaaaacattttactcttagacatcttatgttcaaagactgagactctcaaataacttatttgaaccagttgagacgttttactcttgggtttcttaattcttatttcagtgtacctgagctaagcaaatttaaaggtaaatgtgggtcctccatgcttgcctgctatttccccttgtgtccttaaggacatgtacattttcccatattgtggctggatttcacttgtgattcttccagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtgagtaacttctcgtgattgtgtaaatatgaaccctgtctgtatcccttcatcattatttcatgtctcataataaagccttagtatgtgccagattatcttgtttaggagatggcaggcctgtcaacctttaaaggacaaaagaataaatatttatgagaaaatagctgttgattggttgatataggactttgattacattcagcccttatatatatatgcaaaaatataggactttatatatgcaaaatatatgcaaaatatatgcaaatatatgctatatatatatatatatgcaaaaattattcttaagtccagtgaatgttttcggctacttctgctttaaaacatatggtctagggctagcactacaatttatttgaagcaaacaaaaaagaatgttgattttaaaatatttccatttggctgagtgcagtgggtcatacctgtaatctccacactttggaaggctgatgtgggag

SEQ ID NO: 1516 - DNA, 1035 bp, Homo sapiens
ttttttattcttccaggtgatactgccccagcgtaaatttcagttgcaccatttaaagctttctgaagatgaagagactgtttacaatgtgttttttgcaagatcaaggtgtgtgtattaaagaagcaccttctcacacacattgttttattcctgtcttttcttgggagtgagttgaaggtcaaatttccacaaactttatggcattattgattagttggatgtctgtattccctttttttttttaccccatttttctccttctcccctccccagcttacctctgtctcatacacacatggaaggcaaaattttgaacctactcttcattggcttccttgcatagaagtcatagggtgtggtcaccatatactgaatctgtctggtcctcatggggctgtactgaataataatatctctttgacatttgacctgtcatccagcatctcaccggaactttaagaagatgactttgtaatcctttgtgtcatctgttctttgcactttctcttgaactcttatctttccctgaattccagatttactgtttcctatttggtacctctcatttacatttctaatgtaaatatattttttcttcttttacaccttatatttgttagcttattttaaaaaaagattggttttttaaaataactgtttcttttgcattacctttggccattgcttcttatgagcttggcatcatttaacaagtcttctataatttgtcaagatcccactgcaggcacagttaagcaggtcttagtgaccattatacatgcattttttttctttttaatctgaggcaggtcagctctgcaatcctatctaaaaagacatgaaagtagaggcaaccaatctggaagaagccctaataatccattcagtagaggtaagctgtaggactctcataaatacatatgactggtgaaaatggggatttggattcagtaaaacacagaaatgtgaggttatgaatccttggtatcagagatttggcgttaactaagaccctcaaaccagagtaaaatc

SEQ ID NO: 1517 - DNA, 1082 bp, Homo sapiens
aatttgataacctttgaggccttatggacttaccaaggtagaactttttgggtaaaagctggatctctatacttttttggattgggatatcttttgcttattttgagtttgtttcaattaccttagcttcagaaagtattaaaatgccaatgtgggtcacatccttttaaagggatatatatctagtcaaggttgtttggattcctcagacagggttcttaactggacctaagaagacttaaaggaagaaatctcattaaaaatgaaagcataataaaagtttgaatatattattagatgtgctgcttagggtttttgatagtttgcttattttttgtttttgttttttagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttc

SEQ ID NO: 1518 - DNA, 1035 bp, Homo sapiens
ccctctaccactttccaaaagatcattcatgctgtttcttccctcctcagcctatgggatgcaaaggaactgatggaagattacaaggccctagggaaggtgaagccactagctcagcagttcttagcctagtttttggccatcagcccttctattagactagtgaagcctcagtcccaggatggctccccatgtacacttccctcctcgccccagctcacctacactggactatgacatgatcaaggaatctttttttttaagctactgagatttctgtgttgtttacatagcagtttgtaccctaaacaaacacttgagattttatacttcaggaaactattcagatttccttctcattagcaattgttccaaaaacacttactctgctaatttctgctagaaagaatcacagttcttctaacacagaaacatttctgtcccttgagttgggaaacaagaccctatgttaacccagtcagagtgtggactgaggcattcggagcctatttaagcagaagttttctataaggacaagatttaaaggcttacaaaggtaaagacaatggcctggtgggaagaattctagtctagaacgtttgagatttgactctagttctaggttcatcttagctgggtgtgtaacgttgaaaaaattggccgggtgcagtggctcaggcctgtcatcccagcactttgggaggccgaggcagacggatcacgaggtcaagagatcaagaccatcttggccaacatggtgaaaccccgtctctactaaaaatacaaaaattagctgagcgtggtggcgtgcgcctgtagtcccagctactggggaggataaggcaggagaatcgcttgaacctgggaggtggaggttgcagtgagctgagatcgcgccattgcactccagcctggtgacagagcgagactccgtctcaaaaaaaaaaaaaaaaaaaaagagagagaaaaaaatccttactttctctacactctgatttcctcatttgtaaggtgggcagttttcagaacttagca

SEQ ID NO: 1519 - DNA, 1051 bp, Homo sapiens
ggtactgttcacctgagaggcagcttggaaacatggggacattttttggttgttagaatgatggggatgagggcactattgcatttaattatatgtgggctgggtatgctaaacatcccatggtgccttggtggttgtgcacaataaataattgaattatcctcctcataatgccagtagtgcatttaagaaaaaccaggttatatggctatcttggtgaaggactaaaagttattactagcttcctttgcttcactgtctgcaccctctggctgaggattatttctcatttcgttgctttgctgttttctttccttagttcaagggacttgattcctttcaagctccaaaaatgttatttttaaactctggctttggctcggctcagtggctcatccctgtctctagagtccctgtttctagagaccctgtctctagaaaaaaataaaaaaattagccagatgtggtggcacacacctatatttccacgtaatcgggaggatcattgaagcaggaggctgtagggagctatgattgtgccactgtactcccacctgagtgatagagtgagaccctatctctaaaaagaaaacaaacaaacaaaaactgtgaaaaggtgcccggtagcatgggagaaaatatttgcaaatcatgtatctgataaggcattaatatccagaatatataaagaactcctacaactcaacaacaacaacaaaaaacctggtttaaaaatgggcaaaggacttgaaaagatatttttccaaagaagatgtataaatagccaataaacacatgaaaagatgctcaacaccactaatcattagggaaatataaagcaaaaccacaataagataacccttcacatctattaggatggctgttgtaaaaaaaaaaaaaaaaaaacaaagtaacaggtgttggagtggatatggaaaaattggaaaccttgtgcattgctgaggggaatgtaaaatggtgtagctgctgtagaaaacagtatggtgtgttcctttcagcagtctttgtgtagccagtagttgtgattcta

SEQ ID NO: 1520 - DNA, 1287 bp, Homo sapiens
gctggtttgatgttcaaaaatcaaccaatataattcactatgtcaacagactaaagaaaaacatcatataatcttattacataaccacagaaacatctgacaacatgtaacgtctattcatgataacaacttgcagcaaactagaagtagaagggacctttctcaaggtgataaagggcatctacaaaaaacctatagctaacaatattctttttatctttttgtgtatgttgttattattatagatttcagttttatgctgcaaatccatagtacattgctaccacttttaccttaggtgatcagttatcgtttagaactattaaaaataaaagaaatgcctttttgtcttcatttcagtcatttttgttggtcttttctttttgcaggttcaggtttctgatttttcaggtttttcaggtattttattccttctgtggaaacagcttcctttaacattttttatagtataggtctattggtagtgagttcttttagtttttgttagtctgaaaatctatttccactatatttttgaaaaattttctttgggtataaaatataggtttacagtttttcctgtcaacactttagaaatgtcactgcattatcttatagcttgcatagtttgtgatgagaaatctcctttaattctttattcctctgtatgtaataggtcttttttttttcatttggttgcctttaaaattttctgtttatattttgttttgtatgaagagtctgagtggtttttactttgtgtgtgtatgtgttgggctgcaggggtatgagtaggactgtttattttgcctgaggttctttaagctgctggggtctgtgggttgatatctttaattattttctaaaaaattctcagttattgttttttaaaatatagacatccatcgacttatgataggattatgtcctgataaacccattgcaaattgaaaacatcctaagttgaaaatgcatttagtacacctaacctaccaaatatcatagcttagcctaccttaaacatcctcagaacacttacattagcttacagttgggccaattgatataacaaagcccagtttatagtaaagtgttgaatagctcgtgtaatttattgaatactgaaaacgaataacagaatggccatacgagcacttgaagtatagttactactgaatacttattgctttcataccattgtaaagttgaaaaaatcatgagttgaaccatcctaagtcaaactgtcataagttagtgaccatctgtattttttcttatcaatacttt

SEQ ID NO: 1521 - DNA, 1071 bp, Homo sapiens
tatagcttgcatagtttgtgatgagaaatcttctttaattctttgttcctttatatgtaatgtctttttatatattgcaagagccccctgccccacttctgggattccaattatatacatatactaggctgtcatagctcttggactcattgttagattttgagtttagccaaatttaagtgctttttaaaacaaaaaatgtgcacttctcagaagatataacagaatcagcttcctgtaaagcctatcaatcacagtgatcaggatacagtttaaaattactcaatgtatgaaaaaaatagggaaaatgatccatttttttttttccaaaagtcaatcaatggtgacctgttctaaggtaacccagatactggcattagttgacaaggatgttaaagcagctgttataactatgcccagtgacataaaggaaaatatttctgaaatgaccaaatagatgaaaatctcatcagaaatgaaataacatggaaattctagaatgaaaacttcagtgtttaaaacaaagtcatcatgttgactgttgtcattggaagggtgagagtcagtgaacttgtagatagatcaatgtaaattatccagtgtgaagaaagagaattaaatatttattaaaaatgaatggagcttcagaaacttataggacagtattccaacatacatataattggaatcctgtatgaagagagcagatagctgtaaaaaatagttgaagaaataatgactatattttttctatatttggtgatggacctgaatttcaagaagctaagtagatcctaaacatgataaataccaaccaaatgtaggcatatcatggtcaaacagctgaaagccaaatacaaagagaaaagtttgaaagtattcatagagaaatgacacatgttatatgtggaggtactttaatttgactgatgactgaacactcatcagaaaccacagagattactttttcaaaatttctttaaaattatgtgaatgcttaggcaaaaaccatagcattttatattgggttataacatacatagatgtaatacatgcagctgtggaataaaa

SEQ ID NO: 1522 - DNA, 1073 bp, Homo sapiens
ttaatggcttgcttttctgcttcttatctttctcactcaataatactccatggaaatacgattccaggttactcaataaagatctaaataaatctttgtgatgaataccaagtgagaaatgggatagttatactataatttattcattaattttcatatcagtggtatttgtttccattattttcctaccacaaacattgctacaatagcatcctgttatacatgttcttgtgtagtaggaattttatttcttggaaaatggttctcaagaatacaattgctggattaaaaagcatctgctttttttttttttttaatctgtgggacagatttctagatgtagcgttcctggatcaaagggatatgtatttttaaatttaatagatattgccaaaatgtgttccagaaaggctgtagtacatttccaccaacaatatgtgagagtctctaaatgtctgcaggtataaattctttttaatttttgacacgatggttgctataaaatcttcattgtattttctgactagtgaattttgaacatccttttcataaatttattgggcatgtagatttgctttttggtgaattgtctattcctaagtcttgcttgagttctttgtctttttctaattaatttataaagtgttttgtagattatataattaattctcctctctctactcttctgttggtctgttgtctttataataatatatgactcataagttttaagcttatatatacaaatatatgttttataacttttagtttacagtcttggttaaaaaattgtctccatctatattttttacattcttcgagatttccataaaagctttgaaatactgcttttctaaaagaattgaagtatggcattagttgtggagttttcatcagttatatcaatttcctttatcacattgaggaaatttccttctattcctatttcactgagatgttcttgttgttgttttatcatgaatggatgttaaatgttgccagatactttttttccatctatggagataatcataaggtttttcacctttattcttttaatatggtaaattact

SEQ ID NO: 1523 - DNA, 1081 bp, Homo sapiens
tgttttgggcagtatggtcattttcgtgatattgattctttctatccatgagcatggaatgttctcccatctgcttgtatcctctctgagttcctggagcagtggtttgtagttctccttgaagaggcccttcacttcccttgttagctctattcctgaatattttattctccttgcggcaattctgaacgggagcttattaatgatttggctctctgcttgtctgaatatgtttaaaagaaaactgaacatgttttaaagaaagaaaataaaattcagatatccaacaatatacttttataatatccgtaatccaatccaaaattactttactttatggcatgcaaagaagcagcagaaaaatgtagctcattattctgtagcccagagaaaaatctgttcatagaaacagacatggaaataacagaggtgatggagatagcagtaaaggactttacatagctattgtaagtgtgcttgaggatttaaaggcaaatgtgaagaatgagaaaagagattttaaaaaggaccaaagtggaacttctaaaggtgagaaatatatgaaataaaaaatttacttgacaagcttgaaggcagatttgacactgcatcagaaaagatcagtgagcttgaagacaaaacaatagaaaccacctaaactgaagcacagaaagagaaataaaaaagctggagtatggagagaagcatatccagtgacctatggggcagtgtcagatggtttaacatacctgtaatggagtgatgggagtggcgaatttgggagtgggaggagtggcagaaaaactacaagcatgaattgttttattgtgcttcacttaattgttctttgcagatattctttttttcctttttcttttttttaaacaaattgatgatttgtgtcaactctgtgttgagcaagtctatcggggctatttttccaacagcatatatcacattttgataattgtcacaatattttaaaacttttcattattattacatctgttatagtaatatgtgatcggtgatctttcttattactctagggcaccatgagcaagcagtcatagatgatggc

SEQ ID NO: 1524 - DNA, 1040 bp, Homo sapiens
actttggaaaacagtttgactgtttttcaaatgtttatcacatcaataggatataggtaaatagttgtcatattcatccaatggaataccatttagccataaaaagaatctaactgctgagacacacagcaatatgggtgaatctcaaagacatgttgagtgaaagagccaaacacaggagcatatactgtatgatgtttgtatgaaattctagaacatgcaagactaatcagtagtgagaggaagcaaattgagaattgtttgagacttggtggaggaagtgtgtgtgttgattgcaaaagggataaggacatgttttggaaggattgacttggtttgtataccagtctttgttttcatttgtcataacccattgaatggtgtacctgaaaggatgcatttttgtatgtaaattatacgtcagtatatacttaaaaagaaaaataaaccagatcctacacttggctgaggggctgtgtaataacaaaaaataacattaccttataattgaaggacaatcttaactttgaaaacatatttagaaaaaagtttgtaaaaatacagaattaaaattagaagagaccagtgagtatttaaaatgtaatagacaactcaaattatgcttatgcagttttccagaaggatagatgagaatgtgttaacagattgctttggtactgagagtgattggaagaggtagagggcttagagagatacttttttttttttactttatgctttttcagtgccatttaaattttaaatcatgagtatattacatatcctctcaaattaaatgaaaatgtaacaaaaatcagacttcattttaaaataaaaattaaagctgttatattcatctgctgtcaaacaaggaagtttttacttaaaaaatttttaaagcatctgctataataaaaaggtgagaagaaagccattcttacatttcagctttacttgtagactagtgtattatctgtcaaaagcccttaaagcttgtttcttttgacccagcaattcaacctttgttaatgtgcccgaag

SEQ ID NO: 1525 - DNA, 1028 bp, Homo sapiens
atgtataccagtttatgtaaagcgaacgtttcacagtggcaaagtgggagagaagattggagccattatgtagacagccttacacaccaaatcaaaggttcttagttgttcaggaaataagacgtgtgcacaactccctccccgtaatacacactctcttagttacttctgtcagctactgcgttaagtgctgtcatatgggaaatggtaacagaaagttctttgcttatccaaaaagcccttcagatcttacttttcttttttccttagcatcttctacctgcaaaagctccttgacttttgagaattccttacagaactgctaaatgttttataagggggaaggaactcctgaaggcttttttcagtggggagtaacaaagcaaaaggatctgattgtaatccacaaattggtgggtttgggagaccacagccataacctaggaataatgtgagatcttgaactaaggggagtacacttatttttcacctgtcattcagacctagatagtcctgctggactttaacaataagagcatattaatggaaacaagtggttacacaggacaggaacagatgcagcatttattgatgctgcttttccttggccccttggctccagaattgggagcacagctactagtgaaattctctgtgtaggagggtgctgccacagttgagaagacagccaaactattgccacagtggtttgggaatagaatacacacacacttctattgttagcagtggcttactaatgcttccgtaaattaagcactctttcatgtaagggaaataggtaaaataatcatataatgaatctgtttcacttgaatgtcccctgatatttaatgctccttatttacaggaatgagggggatatgtctgaatcacgtgaggagtggaaagtggtggcagaagcactttttgtcattgaggaatactttaggataattcatccttttcctaatgtccttttttcctgtgtgctttcttcaagtatggccctacttttgtctgttaaggag

SEQ ID NO: 1526 - DNA, 1030 bp, Homo sapiens
acaaatgaagtaagccctgtaattgccccagctgtcttgatagagtttccaggacatgatacagggaggggacttgagacaaagcccagcgtgctccctgaggagatgaagctgtgagtgtggggaaactaaggtagctagaattcacaggacagtaccagagagaagagagctgcagagagaaataaccaagggaatgcactggagtgttcagcagagtgctgatcatcacatgcatgtgaagaacctacctgaggtgagggaaagaatcatcctagaggattaaaggcagcagtttctggcactcacacagggccacatagggttgcaggaacagtgcctgttaccagcaaccagactgtaaaaattcatattcaagtggcactgggtagagtgagtactcaggaaggtcctgcctcaatagtggggaataacctgctgctttggacctatgtagcaaataatgaaagcaagacctgaaaggatcagactgtttctaagtgatctaactacatccctgaacaaaactcaaggtttatataaaggaatataaaaataactaccacccaacaaagtaaaatctgtaatgtctagcatcttagtcaaagattaccatgcatgccaagaggcagtacaatgtgatcaataattatgaaaataaaaccaacttagaactgataaagatgttagaattagtagacaatgacagttaaaatatttatgataactatgttccctctattcaaaaagttgagacctagaagatataaaaacccaaatcaaatttctctaaacaaaaactgtaatgtttcagttgaaaaatataccagatgagattattagcatgttagacattgcagaagtaaaaattagtgaacttgaagacttagcaatgaaactatccaaaatgaaacaagagcaaaaaataagaatcttataaaaatagaaagttgtcagtgatgagctatgagacaacttacagtggcttaaaatacatgaacttagaatctccaaagaagagaacacaaga

SEQ ID NO: 1527 - DNA, 1494 bp, Homo sapiens
aattcagcaaagtttccagatacaaaattaatgtacacaaatcaatagctcttctatacaacaacagcaaccaagtggagaatcaaatcaagaactcagccgcttttacaataactgcaaaaaataaaaataaaacacttaggaatatacctaaccaaggaggcaaaagacctttacaaggaagactacaaaacatgctgagagaagtcatagatgacacaaacagatggaaacatcccatgctcatgaatgggtagaatgaatattgtgaaaatgaccatactgccaaaagcaatctacaaattcaatgcatttcctgtcaaaataccaccatcattcttcaccgaactagaaaaaacatcctaaaattcatatggaacaaaaaaagagcctacatagccaaggcaagactaagcaaaaagaacaaatctggaggcatcacacttcctgatttcagactatacctcaggccatagtcaccaaaacagcatgatacttgtataaaaataggcacacagaccaatggaacagaacagagaacccagaaataaagccaaatagttacagccaactgatcttcgacaaagcaaacaaacaaagtggggtaaagacacccttttcaacaaacggtgctgtgataattggctagccacatgtagaagaatgaaactggatcctcatctttcatcttacacgaaaatcaacataagatggattaaggactttcagacctgaaactataaaaattctagaagataacattggaaaaacccttctagacattggcttaggcaaggatttcatgaccaagaacccaaaagcaaatgcaacaaaaacaaagataaatagctgggacttaattaaaccaaagagcttttgcatggcaaaaggaagagtcagcagagtgaacagacaacccacagagtgggagaagaagatgtaaaagtggtccacaaacatgagaaaatgctcaacatcactaatgatcagggaaatgtaaatcaaaaccacattgcgacaccaccttacacctgcaagaatggccataatcaaaaaatcaaaaaacactatatgtgggcgtggatgcagtgatcagggaacacttctgcactgctagtgggaacgtaaacttacacaaccactatggaaaacagtgtggagattccttaaatcactaaaagtagaactaccatttgatccagcaatcccactagtgggtatctacccacaggaaaataagtcattatacaaaaacgattcgtgcacatgcatgtttatagcagcacagttcaccattgcaacccaaatgcgtggaaccaacccaaatgcccattaatcaatgagtggataaagaaactgtggtatatttatacgatggactactactcagctataaaaaggaaccaattaacagcatttgcagtgacctggatgagattggaaactattattctaggtgaagtaaatcaggaatggaaaaaccaagcatcgtat

SEQ ID NO: 1528 - DNA, 1065 bp, Homo sapiens
ttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaaatgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtggcttggcaaaaatcactataaggcagctctaaatttgccttgataagctaaataaattacttttataacttactaaagcagaacaaacagtgaaactttctaaaatat

SEQ ID NO: 1529 - DNA, 1048 bp, Homo sapiens
tgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgggtatcgaagggaaatgcattctttttatggagtattgaccctgatcctctatgatgtcatatagagcaactcagggctatacttgctagattttaaccaagcagtttgaaatattaatcatcatcctctcatcttctccactctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtatgagagtagctcacaacattttaaatgtttccaatatgaatcgtgttacaaaattcttaattttatatttcatataaattaaagaggaaaaagaaaaggtttataatatattttaaaacaatgtgttactgtataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgt

SEQ ID NO: 1530 - DNA, 1069 bp, Homo sapiens
gtttgaggccagcctgggcaatatggcaagaacctgtctctacaaaaaatttaaaaattagtcaagcacagtggtgtgtgcctgtggtttcagctatttgggaggctgaggtgggaggatggcttgagcccaggagatcaaggctgcagtgagatgtgatcatgccattgcactccagcctgggcgacagagtaagactctgtctccgacaacaacaacaacaacaacaaaacaacaacaacaacaacaacatgcctcctggaacatactatttcagcttttattttctcatttttataaaacagattgaagacccggaagaaccagaccccaagaaaatcaaaggatcttctcctggaatacaagatactcttgaggcagaggatggtgcctttgagacggatgaagcccctgaggatgtaattcattttcatttcttaagtttaattgtgttgaataatgggaaagtaagaattgcagatttttagggaatcatcactttagggaatatttttgtcacttgcacttattagaattatgtttttttcagaagttcagcagaacttacatctaaccttcatctgctcttgcttcttctgtagcgaatcctttcatgcagaaaagctggttccataatgcgggaaggaagagacagagttgtaaaccttgcagtcgacaagacaggcaggattcttgcttgccatgtgagtaccatacttaggagaaaataacaaggactaggctgttccttccaaacactcattctttcatattcaatgtaaagatgactttttcttgactcatgttaataattcattatatggtactgtgtggacctataatctctagctttattagcataacaacaaaaatattaataattactattaggttggtggaaaagtaattgtggtttttgccatttaaaaagtaataattgcaattacttttgtaccagtattattattagcaaccatttattaaatgcttgctcttctaagcaatttaagagcatttaacttcttgttcagccttcagagcaatgctacaagtaggaaatggtatcctc

SEQ ID NO: 1531 - DNA, 1025 bp, Homo sapiens
ctagattacattctagcaaaggagaggaggaagatcctgaggttaatgttgaaatgagtctgcaagatgaaatccagcgggtgactaatataaaaacttctgccaaaatcaagtgagtaaaaataaattatctgaagttatagaaatagtaagctaccaagtattattggctttttcatgctatttgtaagctgtctgtatgaattatatatgtggagacggtggtcatgagacatctgtgtcacactctgctcctgttgtcctaatcatgggcccactttttgtcttgtatttggattattatagtaccctttttagctagtcatttactgtcttttcctgcagctaatttaagaaaaagaaaagtgtgtcccacgttcagaaaggatataaggtcacttataaagaatacatacacagaaccaaagtatgtatcagaaccaggatctgagcctagttttttttttttttttttttttttacttaaaagcctactcagctactactcaatactcggagcactcttttaattttttttgagatggagtcttgctctgttgcccaggctggagtgcagtggcatgatctcggctcagtgcaacctccatctctcaggttcaagcgattctcctgcctcaccctccgcagtaactgggattacagacttgtgccaccacactcagctaatttttgtatttttaatggagatggtgtttcgccatgttggccaggctggtctcaaactcctgacctcaagtgatccacccgcctcggcctcccaacatgctgggattacaggcgtgagccactgcacccagcctcagggcactcttacttgaaaaattgtttatagttattcaaactttatatagatagaggacattgtaaagccttttcctggaaaaagtaaaccttgtgagctaagatggtagctagaacatttatgattattttcttgtacaggtcctttgacttgattcattcacctcacggagagttaaaggctgtcttcctgctgcagaaca

SEQ ID NO: 1532 - DNA, 1150 bp, Homo sapiens
tacaaaggacatgaactcatcattttttatggctgcatggtattccatggtgtatatgtgccacgttttcttaatccagtctatcattgttgaatatttgggttgtttccaagtctttcctattgtgaataatgccacaataaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccaggacctgttgtttcctgactttttaatgatcaccattctaactggtgtaagatggtatctcattgtggttttgatttgcatttctctgatggccagtgatgatgagcattttttcatgtgttttttggctgcataaatgtcttcttttgagaagtatctgttcatatcctttgcccgtattttgatggggttgtttgtgtttttcttgtaaatttgtttgagttcattgtagattctggatattagccctttgtcagatgagtagattgcaaaagttttctcccattctgtaggttgcctattgactctgatggtagtttcttttgctgtgcagaagctctttagtttaattagatcccatttgtcaattttggcttttgtcgccattgcttttggtgttttagacatgaagtccttgctcatgcctatgtcctgaatggtattgcctagattttcttctagggtttttatggttttaggtctaacatgtaagtctttaatccatcttgaattaatttttgtataaggtgtaagaaagggatccagtttcagctttctacatatggttagccagttttcccagcaccatttatttatttatttatttttatttatttattttttttttttttgagacggagtctcgctctgtcgcccaggccagactgcggactgcagtggcgcaatctcagctcactgcaagctccgcttcccgggttcacgccattctcctgcctcagcctcccgagtagctgggactacaggcgcccgccaccgcgcccggctaattttttgtatttttagtaga

SEQ ID NO: 1533 - DNA, 1033 bp, Homo sapiens
ggtagtcagatgttctacacgtctccagcctaagctgtccacttcggatttcttgctcttttcctttttgcttaagcatatcttggtatgttgcctggaagtttatgtgtgttactacagcagaacaaagaattatgtaatataaagcccaacttgtttttcttttccctaccagctgtactataacttagacaaaactcaaccattttctttcattatgtacagtggctattaaaaagaaaggatgtagaaaaatttttttcaggaaacagtggaaaactaatgcgtcatgatctgcttaacaggggactgtaaatagaagcaagtccagatcatggaaattgcttctttaaaatattttttttcaattttaaaaggaatacattcacatggtttaaaaaaacccctcaaactaaagaagaatacagaataagaagtaaaagttctaccctccaacctactaccccaactcctgaatcccactgccaagagaaacagtcatttgttgtgcatctttctagaagaattctatgcatattacagaggtgtcacaaatacccacatgctttcttcccttacaagctctgtgacttgatttttctctttactgtgctttaagcatctttgcatattagtaaacatatacacctcagttaaaaaaaatcaacagctgggtgtagtggtgcatacctgtagtcccagcaatttgggaggcagagaggcaggaagatcccctgagcccaggaattctaatctaccctgggcatcttggcaagaccctgtctcttaagaaaaaaactatcgcaagaacaaaaaaccaaacaccgcatattctcactcataggtgggaattgaacagtgagatcacatggacacaggaaggggaatatcacactctggcgactgttgtggggtggggggaggggggagggatagcatcgggggatatacctaatgctagatgacgagttagtgggtgcagcgcaccagcatggcacgtgtatacatatgtaactaacctgcacaatgtgca

SEQ ID NO: 1534 - DNA, 1062 bp, Homo sapiens
tgtaaacttgatatagtgaggatgttttcttttgtaattaaaagattaaagagattcagaatacttgtttgtaattggttttggaatgaaatttcacttggaaaataaaggcctagaatatgagactattcatcaatagaaaaccattgtagggagcagttaacaggtaaagctctatttaataagggcaagctgatggcagggaaaggaacagaccttaaaaaggactcacctgtgagaattggagacggtaaccctgtggtatcaaaatgcaggagaccagagatagctataaatctcttgcagtgttactgcctccgcatgaagtcataatccctagaatgagaatttatttttcatgatacaccgataatgcaagggacaatgatcaggaagtactgcacttagtctttctttctcatacctaaaatgtttttcattttatgcttttttagaatagagtgtacttacttcctctcttcctcacatagacttgaaaactcggcgactttaggatgcaactccaggttgacacattttcattagtttagaaaacccacgtgtcccactctcagaatcattattatagtagaggagatattcagggcaaggattccttgggaaacaacatccagattcaagggaagacatctgagtcacgacaacttaaaatccatcctggcctgccacaaagtgtttctgtaacattaagtacctcatatgcaattcttgaaaaggaaaattatgtcaatataacgtgaaatttgtgaaactcaaacatgatcatctaggcaaggagagctgaaatagaagaaataaaattatagcctctaatatgaaaggaaatacttttagtgtggttgctgctaagcagtagtttttttcaactgtatttaaaaaaaataaaaagaagcacttgattgctggtgatagtgcaagcttgtataaacccaatgaagtgaatttaacaataccagcatttactctttgttaagaactgaattgtgttcctgtcacatttatatgttgacatctttacccccagtacctcagaatgtgact

SEQ ID NO: 1535 - DNA, 1059 bp, Homo sapiens
cccttgacataaggggcacggatgaggaggcggcttacttctattctgacaatctttttaaaagtgtccttgtagaccacactggaagcaagtcctattaggcattcaatttgcccagactttccgtgttccaaagcctccaatgtctgcttgcctaagggccatgactaaagcggtggcctttttcttatctcatttgtccccttcctcctgctcctcctgatctctattataaaaaaccgaggttgtgaaatcaatagggttcctaagttttgctccgggcctaaggtggacttttgatgttttttctaatgtctgcagctaactgagtgataaacttatcctttaagattagttggccttcaatagagtccggtgacagagtggtatgcttcctcaatgcctcccttagtctctccagaaaggcagtaggattttcttcctttccctgtgtgatagtggacaccattgaataatgtataggcttcttcctacttttccttagtccttctagcatgcaagttagtaaatgtctgtggcaccaatctccatgtattctgcgtcccagtgagggtctacactgggctttttgattctgtaagtactttaagggttggccgagtgcaaacagctcccatgtttgagcagaccaattattaggcaattttcctaactctgcttccgcaagagtctccctatcaattactgcatacccattgtgttttttttttttccctcagtcacccgggaggaaccatctatcatcctgccttgaaggtagtttctgctggatctggtcagacctttgtatggtaatgaggatttaaatcccctgttaggaaatctgctaggttaatgtaatttgctgtggttaatgttaaatcacctttttctagcagaatagccccatactttaagatttttgagttagtaagctccctttttgctttttgacttaggatagttctgaactggtgaggtgtgctcacaatgaggtttcctctaaaggttatttttctgctttcttctgttagcaaagcagttgctgctacagattga

SEQ ID NO: 1536 - DNA, 1342 bp, Homo sapiens
aatttgcattttcctaatgattagtgatgttgagcatttttcaatatacctgtttgccttcttttaagaaatatctatttcttttaagatatgtcttctttggagaaatatccattcaggtcccttgcccatttttttttctttttatttactttcattgttttcttcaaaggcatgatcattaacttttgccatttttcaacccaattatttgttttctttttagagttatttgagttccttatatattttagatattaaccattttttctaatgtatgaaggtctaatgtaattattctgtcagtagatagccggttgtcccagcagcatttattgaagagactgtgccttccccattgtttgttcttagcacctttgtcgaaaattaagtgaccgtaaatgtatggatttatttctgagctctctattctattccattggtgtgtctgttattatgtcagtaccatgctgttttgattactagagatttgtagtagattttgaaatcaggtaatgtgatacctgaagctttgttcttttttatcaggactgctttggctatcagggtcttttgtggttccaagcaaattttaggattgtttttatatttctgtgaaaaatgtcattgtaatttggcaaggattgcattcaatctgtagatcaccttgggtagtatggacattttaacaatattttcctaaaccatgaacacaaaatgtttttgccttcttcaatctttgtcatcaatgttattcctacacatttttttttttttttttttttggtgactattgtagttgggattgttttcttgatttctttttcagatagttcattgttagaacatggaaatgctacatttttttattgttattgattttgtatcctgcaactttgctgaaattttttattagtgccaacatttttggtagagtctttagagttttcatgtcatctgcaaacagagacagtttaacttcttcctttccaatttgagggcctttttttttttaaggaaaatatttgtgtctttttattttcctttccttttgtttttggttgacgtgtaataattgtagatatttatgggatacagagtgatattttgatacatctgtgtaatgatcaaattagagtaattagcatatccatcacctcaaacacttattatttctttgttagaaaccttcaaaatcctttcttctagctttttgaaaatatacaataaattgttaactctaatcaccctacagtactatataaaactagaatttatctagtgttaccctatctagctgtaatttagtattcattaacctacctctctatcctcccctccc

SEQ ID NO: 1537 - DNA, 1084 bp, Homo sapiens
ctttatgtgaagtgtcatttttctcaggtttcttctaagattttccttttatcactagttttaagcagtttgattatggtgtatccccacgttctcatgttttctttcttgtgcttggagtctattgaattttttggatttatgagtttatagttttttttcagattcggaaatatttcagctatgatttcttcaaatattttgtaactccctgcttgccttctttcctttagcaactcccattacacattacacacatatttggctgcttgaagttgttccatggttcaatgatgctttgtttattttttcttggtcttttttttttttaatcttctgtgcttcgttttggatagtttctattgctatgtctccaagttcatttatctttccttctgtgatgtctaatcagatgtttatcccatccagtgtgtttttcatttcatacattttagttttcatctgttgaagttcatttttaaaaacatcttatgtatcttaatttgttaaatttttctctaaacttttgaacatatgggatgtgttcaaatatcataactgtgttatcataactgtgttactcttatttattaatgctataatctatgtcattttaaaagtatttttgataaattattttcttctcctcaatgtcagtttgatttttctgactctttgtatgcctggtcatttttttttttagatgcacaacattgtgatttttatcttgagagatgctgtatatttttgttttattaaaaatattcttgcactttttctggagcgtggtcaggttattgagagataattggatactttcgggtcatgcttttacgctttgtttggcaggaccagagcaacatttaccctagggttaattttttctcactactgagtcaaaatccttcatattattaacctcagccccatgaattatgaggttttactctctggatgatgaaaatagctactattcctggccctgtatgagacgtggggtagtttgctattatcatttgccatggtttattccctggtctcaggtagtttcctctcacatgcttcatcagttctcaacggaaac

SEQ ID NO: 1538 - DNA, 1028 bp, Homo sapiens
tataaaaatacaattatattatatatgataatatataattagatataattaaatatgtaatatattacatgtaatacataataaatatataaaatataaaatttaatataaaataaataataaatatataatatattacatataatatataagaatataattctattatatttagtaatatataattagataatatatgaatatgtaatatattctattatgtggaatatatataattctaatatatataatgtagttgtacagattctgattgcttctttatatgacaattttgtaataccatattgtatagagataatagaaacatggttcaactttcctttagtatgattattaaaatttgtgttttattgttgatagtttagggaaatttttttcaataccacattttgttgcttgcaacgtcatgtaaaattttacaattgtcaaatttgggaaaacttttatcaagattttacttgtaagagttgtaagatttagataacacttctatgactagtttctggctctgtacatttcaaatcttatttctcctccactattctcctaatttcagggctgggcattgtgggatgtattcacataacatcagaattcaacataggctcagcatcataggatgcctgtcatcccaacatgatgtcccttggtcacccagctcactggtgagcagttgatgatagaagtgtttatggaatccattaatacaaccaggtggttagcagtcagctctacacaaaagtgatgccaaccatgtaatacatttcattccactcaagctaagtatatcttcaacccaactctgatgccaccctacacaaagggaaatgtgacagaggggaaatcaggacagtattaactaattggtgttatatactttaatttcgtaaactttatgaaaacatacagccatgcctacatattgataaaggccctacaaggaacttgggagaggctcatggcattagcttcagggtcaactgcctctacatgtcatatcagtgtgc

SEQ ID NO: 1539 - DNA, 1028 bp, Homo sapiens
gcctcccaaagtgctaggattacaggtgtaagccactgtacctggccggtaccctgttttgatgagccagtggcagctcccggaactcaagttaaaagactctaaacttggtgttgtatgaaagttggtatgttctcccatccttaaatttatttttgagccctgctttcgatgaggaaagctctagaaagtcgagtctcagaggaaatggtaccaagctaagcagagattctgttgtaggagctggaggtatatagtagggggtggaattatttctggctcagttcatcttctggaaagttaccgtattgcccaatgtccggggcccaaagatgccggtgaattcagacttgattgaagccactgctatccaagaagctctgacataatgaatcaacatggcagcaatcagtataggatagtaacacatttttagtcctggcacaagtttattgttctgagttactatgccattgtaagcatttccctgcagtgagttaaccttggtcttgacctgaatcttcagcaaacttaagcttgtcccataaaagcactgaaagctgaagcctttttactgacagtgccctcgttccttgccatgagagggggactgacaggagcagccaggctggctaagtcagctggggctcagagcagagtgccagctcaaaagagaaatatttaataaaaaatggaggcagaagcccagttatacaaattaggctgtctgatggagacagggatagctctggctttttatttaaaaaaaaaattatttcctaagtactcattttaaaccctcctctgttttaatggaaggtgctgcccctttaacatatgtcctttaaagtaagagtacctccttcccagatacgtgcagagcccagccctacccagttctgaagccactctgacacagaccaatgttttttcaggggctcaggcctttatctcacaggtctgcaacctgttctgttgctacaggcaccatatctagtgctgtagtagacactaggagacaaaggcga

SEQ ID NO: 1540 - DNA, 1080 bp, Homo sapiens
caaggtcatgccactgcactccagcctgggcaacagagcaagattctgtctcaaaaacaaaacaaaacaaaatcaaaaagaaaaacgttaaactagtattttaaccaggaacaagaaaaataaagagctaaagctgacagtagtagtaaggccaaggaatacaagcatggacacagagcctggagattcccatgactggagtttccttactagttcttcccacaggcctgaccactggcatttcagaaccaacctgtttcccggacttgtgatgctctggcagcagagccaatcaatgtttgcatcattgttgctcctgctgcagtacaggcagctgttgttctattcctgaaattcagggttgcaacccttggtctcaaagtgaagagtcatgtccacaggtcaaggagctagggcttctaaaagaggacgtccctgctgttttttagaatttaactggactattgtgactactatctctgtaccttgacttctgtgctttgcttccttattaactccttatgacttagaccttagatttgcccatagattctgtttctgcctctgttccacttgagtgtcttctcttgagtttacctactgtcagattctggccaattctatgactcagatttttttctgggactctatttggacattttccttacactttctttcattgcccaatcctcttccaaagctgctattatcctgtcttaacattgacatggccagtcaagaggccaggatgggctggggagaagggataccaaaaaacagaagttccccacgtacggggcacttgccgttggggaagaagttgttctcaatttcacgtgagaatcctggtgagatgactgagaaatcagtgagaatgtcatgccggagtcacagtgctgtggtttctaacagcctctatactttggaagcaacctgtctaaagtggtatgtatttcttaagttataactatatgcaggaaaatggagggccaccagcttgagccaatctgtctctcttagtttgcttggacactgacctctccaaatgaggatttttatttattttgtaattcatgatat

SEQ ID NO: 1541 - DNA, 1039 bp, Homo sapiens
ggtttttagaatcaatctctctctttgtgcttaaccattattcctctttcttcttcctcttttcccactgaagtgtgctctgtagctctacagattatagcacaagactccatctcaaaaaataaaataaaaaagacttctcaagtgaagaggtagagcccatgcccagcccaagccaccagcactcagctatctcaggaagacagttgagtcctcactctggttaaagccactcaagctgacagtccatatccaataaagatctgtgtctctggaatctttgatcagaagaattctgatacaatgcaaataattggtccaatttgtcttctggttcccaaagaagatcaggtagaatgaccacttgaaattagccaaaaaacctcatctctaattacaggagcaatttggcatttagtgatctatcccagcattagttcacaaaagacccttctatgtgtgctgcacaataagatatgatgtaacaagcttggattccatagtacatagtattcaagaaggactacataaagcaagttgctgagaaggggttaacagcggtgcaggtattactttgaagcatatcattccaataattgatatgagcattagaggattctctctctttctctccctctagcctaactaattttcaaaaggcatcaacccttaagataccatcaattttcttgccctggtatttgaaatggggtacctccacagcttatcagtacaggttttctaaagtttccatggtattcaaccaccaagtaaaaatttaggagaatacagttgtcaaaaccattgtcaccctaataaaaatatatgctaaaaatacatgtgcttttgattcagatcttaaattgtgaagtacactggatctacataggtcaagctgagccacagcccagtgatttttgacctgtatataatctatatgattcaagttttcacagtcttttgtagataacttaagggctgcactttagcaatggtgaaaattggacttgagaatctacgtgtctgaaattcttcaaaa

SEQ ID NO: 1542 - DNA, 1058 bp, Homo sapiens
tatgaactggtgaatttcggctcagccttccaggctggcattctttgcccagtaccacttaactttattcatgatccattttaggtaaacagtccctgtgccatgccggtatgcttagctattccaaagacagatactctccaggatgggcagctcctatctcagtgtgttacctggaatgcttactgcccagagcagtgattctcaaactcaagagcctcgggttctggcaaggtgccttagggacacaggtgggagcaaggaggggcccagggagacagcaggtggtggcacattgagcctttacctctgcagctttgaattgacctatttttatatttgggtctctgtttaagatttcattgccgtggtagggagagttccaatgctaaactaaaaattcagctgtggggcagagagagcacgtgacggtgagggttcttcttcagagcctctttaactgggaggcctccttgctctcctctttgctctgctgagccagcaaggccctgcagccagcataccagcctctcagggctgtcttctgtgacctcaggcaggtaggagccaccagctgccctggagtcctgcttagaaagtgaggcttcctctgttgcctcaacatcaggagtctgccctggggctgggattgaggtgagggaaccccttcatgtttctccccaaggcttctctccgggagtagtctttgaatggtgggtacccagaggtgctccaatgtctgtatattaggacatctgaccctttccaggacacaccaggaccctgacaggcacgtgtgtcctgggcctgttgtcaccctttccatcccctcagtgttgtctcctagtgtcggaaccccaacccccagctgagttcagctcttctctgccctggttatctcaaatggaaaatgagaacagaggtttgctcagccagattccttccctgcagtcatctgcagataaatgagatactctctgtgaaagaaggaagctgagtcagtgcttcgctcacccctgaggaagatgctcacctgctcctctccccaaccccctccc

SEQ ID NO: 1543 - DNA, 1061 bp, Homo sapiens
agacttgtgacaacgatggcagggatcccatctcctcgcctggacactttctcctccccaccagaaatgagtaggttacagccgaggggagcagcagtgtctgaaaaagaccaccagcgttctgagctggaggttcttatagggcgtgggagaggcagcatctttccccaaaacctgcctgatggttggtgtggggccacttggctttccttattccacaaggctaatgatgaaaaaagggatccagaggcttcaccttaatcataaccattttagcttctgccctagaattactgaatttgaagtcctctttcctattacgttcttttttattttgttttatttttttttttttttctgagacatcttgttctgtcacccaggctggagtgcagtggcacaatcttggctcactgcagcctcaacctcctaggcccaagtgatcctcctgcctcagccttctgggtggcacaggtgcatgccaccaaacttggctagttttttaaattttttgtaggggggggggtctgactatgtttctccagctagtctctgactcctggggtcaaatgatcctcctgcctcagcctcccaaagtgctgggattataggtgtgagcaatggcacccatctttcccattatattctaaagtatctatactgtatccctaatttcaaaagtaatttatgaataatgtagtagaaaacttgaaagcacaggaaagcaaaaaggagaaaaataattccactacccagagacaaccgctgttaaagtactatgctgtgtattctttgtttttgtctaatcctgggctcactctttacattctgtctcggggttaagggggatttctcttcaaataattcccagtgattgaatgtgagagtgagagatggctgcaatcatctgcccagctcctttatttagggttgaggacccaggtccaggggaactgacctgtacctttccacacagtgggcagtgactgggggaggacacaggtcaggcttcctgatttagagggcatgcagtcttgctcccactctgggtcctgccttgt

SEQ ID NO: 1544 - DNA, 1032 bp, Homo sapiens
ggaaggaaggcatcttgtaggggctggtggcagcgtgggtgaatagattcagccctgggagctgaagataagggaaatctgcttgagtcagcactctccggagcaggtgggcgggagcctcccgtctccagccttgatagcagaggccttggcagcagagagcccggctcaggcctgttatatcgtagtcttgctgcagagattgtggcccttcccaggcccagcctctagagaaaggctcctttgttctccacatgccgtgggagtgaaggagtgctgcttgggtgccagctggacgcagccgcagcaggtggggatgtggttggggacggccatgtagaaatttgcaccctgtaagctccccagaccctgccttgacagcctgccctacctactcccaaatgagccctctgtgctggctgacccccttgctttccccaaatcaaggcataagacccccacttcttgtctttgcttccatcaagcccttcctggcatgtgcgtctcctacgagcttaacctgacttacacttcaagtcctgtctcattcattcagtctgtggatattccttaagtttcactgggtaccagacattgtcatagctcttgggagacacgggtgcatgagggaggcatagctctccttccaggggcttgctgcctccttctgaagtcttgcttggcctttccagccccttctcaattctgagaaccatgttctttcttgttattaaggttcagttccatggggtgtttttttttttccctaatctttctacttaacctaagttctaagttccctgaggacaaaaaaacatgacttaagcctctctgcagcttgtgtgggtgggcccaggccatggagtcaaagggtcaggaaaatgggctgggtgttcttggttgtcctggctgaccctcagctgggtgattttcgctggtgaggacagcactgtggcaggagagacggggattttggttctgccctcccacctctggattgagagcccagccctccaggcctctctgccccct

SEQ ID NO: 1545 - DNA, 1049 bp, Homo sapiens
ggcagccagatcttgattcaggatctgccatgcctcttcctgaccacagccccgctcctccatcctctgcaggtgaatgcccaggcccttaccagtgccttctctccacacaccaagccttggattggtctggcagaagctctggggacactgatgcgagcctgggctgggtcccccaaagggaccatccaggtgataacacagggtgagctggggaccttgcagagggagggggaggaggggatgagggagtgtgggatctgccctgctgggtgtatttgctgcaggacacagggttagtgagaggcagtgagggtgccttggaccctgccctgagtatagctcccttactactggtgggagggtggtaaagggaggggttaaaaaaagtcgttggaaagatgtactgaatattcataaatcatgtttatgtagcatttttaagacctagatattttgggtgcaagagaaacctctacgagagagagagtttcatgcgagaggtcgtaggatggctggagggaggccctaattaagcaacaggatgctggattctggtttttggccctgtctcttccctgctgtgtgactctcccttctgaggcttggattcttcacttgtaaagtgagagttaggggcagatgagccaggagcggtgaggacactttgtgctctgtaacttactaaggtggtaccttgggccgtctgacagccctcgagagagagtttgctcagccgtggagtgggaatgagaacagtgccctctgaccacccctcgggctgctgagtgggctgtggccacctttgcagtggatccagtactgtgcggatgtggttgagtgaccaaggagggctccagtttccttaaccctgtagacgtgtatctttccccatggactcttgggtgtctcacagttgggcagagattgcagggagagggcagctaaaccctaggcattgacaataccagggaagggcagagccagggggtcccactggcctgggtgtccaagcgccgaaggaaacaaggcagggagctgggcagcag

SEQ ID NO: 1546 - DNA, 1055 bp, Homo sapiens
aggctttagtggggaagcgagggctaggtagggaatgctgtgatcttttggcgtttggcagagttctgaataatcttattctcctgaagttagaagactgtgatgaagtgtatagttttgtttgggtattgaataaaaaagaatgggtacctgcaggaaggaaaggagctaagatgctatcccaaaggcctgatgctggttgcccagacaggggagcatgaacatgggggccttgttttggactcttagcctccagtgactagaataaaaagggcctaaaaaagctaaagtgagaggcaggagaagctcctgggttttcatagttctgaatcttttggttccacttgtgtggttgtgtgtacaagtcagagtgaacctcattcctgtggataagagccaccatttctcctactggtgaaattagaaggaggttgtatagggcttatgcgatagaaaagatcaagatggacctttgggtatagttggctttaggaggaggaattttaccaagacactgttttgctgtctctgtactacttcctgtgtgttaactccattctcagacaggccattctcccatggaggcaaggtgactgcatttccagccttccctggtaggttgaaatctagtggaaagagtctctgcctccctcctcaaagcccccataaagtttgtgtgtctcattggttttgattgggtaaagtgcttatgcctgggtccatgcaaagcacgtggcctgagttgtggagtgggaggttcccctcgccgagggcagttagaccaaagctaccaaaaaaaggaggagtggacgccggggaccaaaaaacagcaacatgtgtgctcctcaggaatgatgcttcccttaagattagcatccagactctagaaatccccactccagaatgacagctgtggcagtggaaccagaggatttgctgtcatcagttggcctctatggagagtgagacgctgtcctggagatagaaatgtggagttggtttccttcctttccttcttggggaaaatcaaaccatttacagttcatttccattgc

SEQ ID NO: 1547 - DNA, 1056 bp, Homo sapiens
aaattaagtttgcagatgtgagatgaaatatagccagtgaatatgcatactgattctgaatgaaaggaattaacttttcagtcaagaaacagtctgcatgcagtaaattgaatttttcctgcaactggaatgatttgtttaattcttctttgaacactgccctttctccagtaagaacactaatgatttgctaatattttttaaagaaatctgtttttttaattagttaagctcagacttcctcttattttttatcctagagaaaactgctaaaagggaatgatatatcagtactattcttctaaaacaactttttaaaaatgattatacaaagccaaatatgctcattatataaaatttagaagcaaaaagaaggaaataaaaattttccataattctaccagctagagataatggtgttagaatatattcctttctaatctgttttctatgcatgcacaaacacatatgtgagcacatatttataattttattctaaaaaataggacactgctgtacatattgttttacaatctaagtcatataattataatattctttaagcatatttatgagtaaaatattaaaacctatacaaaaaaataacagaatggcattttagctcattcattgatttttataaaatatttaacacactccctggtttgtagttagcgttcaataaatgctaaaaatttatcttcaccatcatcattaatttatttattaatcattattaaattattcattgatcattttttgaggatttactattgccagacactgtgctacaagctgggaatgctgacagtataagataaagagggaaatgatgggggatgggtcatgtaaagggagaactttcatttttacttcatatatatctaagcagttataataggttgatttttgtaatttaaaaaatgtaaaaatgcatacatgcactagtgcatgaatggcagccaggatgagtggaattggagaagcatcacacacacagtgacttttgtgtttgatcttgaagaatgagcgaaccaggcagggagtcggggagga

SEQ ID NO: 1548 - DNA, 1065 bp, Homo sapiens
ctgtcacggctttttgcccccctgccgcagcgactttttcgccgccgcggcgttttgcccccgccgccacggctttttgccgctgtcgccgccgctttttgcccccgccgccgcggctttttgctgccgcgactttttgccccggtcgccgccgctttttgtcaccgcgactttttgcccccgccaccgaggatttttgtccccgccgccacggctctgagggcaggagcggcagactcggctgccagctctactggcgtcctggcaagggcagcgccgaggggtgctcctggtccagctctcctggctcagggattctttgcctaggcgccggcgccccgggctccttgcctaggcccctgtggcctgcatagagtggcgctgcctgtggaggcggtgggagagaagaaggagggcggtggtgggggtgatgcggcggccacggagggtggcacaggggctgcggccagccgggcgctgcagcagtgcgggcagctccagaagctcatcgtcatcttcattggcagcctgtgcgggctgtgcaccaagtgcgctgtgtctaacgacctcacccagcaggagatacagaccctggaggtaaggggttcggggacccgggctgggctccaggagcggcccggacacctccttcgggggccccagttcactcctggccgagttgcatctttgagcccacgtcacccccttggaggcttcccctccctcctgcactcgctgatgcggcagccagaggacccaggaccagccctcaccttgggcaggatttgtggagcgggtgcgtggtgggaactgggatggaggctccagggtcccgtgggggtgggggtgggctgcgtgaggacatccccttaccccctgaatttccatctggtccagccctctcatcttgtaggtgaggaaaccgaaggcccgagggagaaatgacttgccaggaacccctgttaaggaaaattaacaaagtgtggttattaaagaagaactgagttgggagtcagacctggaggcccgcacccgcagttaagacattataccaccttgagtctg

SEQ ID NO: 1549 - DNA, 1072 bp, Homo sapiens
catagccaaattatgataccttagtgttcaataacattattcagggaagttgaattattgattattaacaccatgtagtaatatggcaaatgtttaggatatccacataagcatttaactagactaaaaactagaattttattgatttctgacattgagattaatgggactcataaatttaaactctacaaccatgggaaaaaatcagtcattagttttagttgattctctacttactgataatgtataaacaaaataacaataataactagaaattataatgtcagcaaaactaagataggagaatagatcaagcacgtttggcttaagtgattacatttgtaaaagttaattgtcattctttttcagtaagagtaataaaagccttgtggaaatttggcctgttaaaaattctcatttctagccttactgtaaatattaatatttgttaaatatttttctagtttgtttatttatttatttatttatttttgagatggagtcttgctctgtcacccaggctggagtgcagtagcgtgatctcggctcactgcaagctccgcctcccggtttcactccattctcctgcctcagtctcccaagtagctgggactacaggtgcctgccaccacgcccggctaattttttaccttgtgatccacccgcctcggcctcccaaagtgctgggattacaggtgtgagccaccacacccggcctagtttattgtattactaagtaaatcaaatagcataatgtttatatatttgtgttttttgtataaatgatagtattaaaatttaacaagctcttcagactgtatattttattaatatattagtttgtgtttatttccaagtttagcaatagccaatacttgtgaagaaatatcttaatatactaccatttctgatgaagttctaatattaaaattaaacattagtgagaacaaaacagaatcctgtaacttggaacaaattcatttctcacttatagactatttctaggtagaaaattccaaaacccccaaaacatttaagagaaaaatacagaaaatacatgtcaggttgctag

SEQ ID NO: 1550 - DNA, 1033 bp, Homo sapiens
accttagacgcagtgaacttgctttttatttcagagacttgtaggcaaaagagaatgtagccttgacccagatgagactttgcactttgtaactttgagttaatgctgaaatgagttaagactttaggagactgctggcaaggcatgactgtatcttgcaatgtgagaaggacatgagatttgtggggtcagggacagaataatacggtttttctctatgccccttccaaagctcatgtgaaagtacactccctaatgttagagtcggggcctaggtggaaaaagctttaatcataaaggagtgggagtggatccttcacaaatggcaaagcgccaagcccttaatgccatcctcctgatagtgagtgagttctcatgagatctagtagtttaaaaggctgtggaacctctttcctctctctgtcttgttccaacttctgccatatgaaacatgtcattgccgcttggatttccagtgtggttaggaggggcctgatcagtgtgggcctggtcagtggacctaggtcagtgaggactatttagtgggatagtggtcagcaggggtctgcttagagagggtctcattagtggggtctagtagtgggggttttggtgagtggggacctattggctgccagttgtttggtgtctggtcagtgcaaacctgggctgtggggcttgatcagtggagacctggtcagctggggcttagtgctggcctggtcagcatgggctggggcactggtgaccaggtcaaggggtgctattcagtggaggactgggcacatgagacttagtcagcagaccctggtgggcgtgtcctcatcagtgaggcccttgtcagtggggccctggtcagggcagccttgtcggtgggacctaatctgtattgtcctggtcagagaggacttggtcagtggtgacttttgtagcaccggtctacagggtgacctggtcagcggggatctcagcatttggtgccggttcagtggggtctactcactagggtcccagtcaggggcatctggtgaca

SEQ ID NO: 1551 - DNA, 1039 bp, Homo sapiens
agtagagagatatcgaaggctctgtggataaggaatagtctaacagtgagtaatgctgatgagactggttgatagaggaagatgatgatgttacctagtatttacagggcacaaggcagtcaaagtgccttgccatactttatctcatttaacctcagaattgtacaacacagggcaggatgatatccggcctttttttttttcttttttttaatattttattttgagataattatgcattcacatgcagttgtaagaaataatgcagagagattgcacatacctgttacttagattcctctgatggttaacatcttgcaaaactataacacagtatcataatcaggaccttgacattgatacagtcaaaattctaaacagttccatcactgcaaggatcactcatgttgtccttttctagtcctgcccctcccagttcactctttcatctcaccccactttagtccttagtccttaactgctggcaaccactaatctcttgtccatgtttataatattgtcatttcaagaatattataaaaacggaaccattagcatgtagctttttaggattggcctttttttttcactcagcacaagtgtctgaagactcattcaggttgttgtgcatatcaatagtgtatccctttttattgctgagcagtattctatggtatgaatgtatgatggttcggacatatgggttgtttcctattttaggctgttatgaatgaagctgctctgaacattcattatagatttttgtgtatacaggtattttttagaaaatagagataagccaggcatggtgatgtgtacctatagtcccagctactctggaggctgaggcaggagaatctcttgagcccaggggttcaagatgagcctgggcaacattttggagatcctgtctacaaaaaaaaaaagatggaggtagttttttgtaatggcaagattgtacattagaagatagaaaagtaggttttgcatcttactagggaagatacatgtatatttctctccctttggactgatcatt

SEQ ID NO: 1552 - DNA, 1059 bp, Homo sapiens
atgtgatcaattactggagtcacctgtgagggaattgcgagtccccatttactgaacaagaaatttgagtcaggcagatgatccgaggtgatggtgacccatgatggaatggggactgcagctcaggtctgtccaactctaaagcctgctggttcttttatcttggatcttatgtttgaccacactgtaatcaggagataccactaagatgggaagatgagctgccgagatgggtgtggggcctaggggtgaagtaagagtcaggaatgcctgaggtttttagtttgggagacagggagaacgatggtggcaatggcagaaatagacatatggaagccaggaagaggtgcagcagttggtgagagaatgagcattattttagataccctgagtttgagatgacagttccattcaagcaggaatttcattaggcaagtgacaatgccacccccatccgcctttcattaaatctgtcattttcttttcttctaaattgggaatgttgcagagaaactgtgaaatagatgacacccctcttacgtgccaaatacctgacctccttttgcagcttcttacctttcactttcagaaatattctcccttgaaggggcttcgtgtttgtgtgcaggaattaatagcattttctatccctgtgccctgtagggaaagagcacagctaaacaaggagagagaaaactggagttctgagctgccttgctccgagtttggttggaggccccttatgagggtcagctgggaatgaaagaaaagtcaagtcaagccctgccagcaccctccaccacctgacctcccatgggtgactgaagagccagctaatgaacaagttcttttaaaggcagcctggggagtgtgggagaggctgagttcagcaaaacatgactaggtggtgctggtgctgtttcggggtgtggaggcagaagtggttgatctccttaatttgaataactttggaatggggagatggtgctttgatagaggatttgattggagattttgattgtaggatatgttgaaagaggggatcaggctaaagccatt

SEQ ID NO: 1553 - DNA, 1040 bp, Homo sapiens
cttgcttcaactccatttattacattcatcatgacacaaacttttaccagctccatttctggctgcttgagatccaaactactctattggcctttggagctattcctcctcttgcacctttatctttgaccaagcctcagtgccaccttttgttccagtaaggacatcttcctccctaccccacagagaggccacgctcaaacattcctatctcttggtgtacgttttctcttactctgggatatcctctcctcacccttcatttactgaaatcctactcttcctcagaatactacttcagatttctgtttccttccctttctctctctctttctcctctcctgccttccctccacaaacttggaggcctactataatgctaggtgttgttctgggtcccacaagtacattagtcaactgaacagacaaatttattctttttttttatttttattttttgagatggagtctctccctgtcacccaggctggagtgcaatggtgtgatctcagctcactgtaacctctgcctcctgggttcaagcgattctcctgcctcaccctcccaagtagctagaattacaggtgtgtgccaccatgcctggctaattttttgtatctttagtagtgatggggttttaccatgttggccaggctagtctcaaactcctgacctcgtgatctgcctgcctcggcctcacaaagtgctgggattacaggtgtgagccactgtgctcgaccaaatttcttcttttcaagaagtttagactacctccagaagcctgactatagtaatgggattccccactgatcttcctgagctttcaacactttcattgtagtatttattcttaatttcatgtccttatagtatacaataacataatttctgtactatataattatatatcttgtgcaattatgtaatatgaattgttatgtgaaattttgaaatgtatatttggatcatgtcttcacaattagattgtaatttcttgagaacagggaacttcatacttcagaaatcctcagtttatccat

SEQ ID NO: 1554 - DNA, 1536 bp, Homo sapiens
taagtgatcctcccacctcatccttccaaagtgctggaattacaggtgtgagccaccacacccagcccatctatgtttttgatatcaaattgtagtttctcagtgtcagcttcatctgtactgttagaaatgcagtatctcaggtcctactccagtcctactataacaagatcccacaacatagcatgtgatttgtgtgcacattgacatttgggaaatgctgttccattcacaaaggtgcacactttttggcttggtctttaagcccctctacatctggaaagcctcaaacaggtttccaaccttatttcttgtttctgttccactatacccgagccaaacagaacattcactccagtgagtcactggcatcctgttacttgaggttatgtggtcagtctttccatctttgcatgtctaagtcatgcccatgtcttaagacccatctcaggtgctccctgttccaggaaactttcctgattctcccagaaggaagaaagttctccatcttctgaattcttacagcattttatttgttcttctcttagggcattcagcactatctaccttctgttatcttctctgagtggactgtataagtttgtttgatcttctggtgtcccacagtgcctagtataatatgtggtgtatagtagatgctcactaaatattgtggaataaataaatgaatgaatgaatttgaaattagtgccaagtgtatcttattttccccattttctatttttgtttattgccttaataatacaggacacaaattatcctttaaaagccagctctgtgcaatgaagatggggttaaggttgaggagaacatgacatctcaaaataagccagaatgaaaatttcctccagatgtttttttcctcagagtttcttatctttcccaagtcttattctctttatgataagagaatcatctgataaaaaaatgttattttagtatgtgataaatgaagacttaggggaggaatcatttgctttagaaaatgattcaaagttggatttattctgttggtaatctcatcctaaatttaaaatagcatttgatttttagtactgtatcatattctcagcttatggacgtatttgttacaaattaaggttcagatgtgttaatctccaagtcatcttgtgtccggaattggtgggttcttggtctcactgacttcaagaatgaggccgcggaccctcgcggtgagtgttacagctcttaaggtggtgtgtctggagtctgtcccttctgatgttcagatgtgttcggagtttcttccttctggtgggttcgtggtctcactggctcaggagtgaagctgcagaccttcacggtgagtgttacagctcttaaggcagcgcgtctggagttgttcgttcctcccggtgggcttgtggtctcgctgggctcaggagtgaagctgcagatctttgcagtgagtgttacagctcataaaagcagcatggacccaaaaagtgagcactagcaagatttattgcaaaaagcaaaagaacaaaccttcca

SEQ ID NO: 1555 - DNA, 1022 bp, Homo sapiens
acagttttatgtcccttaagtgtactttaatctagtattattttctttccatgaaactgatttgttgaagagaccaagccagatgtcctgcaaaatctcccatcttctagatttgtctggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcatctgataattttagtatcagttgataattttagacaagttactttttgtcatctctgtacctctcttacttgactataagatgcctctctgaggctgggcacagtggcttatgtctgtaatcccagcactttgggaggtggaggcaggtggatcacctgaggtcaggagtttgagaccagcctgaccaacatgctgaaaccctgtctctactaaaaatacagaaattagccaggcgtcgtggtgtattcctgtaatctcagctactcaggaggcttagggaggagaatcacttgaacctgggaggcagaggttgcagtgagccaagattgtgccattgcactccagcatgggtgacagagcaaaactccgactcaaaaaataaataaataaataaataaaataaaaatgcctctctgagaaaaggagaggattgttaatacagctcatcaggcaccatgcaaatagtagtttgtaaaaacgtattagtcttgggagaaaccacacacacgaatagtgtgcaagctgacaaggtgtcaatttgttattattaagaatcacagcaataattttttta

SEQ ID NO: 1556 - DNA, 1533 bp, Homo sapiens
gctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaagtacagataatgaatttttaccaagtgaaccaccacagatcaagaaatagaacattactagactggggtatatttgtaggagtgacattgttggttttagaggtatatgaatgataaaacttagtattacatattgttgaacgttttcccaaagtggttgtaccatttagcagggatattctggttaccccacaaccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttccggatatgtgtcctttctacgatatatatgtattgcatttcccttttttcaatctgtagcttgccttttcgctcttttaatggtgcttattcatgaatggagattctctaacttttttttttctttttgagacaagatctcactctgttgcccaggctggagtgcagtggcacaatcacagctgaccgcaaccttgacctcccaaggctcaggtgatcctcctgcctcagcccccaggtagctgagacctacaggtgagcaccaccacactcagctcttttctatatttttagtagagatggggttttgccacattgcataggctggtctggaattcctaggctcaggtgagacatctgcctcggcctcccaaagtgttgggattacaggcatgagccactgcacccagcctgagattcttaattttaatgaaattatactttatcaatcttttcctttatggttactgctttttgtgtcctgtttaagaaatcaatgcctaacctaggagtatgaacacatttttctgtgttaaccttataacaattttattttagtttttgcatttctttttttttttttcagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagatggggattcaacatgtttcccaggttggtctcaaactcttgggctcaagtaatcttcccacttaagcctcccagagtgtggggattacaggcatgagccaccccacccggctgtgattcactttttactacatggatgtgtctgcttgatccagcaccatttattgaaaagactatccttttccttctgcactgtttggcactttttttcttaaatcggatgactgcatggtcatccaatttatga

SEQ ID NO: 1557 - DNA, 1096 bp, Homo sapiens
cacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccg

SEQ ID NO: 1558 - DNA, 1022 bp, Homo sapiens
aagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaacca

SEQ ID NO: 1559 - DNA, 1083 bp, Homo sapiens
ttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgttt

SEQ ID NO: 1560 - DNA, 1026 bp, Homo sapiens
atgtgaaagaagccagacacaaaaggtcacatactgtataattccatttacatgaaatgtccagaataggcaaatccaggcagaaagtagattagtggtttccaggaaccagggagagggaaactgggaagtgagtgttaatgagtatgaggtttcctattggagtgagaaacacgtactggaattagacagtggtgatggttgcacaactctgaatatactaaaatcatagaattgtaagatttcagaagatgagctgtatagcgtgttaatcgtttgaataaagctttgtttttaaaagaagacaaagaaataaaccaaagctgagagaagtaactaacccaatcctttatcttttataagagtttttttaatgataaagactcagttaaagtccaatttgattcagttcagttaaagctaaatggcttagaatgaatcatgtctaaatattctgtataccaatcctacctatattatagggccctaaaagaagggtcagacgaagtatgctctaagtggctctcagtactgaatattcacagattaagttttacaaaaaggtaaagttttgtgataaccctcagataaaacagaaacatatgacctatgttttgacataaaacatacgtatttggcctgttctgaaagatatgtataattttcacacaccacattctaccaaggaaaatgtcaaccggagccaaccaacttggtgttccactcatcaactcttttatgccaacatggtgtttctgcccttgtctcagaagccaactactgatacctgcttcagaaaactgactatgaattccacaaagtcctgcttttttcttttggattgtacaatcaacaaacaagtcacccttctaaaactctgtttctgaaattttaacataattcctgaagttccagagtctcttaaatgctaaaatattaacaataccattccattttttcccctaacactcagaagcatactgatacccatcctgtacacagccttttcttgcctgataacaagag

SEQ ID NO: 1561 - DNA, 1033 bp, Homo sapiens
caggctggtctcaaactcctgacctcaggtgatccgcctgcctcagcctcctaaagtgctggaattacaggcgtgagccgccacgcccggccgaaaatacatattttcatacattcattcttgatcattgtgcaactaacagctagaacatggcctggcacacacgatgcactcataaatggatgagtggattaacaaacaaatgaataagggggtcagctatcaataagcataataaaattgtggctaagagtttaggcactagaaccagtacacttatgtccaaatcccagctccagcacttgccatcaattactagtgttttcctagcttcagtgtctctctacaaacaaagacaatggttgtaccaacctcaaaagactattaggagaactgaataagataataaggtcaagtgcattctcagaacttggcacactgtaagcacttacaaatattaattggtatcatgatctttgttgctattttttaaatttagtattggaatggaaattatcattagaatggaaactttgcaaagtccacagaaagaaagatagggcttctcttcgaacaacgggagaagagaagaaaacaagttttaatgaggagacagaaaggagataatttaaaattatgaaaagaattattctaattcaagtgctacattctctgtgaaagtggttgctctcttttctgtgttggtaatcatacctttcagaatgttcagggttgtccaacttttgtaatttcattctttttgataaagtttctttattaattgcatgaccaaatgtaagctaatatttacaactttgaaaagtttacacacgcacacgcgcgtgcacaaattagaaaaaatgttctatcccagtatttaagatttatttatttatttgagacagagtctcgctttgtcgcccaggctggagtgcagtggctcgatctcggcttactgcaacctctgccctctgggttcaagcgcttctcctccctcagcctcctgagtaactgggattacaggcgtgtgcca

SEQ ID NO: 1562 - DNA, 1050 bp, Homo sapiens
tctcaagatctcagagtgtactgtccttatctctatgaaagcacttgccatgctatattgtatttaatgcaatgtctgtacttccaaatagactataactatctaagggcaggaactaaagtatctcatttaatgtgatcatgtgtttgttgcatggataaatgaaataagaagggattcctggctgcttcttccaggcctgtctccctttgtctttaagccctggaggagtcgaccctactttggcaaaaaacatttagcatgtcccctcctctctctgagtactgctacctatcctatatcccaaggctaccaaatgcatattttaaactttacagaaaataccatgttatttagtattttaccatttttagggtagggcataggaatgtgttcctatctctcctgtattttttctaaccaatgttttctctaatttttaaaccctttcatggaggcgttttgtattttaggtgctgtcattcagagtccacaggatggatgaatggatatgaaaatgaacaaacgtgtgacacaacactgcatgatttacctgcaatgactttctgatcaagcctgaagtgggttgtagcctctttatttactttttatttgacacatagcagagagagatttaaactatctcttattggccttttccctgcgtcttagcttggtttctgtcagtgtttcccagcatcgagaaataaggactaatctgtcatattagatctaaactctaaaagaaaaggactttgggccttatatctgccacccattctttcaatggaggtgacacccctcatttctatatttccagtcatctctcaatgaaaaggaacatgcaggctggctggcctttggagagcaccccacacagttttgaggagctctgcagctctgcttgccctttctgcatcacagcagatccaaaaggtgaaaaaaaaaaaacaaaaaaaggagggggttggggtgttagcatccttgcttcccccaccagcaccacacagctgttcggaggtttagtcttcaaaagcctcttgattacca

SEQ ID NO: 1563 - DNA, 1028 bp, Homo sapiens
tagtagaggcggggtttctccgtgttggtcaggctggtctcgaactcctgacctcaggtgatccgcccgcctcggcctcccaaagtgcagaggttacaggcatgagccactgcgcccagcctacaggacttctctttttaaaagccagaagatattcacagggaggcagaggaggacctggcatttgcttggaaattggtggttttttcttccctgcctcagggctggatcttggcagaaatcttcactttgttaagtcccagatggacatgaaaataccagacagggcacatcgggctacacatgccacctgacaattatttcgtatccaaaagtagatcaccagcttgtgattcttccaggccccctgcctctttcccttctcctccttaaaagctttccctgagagtaaacaatgccaaagaggaatgtactacgtatgcactcccctctgtggaggtaaaataggagaaggatgtcaaaaccatcaaccagaacaatgtcttaaaaaaatctgtggggaaaaaatttatacttagctgctgctattcactgagcatttctgcctagtccacagacaaaggtggctgcatctgctgtcaggagcaaggtcaaccctcaggccaaattcagcccatccgacatgttttatttagcccacacaagtttgacccacttctaactgctcttgggaaatgagtgggtctgccaacactgggcctgccttcccacacagcgggagaacttgccccctttacacaggacagggatgtgttttccagtttgccacagtccctgccactccctgtccttgtcgtccctcattcacttaattatgatacttgcctggcatcttgcaggtttctgatgctgttaccccagtatagaccaagtgcagacagaatttcatttctgctttattaaggcacagtcttgagaaacccattggcttcacacacaattaattaatttgtggcaacaagctactatattggcttgcatgtcactttcacctctctgggcattag

SEQ ID NO: 1564 - DNA, 1051 bp, Homo sapiens
tttgcttattgactgaagttccttataaattctaggtattagatctttgttggatgcattgttagtgaatattttctcccatccggtaggttatctatttaccctgttgattgtttattttgctatgcagaaggtctttagtttaattaggtcccatttgtcaatttttggttttgttgcaattgcttttgggcacttatccaaaaactttttgccaaggctgatgttggtaaaagtatcttctaggttttcttctaagatttttatattttgaggtcttacatttaaatttttaattatcttgagttaatttttgtatacagtgaaaggtaagggtctagtttcattcttctgtatatggctagccagttatcccagcacaatttattgaatagggagtcctttccccattgcttgtttttgtcagctttgttgaagatcagatggtgtagatgtgcagctttattttgatgccttgtaaatggaattgtgctctcagtttcatttttggattgttcatttctggtgcatagaactgcaaatttttttgtatattgatcttgtaccctacaatttggtgaattcatttattaattcttaaatttttgtgtggattccttagaattttctatatacaagataaagtcatctacaaatagaaatagtgttacttattcctttccagctggggtgcttttatttctttttcttgcctaattgccctcattagaacatcaggtactatgttgactagaagtggtgagagcggacatacttgttttattcctcatcttacaggaaatgttttcaagtctttcccctttaagtatggggttagctgtgggtttttcatagataccctttatcaggttgaagaagttctcttctttcctagtttgttcattgttttttaacaagataagatgctagattttctcaaatgctttttctgcatttattgagatgatcatatggagtttgtcctttgtcctttgtaatatggtgcattacatttattgtttcatatgttgaatcaaccttgcattcctag

SEQ ID NO: 1565 - DNA, 1032 bp, Homo sapiens
gcagtggtgtgatctcagcttactgcaacctccggtccccaggttcaaacgattctcctgcttcagcctcccgagtagctgggattacaggcacctgcaaccctacccggctaatttttgtatttttagttgagatggggtttcagcatcttggccagtctgatcttgaactcctgacctcatgatccacctgccttggcctcgcaaagtactgggattacaggcgtgaacccccatacccagcctcatcttgcctttcttaaaggttcacagatcagaactgcacataatcgatacactggatgcaaatatgtaatgaatgaatgatttttcacattacaaaattaatttgtgcgtattatagaaagttcagtaaatacataaaagcaaaatgaccaaaatgttaacagtgtttattaactataatctgtactcaaattatatccattttggtggatgaccttaaacatatgtatgtgtgtataacattaaataataggtaataccgtaagactgtttcacctaattttttccacttaacagtgtttaatgaatattttctcatatcattaaactctatacagcattgttttaatggctgcatagtattccattgtatgaatatgccagaaagattattatttaaccatgaagattgtgctagcattgtgttctcaaggatggtaatgctaactgaaccagcatggtaaggtgttggttggcataccataatccctataaatacatccccagtgttgtatattggcagtctttacattgctgtttgcaaattcctgaaattgcagaatgcttttggccagtttcttatagttgatacagttgttagtctttttctcaggttacagtaatgtttacagtgcctcttgtaaagtcaaaggatttgtaccaatctgagtggcaattttttccatgtttcttcaactagtccttttaagattctcacctgcctttagcaaagaacatatatttaacacctgtggttgcagttatgtaaaaaataccgatgtcaca

SEQ ID NO: 1566 - DNA, 1052 bp, Homo sapiens
ggactcatccatattagaagcaatgattatttctaacatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaagcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagcc

SEQ ID NO: 1567 - DNA, 1077 bp, Homo sapiens
actaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttt

SEQ ID NO: 1568 - DNA, 1035 bp, Homo sapiens
tgctacacacatttcttctctgtactacagaacttgtctggcatgtgccccaaattcagagtcaactgagcggcaggtcttagtcacagcatctgtgactcctgctttcccacctttagaacattctataggagaggctgatggtgagttggagtgtgtttctatgttcttttttcctttgaagagataggatcagttgaaagctgaccccacccacagactttttttgctatctcttttaattaattaaggagtggctgaaattttcctctttgttgacttatgcattggtgggaactttaaaattcatctagtctttctgtccatcccatgctggatctgatgtttacaacattctagtcaagaggtaccatattttctctcttcttgaacatctcttgtggtagacagctctccacagcagtttattccatctttggccagctctaattcttagaaagatcttcttatattcagctgtaatccatctcctcatgacttgtcctcattgacatctactcagaaatttgtctcagagtcctgagacctgtgcaggtgatagggacccaaagagatgcttgtctgtagactttactgagctgacacccagctctccataaaaggagtcaaacccagtgaggagcatgtctggggtgattgctcaggtaaagcatcttagccctacttgtttcatacctccctgcacaggtgggcactggtgggagaataacatttatcaagcagtgtttccctaacctctcttatgataagaatagctcaggtgttctcatggagattctgattcagtgcatctggaatgtcatctgggaatttgtgtgttcaagaaatagccaggtgattcttacattaggaaagttttagaatcactgcagagtgaatctgggaaatcaaagtgtttgtttttgtttgtttgttttttgagagtattagagacaggttgctttggctagatcctgtggtcatttttcccccttggaaatgcctcctacttgctggcctcacttagtacagaga

SEQ ID NO: 1569 - DNA, 1020 bp, Homo sapiens
cctggggaatgaggacatttctgatcaaccaaggaaggaaacctatttgaaggattacaatattttctttttttttttttaatggtgtagttcagaaaacgccagttagactgagactcagatttatgtccactggtctttgtttctgtgccccatcccaaaattaatttatgaataggaaaagagatttgatagtgaagttctttctcactctgaagtctaatactgtttctgggaggaagtaagagaattattatgcccacactgtgcactgagaggcttaaccagcaggtgaagctgttgattaaaaacataggttgatgagtattctcatttttctcctttgaagctttcagaaattttctgctttgtcctggtctaaatttattttggcccagcccttgtctccaccctacatttcaaaccagtagccttccctctatggctcaacatttctctgcctcagttttttccattttaaagatgaagatattgtttggaaggaccagtaaatacaattaatataaaaattgcttctgtagaatcaaacaacctccaacatttctgttggaaatttatagtttatagagtattcttacacaatgatctcctttaatcctcacaaacttggtggaaatggagcctcacaggggctaggtgacttgtatacattgtttacccctacataataagtgacagagctggtacttaaacttgtggcttgatttttctttttttttttgagttggagttttgctcttgttgcccaggctggagtgcaatggcgcaatctcggctcaccgcaacctccacctcccgggttcaagtgattctcctgcctcagcctcccgagtagctggaattacaggcatgcaccacaacgcctggctaattttttgtagttttagtagagacggggtttctctatgttgggcaggctggtctcgtactcctgacctcaggtgatccgcccgcctcagcctcccaaagtgctgggattacaggtgagccaccgtgcct

SEQ ID NO: 1570 - DNA, 1021 bp, Homo sapiens
cttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctctgatccattttgagttaatttttatgtgcgaggagggagtctaacttgattcttttacatgtggatatttagttgtcccaggaccatttgttgaattaagtgcccagaacaagtacatctatatatagagaaagtagattagtggttgtcagagactgtaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatagaactaataataacagtaataaagcaaggtgtctttccacatctccatgccttgtattttcattaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctagagttccaactacttggaaagctgaggcaagaggatcgcttgagcctaggagttcaaggttgcagtgatctataatcaccactgcactccagcctgggtgacagaacaagaccctgtctcaaaaaaaaaaaaaaaaaaaaaaaaaaggcatctcactttaatagtaagaggccagaatatgatgctggcagcatgttgtgaggaaatgtattagatgaaagaagttaaattccagttctccttttttcagaaatg

SEQ ID NO: 1571 - DNA, 1048 bp, Homo sapiens
aggagatctggcttgctgggctccatttgaactttgagtacaacagagacatgagcccttcgggacacatgcctgaggtagtgacaatccaactttggaagagtggaagccctagtttcaaattcaagcatgctttgagtataaattaagtttacctctttttgcacagcaacatggccaatctttcctaagctgctcagcttacaagaaaaggaatcatactgctaagaattcaaacttcagcagtcataggtaagtaaggaagtcttataaacctattctagccacctaaccagaaactcgaaatttagcaggttctttcagtttcaggacagttgtgttcactagatcagaggcattgagacatgaagaacagacccttaaaaagggaaagtgttcccttcagtttgaggacatcactggaacattagggaagtgggaacacagctgctcactctacagtgtgggttgcctttgtgtctggaatgtgtctgacgtcctgatccctgtgcacatttcagggagccttgggaggaccccgaatcactgatggaattgcgcagtgcatggagatggctcagcaggatgagggtaaatgcaggggcaagtccaggccatactgagagacaatgagtggcgctgatgaggacaaagataaaatcaaaagtttgtgcttcatcttcaaaaactcaagctgataacaaacttggcctgatgagaaataataagtatttttctatttacatgagaatttaatctcaaaacagaaatcagaaaaatatgaagtccagggcataaaacctaaaactattgctcatatttattctttctaaatagagcaaagtgtaaaatcttctccataagacatacattgtggttataaaaaggcaaaagtcttagtgagaatcattggtattccatagaagagtgaattaaacacagccaagggaagacccacgtctcatacttctcttgtatattccaaagttccagggaaattccaggtgatagaggttatttcccatactgttaaagcaaggtttcagac

SEQ ID NO: 1572 - DNA, 1630 bp, Homo sapiens
cgtgacccattctggtcattcttccagcatcacaaaaaccaaaaaatggaaatatggccaaatacgtgattagctgtccctcatcttcaggtttcttatctgttacttatagataatagcattaccttaaggattatgatgaagatacaatgtccaaatataaacacagttttgagcaaaatgccttgtacgaattggtcaatgaataattactaaatatgtgaatatttctggattgtatggatcctatgaataattactgaataattattgtgattgcttttattggcagtgctgaaaactcatccctttgtgacctcaagtaacccatgacactttgtgaacctgcagttttttcatttagaaacttgacagattttcattctgacacagaatgtcaggtctcccagaccctagaaaatacattgacttaaagcctttgatacatctcaaagcagtatccttacagtgtcactggaagatggtgcgggctgcagagagggatgctttcaaatgggattaaccagtcctccttccttcacttccacatgaatgctgggcagcccagggtcaacccactgcaccctcaactcaggcaagtccagcagccaatcttaggagacctgggctacagaacagtctctcaagttccaggctcacaaaacctaggtggggatgaaagctgagaaagcgaagaggtggttcaggggatcactctttcctacttgttcctctcacctcaaactcaccttctactgcacagcaacactgaggatcgccaaccaaccctgaccataaccttgatcttgccatgttctgttagtggaatgcaacccaaaatcaatggtgttaggtcatctcaacaaaatatatatcaaaccatattccataagaactgctcgtggccctgttcttttcagtatatgggaaaacaaaatggaaacaacaaaatagcatcaggtttacaaaacttcccaagatagatggtcacacatgttttcaggagacctctatataaatgactttgatcacttgataccttgaaaagaggtcttggggcactagaatgacatctataagtgacaagtataaaatgtagtgctcagtgacattaaaaaacaaatcaacccacatagaggaagagctttggacgtagggatgtcaaactggtctagaatgtaatgaaaacccaagaaggtgccccagtaagaaagaagaaatcaatctaacaatgggatgcagcagcaagaatactgagacaggaaagaaaatattttaaaaaaatgaattattcattcactttctagtggatacagaaaaaactgcagaagacccggaggatatcagggcaggctaaaagtttgatatcttacacctgtggaaaagccttaagctctgttttaactgagagcaggtggggtgacttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagagt

SEQ ID NO: 1573 - DNA, 1032 bp, Homo sapiens
gtaaaaagataatgtagctgcatttctttagttattttgaaccccaaatatttcctcatctttttgttgttgtcatggatggtggtgacatggacttgtttatagaagacaggtcagctgtctggctcaatgatctacattctgaagttgtctgaaaatgtcttcatgattaaattcagcctaaacgttttgccaggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttacaatgaagtacttgggaaagtggttttcaagagtataaatatcctgtattctaatgatcatcctctaaacattttatcatttattaatcctccctgcctgtgtctattattatattcatatctctacactgcaaatttggggtctcaatttttactgtgcctttgtttttactagtgtctgctgttgcaaaaagaagacattctctgcctgagttttaatttttgtccaaagttaattttaatctatacaattaaaaccttttgcctatcactctggacttttggattgttttttacattcagtgttataatatttgattatggtgattggttttggtgggtactgatgcgaattaataaaaacatttcatttccatgtttattttctaatctcttccacattgtaggctatgtttaccatatgtagcagaatgtatttacatttcttggttctagtcatttgtattcttcgtgagtgtgagtgtgtgtgtgtgtgtgtctgtgtgtgtgtctgtgtgtgcctttggcatttaggaagggttgtatagctcatgttaaatattgcactaaaaatgtttttgatggttttcctccctttggactagacacacttctaatatttggtttatagttttaaattataactttcagcatcaaatatttccatacaacagtcaattaca

SEQ ID NO: 1574 - DNA, 1047 bp, Homo sapiens
cgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctg

SEQ ID NO: 1575 - DNA, 1031 bp, Homo sapiens
aatgcaaaccacagaaagatcaggggttgcttggggatgggaaggggcaggagggaaggattacaaaggcacacgaggaaacatttcggggtgatgagtatcttccttactttgctttaatgttttcacaaaatcgcctgtgaactttttcaagattacatttctaaggttaataattataaaattatttacccttaattgactcatctttatacactctaatgttattttttgagatataattcatatactacgtaattcaccctgttaaagtgtacagctaagtggttttagtatattcacagagttatacaactattaccactgatttagaactttttcatcatccccaaaagaatccccatacacattagtagtcactacatatttctccacagttctctcagccctaggcaaccaccaatctattttctgtctctatggatttgcctatataggatatttgttataaatgaaatcatgcaatatgtgaacctttgtgactgactcttttctaattagaatactgttttcaaggttcatccatgctgtagcatgtatcagtacttcatttttatggctggataatactacatggtatggatattccacattttatttattcatcagttgatggacatttaggttgtttacactttttgcctgttatggataataatgctgctgtaaatatttttgtacaagtttttgtgtgatcatatgtttttaattttcttggttatataactaggagtgaaattgctgcgtcatatggtaactgttcaactcattgaggaacagaccataatattttaagaagtgctgatgtgatcatggttagtgtagagcaagttctgccaaatggaagatattgtccatcctgttttttattttgaatgtgtaaatagttcaccccaaatattttcagaaatactgtcattatacttacattcagagtaatgttttcagtttttcaaggcaaaacttgtcaaactgtctctgtgattctttagactgttttagcaaaactc

SEQ ID NO: 1576 - DNA, 1081 bp, Homo sapiens
tcacttgaggtcaggagtttgagaccagcctggccaacatggtgaaaccccatctctactgcaaatataaaaaattagcggggcgtggtgtcacatgcctgtaatcccagcttctcgggaggctgaggcaggagaatggcttgaacccaggaggtggaggttgcagtgagccgagatcgtgccactgcaccccagcctgggcaacagagcaagactccatctcaaaaaggaaaaaaagaaaaaaaaagaaagaaatgtctggatttctaaaacaccaaaaaaaaaaaaaaaatgttgggggaaagagaagacatatgaatggctggtaaatattacatgacaagatgtttagccttattggtatattcgtatcagggaaagcaaactaaaaccacaatgacagggtgatgtcagcgaaaatggtagagtaggacttctgtgggtcatccctctgcagaaacaccaaacaccttgacagaaaagtcagaatttagcttatcaaaactctggaaaggtaatcaaaggtttacagcagccaagcaaatacttcgccagaagaaagggcactgaaacaaggtaagagatctttgtggcattttagcttaccctagcctcacctcccttcctggtatggctgcagtcttgaagatgacagcctgtgttccccatgctggtgcctgattccagagagtggacactcttcctcctgagggattctgtgttctgttttgtcctttctccaaaggactgccaccaggggcaaaaaacaaacaaaaaaaccaaaaaaagaaaaaaaaaaaaacagggcaaacaataagatattgaaagcctgagaggaaaagctgtagagtgagtttttgtagaggaataggagctttgaaaagctattgtggatgagaaactagaaagccaagtgcacagctcagggcagtatgtgtgctcagaaaagacctgagaaagccattagctttcacctctggcttgtctttaggttcaacacaaacaggaagtgaatattaaggtagatttataaaggccctgggtaagttttgaaggagtgccccaacagctaatcagtaga

SEQ ID NO: 1577 - DNA, 1051 bp, Homo sapiens
ttttctttttggtttatttgttttgaaatgtggtcttgccttgctcaggctaatcttgaactcgttggttcaagcgatccttccacttcagcttcctgagtagctggaattacaggcacacaccactgtacccatctatttttgtttttattttttacacattataaatgttcagtttttttaaaaaaaattacgaagcatgtgaagaatctagaaaatatgcttcattcacaagaaaaaagaaatgaacagaaactaccccgaggaagcactaatactagaattactagacaaaaactttaaatcagctgtcttaagtatactcaaagagctaaaggacaccatggacaaagaagtaaaggaattcaagataataatgtctcaacaaatagagaatatcaataaagagaaatttttaaaagtaggcaaagagaaattttggagctgaaggttacaataattgaaatgaaaattcactaggggagctcaacaaaagatatgagcagacagaagaatcagcaaacttggagataggtccactgaaattatatagtttgaagagcacacatttaaaagactgaagaaaaatgaacagagtccaggagatgtgtgggataccaacatatatatcatggtaaggagagggagaaaggtgcagaaaacatgtttaagaagtaattgccaaaaccatttcaaatttgacaagacatgaatatacacatcaagaagctcagctaacacccaagaaggataaactcaaagacatccatacaagacacattataattaaaatttccgaagccagagataaagagagaatcttggaagcagcaagagagaagcaacttgtaaaatataagggatcttaaataagatgaatttctgttgatttcttagcggaaaccatggaggctagaaggcagtgggataacatatttaaagtgatgaaagacagacctgccaaccaagaattctaaatctggcaaaactatccttcaggaattaagaagaaatcatgacatacccagataaacaatagctgagggggctt

SEQ ID NO: 1578 - DNA, 1026 bp, Homo sapiens
taaacagttaatgcattttattaacaagtaggttttctaatgttttctagtgtttttattcaagctgctttgtcaaggagcactaaaacctcttttttaggggtcggggttggggaaacagggtctcactttgtttcccaggctagaatgcagtagcaagatcatgtttcactacaacctcaaactcggtgggctcaagcaatcctcccacttcagcctatgaactaggtaggactacaagcatgtgccaccacgcctggctaatttttcaatttttggtagagactaggttgcccaagctggagtctcttaacacattattggagttgatttgttccttatctttttttttttttttttttaaggatttttacatttattcaaaagaggatgagtctctttatcaagttttggtgtcaggattatattagtttcataaaaggaactgggaaaacttgctgtattcttatgcttggaaatagtttacataacacaggaattacctattatttaaaggtttaatgcaagttacctgtaattccatctggacctggtatctttttgggaactagatctattacagtcttttcagttacttctgtggttgatagtatagggtagtgttttatttatctctgtattctcagcttctagtgcagtatcggttttatagtggctactaaacatgtttgttttgaataagtggataattgtaattatgtctctaaaaagtataaaaaacatatgaattaatagtaataatagctaagagtatgtgccagaaactagtctaaatgctttacaggtattcatttgtttaatcctcactataaccatgtgaagaaggtattgtgaatatctccattttactggagaaactgaggcacagagagtttaggtaaattgtctaagagtataaaggcagttaaatattggagccaggatagtgcaaaaatcaaagtatttgtatttggtgagatttttaactgttcacttatactaaaaaattttagtataactatttag

SEQ ID NO: 1579 - DNA, 1086 bp, Homo sapiens
ccaggtgctattccctcaagaaatgcaaattaaatatgtcggtcttaataaatcaggagggaagcatagtctgtgtctgttttaaatgacaacaacaacaaaacagctttggggtttaagaagtggaagacacatttttatttttttgagacacaatctcactctttcgcccaggctggagtgcagtggcgtgatctcaggtcactgcaacctcccgctcctgggttcaagcgattctcttgcctcagcctcccaagtagctgggattacaggcacgtgccaccatgcccagctaatttttgtatttttagtagagatggggttttgccatgttgcccaggctggtctcgaactcctgatgtcaagtgatcaccgacctcagcatcccaaagtgctgggattacaggcattagccaccacgcccaggtgagaagacagattttaagagaaggagcagggctggtatctgaataggtatttggatgttaggggaaaaccctttttggcctctgtggtagagcgatcggaaggtaaaagtgctgtttacaagaataatccattggagatctggggattggggacgacttataggatagagtcctcttgttgagaatttcccgaatgaatctcatgtaggttctgtcacagtaagatggaggaaaactttgatggggtaagtatcacaagtggctgtcctatagggggaaatcctagcctgcagtaatgtcagtgtctcagtattcagccagcgagccactgagctgctccaggggtttaaaatagaatgcatagaatacaatgtatacagctggtgatgctttccaggatcaaaatagagcccttgtctgatcccattgacattgtaaggtttcgatctctcatacctgccacagacaagtacattgtaggcattcaacttttaaggttttatacatgcaaactttatgttttcctgccacactacacttggtgtccacagaagtgtagtttgtatgttgcctcttcttcctctttcaaccagaacacttagatctgtgatcataggatgtaagcctgtgattctttactttttctaataagaaatac

SEQ ID NO: 1580 - DNA, 1120 bp, Homo sapiens
tttgtaggcttatttgaaggcaattgtatcaacacattttgaaagccaagacacaagtattttaagtttctgtttaaccaagtctcgagataagcagagtaaataaactctttagaagcaagactcagttggtatgtacaaagtgggattgctttgtatatattccgcttagtttgagtcagagctagtaatctgatgctcttaaatgtcttcataaacttgggcagtgatgtttcctttctgtgattatgtgtcacagatttttatatgtggactataattagtatagtacaatggctgaaacttttcctatagttggatatatcttctgagacttccagtgattgtataatgttgagtagctccagaagattatttgaatagtaaaaacaaaagacatctctacctatgtgagtttattatttagttagaaacacagaactaactatttaaaacaggtagagaaagattaagatgaatgtgatgtagtggagaaagctttggagactttggagtcagaactcaaatggctctaggtcccaaatccagactctcattttgattctcagaacaattctgtggaaagagaagatacaataggcaatatccctttttacagataggtaaacagaaatagcatctcaaaacctcatttgcactgggtgaggtggctcacgcctgtaatcccagcactttgggaggctgaggcgggtggatcacttgaggtcaggagtttgagaccagcctggccaacatggtgaaaccccgtctctaccaaaaacacaaaaattagccaggcatggtggtgcatgcctgtaatcccagctacttgggagactgaggcaggagaattgcttgaacccgggaggtggaggttgcagtgagctgagatcatgccactgcactccagcctgggcaacagagtgagactccgtctcaaaaaaaaaaaaaaaaattcatttgcccaatgacaaatagctggtatgttgcagagccagaatttgaatccaggtctttttgcctccatggctagtccttttatctccatgggatacagtctaaaatccttagtttgaggttcaagactatcactaataagagtcttactcatctacttcag

SEQ ID NO: 1581 - DNA, 1064 bp, Homo sapiens
ttgcaaataagggactggaatagggaatgtttaggtggtcctgtttctggaaaggggaggagtcaatctcagaatgaatggggtggtgaaggatgtaagaggtgctttgcatatagtagatcattactgagtgtaaggttttagagtgagaaggatctgtattaattgctgtgacaggcaacaattaactctttttttttttttttttcctttgagaaagtgtctcaccctgtcacccaggctggagtacagtggcatgatcatggctcactgcaacctcaaccagcctgggctcaggtgatcctcatgccttagcttgggactacagttgtgtgccaccatgcctaatttttgtatttttttgtatagttggggttttgccatgttgcccagactggcctcaaactcctaggctcaaaggatctgcctgccttggcctcccaaagtgctgggattacaggcgtgagccaccgcaccaggccctatttaacttccttgtgtctgtttcctgatgagtaaccaggggatgtttgcttgcaagggttgtataaggttagaatcatcatgtgtaaagcatctgattcatcatacaggttttttaacaaatttattaagagcctgccatatgtgtgggacttttcgttggggtaaagaagacaaagtccttacatatatatagagcttacattctgatgccattcaaaacagtggtagttattgatttgaggaatgcctaaataaaatggagttaagaatgccaaggccaggcaaaaacctgaatcagttgcttgttatgcaaaaacgttatgacaaattattggaagtttcactttttgttatctaatagggaaaacgctaatctatattggtaaatggttttcagaggactcagctacatgtgtttaatatactcaatctggccatcagcctttgctgaggagccgcattgttcaaaacccatctccaaaccaagtctgtctcttgccttttcttcctctaatagctgaaaatctgttgcttcaacttgtagccctctgttcatgcagtgagtagaggtagttgta

SEQ ID NO: 1582 - DNA, 1937 bp, Homo sapiens
ttggagtcaccatagtggaaatttatgacctggtatccagttcagatacctggagcttcttgactggggggagattggatcccttggggaagagtgaagccttcaatgctgccacaagtgtgatccgcccgcctcagcctcccaaagtgctgggattacaggcgtgagccaccatgcccggcctcttttttatatttaaaaaatatcattttatatattatcagggcaaaagagaaaaaccgtatgattaccttgtcatacacagtaaaagcatttggcaaaattgaaaacttttttcatgatttataaaaacaaaccccagaaaatgctcagcatgatgagaacagaaggcaacacttccaaccccattaagggcagatttgaagaacccacaggtaacattatattaaatggcataagattgaatgcttttctattaaatcagagaaaaaagtagaatacctgttgttactcttttaattcagcattatactagagctctaagtcaatgcaataaagtaagaaaaattaataaagtattgaaagaattgaagctgtctttattcacagataatgactgtgtttgttaacaatgctagaaatctacaaaaatctaccagaactaatcagtgagtttggtagtgttgcagaatgtaagctctcaatgtaagtggtcttttgtatttctgtatattagcaatgagcatttggaaaatgaaataagaatacaatttcatttaaagtaacatctaaatacatgttgtgcttataaataaattcaacagactgggcaccatggctcacacttgtaatctcagcactttgggaagccgaggtgggcagatcatgaggtcaggagatggagaccatcacgcctaacacagtgaaaccccatctctactaaaaatacaaaaaattagctaggcgtggtggcatgtgcctgtagtccagctacttgggaggctgaggcaggaggatcacttgaacctgggaggcagaggttacagtgagccgagatcgcatcactgcactccagcctgggtaacagagcaagactctgtctcaaaaaaaaaaaaaaaaaaaaaaaaaggaaagtcaacaaaatttatgtaaggccagtacaccaaaaactacaaaaaattgctttgagaaattatgaaagaactaaattagtggggagataaaccttgtcatggatcagaagagttgttatgtttaaagagtcagttcttcgtaaattgatctccagatccaatgcaattctaataaaaattccaagcggcattttggtagaaattttcaagctgattctaccatttatatggtaatgtcaatgatcaagaataataaaatagcaatattataaaagaataatggtgaatgaattcactacctatttccagaattactctacatacagctatgaaaatcaagattatgtgttttgttgaaaaaaaaatagaatatatatcagtggaagagaagagagaatccagaaatagatactcacatgtatgtctaattgattcttaggacatatatatatgtatacacacccacacacacacacacaaacgtgtgtgtgtgtgtgtgtgtgtatatatatatattcaccgttttgaagattatcatctccaaatagggaatatatatatatatatatatatatatatatatatatatatatatacacacacacacacacatatatatattgcagtctgataagataaacagcacaatgaaacaatttctcaaaagacttgaatagatacttcagaaaagaagatacatgaatggtcaattagcataggaaaagatgctccactgtttagtcatcagggagatcaatcagtgcaacaatgagataccagtacatatccataagaatggctaaaattaaaaaggctgaaaatagcacatgttggtgaggatat

SEQ ID NO: 1583 - DNA, 1042 bp, Homo sapiens
gagggggcgccaggcagggcctgtcccgcctggggagactgcgcccgggataataggagcgcttggcctctgagactacccggcagaagggacgtccccaaatgacactcggaggccgcctccctgggctccggtgctcggtgccgggaggagcggcacggctttctaccccgcctcaggtgcgccagcacgttttctgggcagcatctgtgtgttaggcgaccggagaggtgggttccttatagggaataagaaaactgaaactgacttccaactgcaggcagaaggaagcagtggtcattgctggaggttaaaactgttctgaccgggcgcagtggctcacgcctgtattcccagcactttgggaggctgaggcgagcagatcacgaagtcaggagatcaagaccatcctggccaacaaggtgaaaccccggctctactaaaaatacaaaaattagctgggcgtggtggcgcgcgccggaagtcccagctacttgggaggatgaggcagaagaatcgcttgaacccgggaggcggaggttgcggtgagccgagatcgcgccattgcactccagcctggcgactcagcgatactccgtccccctctccccgccccaagaaaaatctgttcagtggggagcgacaaggaaggagctttcagcccgactggggtcgcagggaagaattcaagatggcgtgtttaggagctctagctccttgacaaattagtaaaatgttagtcttaggagaagaacgaaaaggctctcctaggctaagaaacagcatacacagtgagaaacctcagaagaaataaaattcaaggaagatagcaacaacgaaaacatcagaaggaacactaaaggtataaaaagggcaaagacagccctagggttgggagggatccaggttttttatgaaaattagtggaatccctaagatacttacctttgtattataagtatttgcatgtctccttctagaaacgtttatcactctgtgttacacagaccagcagtgttggcgtcaactgggagcctgttag

SEQ ID NO: 1584 - DNA, 1423 bp, Homo sapiens
agcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacctgaatatcgtcatagccaagatggatgccacagccaatgatgtgccttctccatatgaagtcagagttttcctaccatatacttctctccagccaacaagaagctaaatccaaagaaatatgaaggtggccatgaattaagtgattttattagctatctacaacgagaagctacaaacccccctgtaattcaagaagaaaaacccaagaagaagaaggcacaggaggatctctaaagcagtaggcaaacaccactttgtaaaaggactcttccaccagagatgggaaaaccactggggaggactaggacccatatgggaattattacgtctcagggccgagaggacagaatggatataatctgaatcctgttaaattttctctaagccatttcttagctgcactgttatggaaataccaggaccagtttatgtttgtggttttgggaaaaattatttgtgttgggggaaatgttgtgggagtcgggttgagttgggggtattttctaatttttttgtgcatttggaacagtgacaataaataagacccctttaaactgtaaaaaaaaaaaaaataggaatgcggtccatggtttacttaatcgtataatatcagtgttcattttcttattttgataattgtcataatgttgtgtgaaatatt

SEQ ID NO: 1585 - DNA, 1031 bp, Homo sapiens
tcttattttttttttttctttgagacggagtttcgctcttgttgcccaggctggagtgcaatggcacgatctcagctcaccgcaacctcctgcctcccaggttcaagtgattctcccacctcagcttcctgagtagctgggattacaggcatgagccaccatacccggctaattttgtatttttaatagagacggggtttctccatgttggtcaggctggtcttgaactccctacctcaggagatcctcccgcctcagcctcccaaagtgctgggattacaggtgtgagccactgtgcccagccaagtctttgtcttttaattggtatacttacaccatttatatttcaagtaattattactatgtttgagcttaactctgccatcttatttttattgtttttagtttatctctgtttctttttcttgccttcctgtgaattatttgaacattttttagaattttatttttgtttatttacagtgttttttagtttatctctttgtgtagctttttagtggtcgttacgggtattgtatgtaaatgtacgtatgtgtgtataaaatcacagactactgatattgtcattttacttatttgagtaaagtatggaaacattacttccctttatataaacattacttccctgtatatctatcttccctttgtatttatagctttactttttgtttataattgtcttaaatatttcctttagaaccacatcagacactgttataatctttgcttcagcggtcaaacataattttaaaaactcaagaaaaggaaaacctattgtatttacacgtttttgaatgctgcattctcaccttgatgttccaaggttccatcttttatcatttcctttttttccaagggcttcctttagccattctttgagggtaggtttgttgatgataaattctctttgttttccttcatctgagaatttcctcttcattcctgaataccatttttcttgattacaggagtctggattgacagttcttttctttcgatatttgaaacat

SEQ ID NO: 1586 - DNA, 1026 bp, Homo sapiens
ctctcttttgattatcttcaaagggacaatttctcttaaaaaatcttattataattcttctttgtgcaatagtagatatatcagacatgttgtacccttccccccaatttacctgttgaaaaaatttgatagttcacctgggttcatgaagagaccaattacatgctattgaatattacctccagtttgtcttgtctttgtcctacttttgagcataatacacttgctttcattcctttctctggatctcttgcatcattctggcaaagtagatgagaaataccattgtaccctagatgggcccttttttccgaggagtcagtgcgatgtgaaataccctttttattgacctggtaaagatttgttcattgatgagaccacatatgttaatttctgtgatgataattgaagtttggtccttgtcctataataaaccaattaataaatttagaggtcacttggaggaaagtcttagatatgaattctatttttactggtctgaaagttgtagtttttagagtcttaatgtagatacgatcactgtgtattattagcccagtctcaaaggtcgctgtcccctggtggggccccctctatccctggtgtcctttgctttctttgtagggacttttaacagtatctccttctgagagcttgtcttggtctgtttttcacagactgggtaattcatatgagcagaaatttatttatcaccgttctagaggctgggaagtccaagatcaaggtgccagcatttggcaagagccttcttaactgcatcctcacatgacagaaggtggacgggcaagagggagcagaagagcaagctatccaaatgctgcatgacacttttttttttttttaatatataaaggccttaatcttattcacgagggaaaagttcttatgaactaaccacctgttaaaggcgctacctcttaataatattacattgacaacacctgaattttgaaggaaacacattcaatccatagcagttgtcatatcctggcatctaaccttatg

SEQ ID NO: 1587 - DNA, 1032 bp, Homo sapiens
gagtttgtatgtgttgggtaagtatgagtttgagggggcttctcatagcaaaaatctccagaccatagactgaagatcacctggcgaacctgctctgattactcccatgttttgggttacctgacaaaatataagacttctagtcaaatgcatgacatacttgtattacatgggacacacttgtgttaaaaagttattcattatttatttgaaattcaagtttaactgggcatctgtatttccatttgcatatctggcaatcctacaggtagtataattctaatttagaataatttttgaaattcaagacatctggggaaagaagggattttaagtcaaagagccaaatttgaatgctggccacattcacatccagctgtgtgactttggataagttgcctaatttctgagcctcacttaacttagctataaaaatggggacagtattcctcacttgaaatttctaagctgttatgctgatcaatgagattaaacgcaaaaatattctggaaacaaaacagctttgtgcaaatgagataagaagttatttgagtgttcctcgttcttgggctaagaacaagtcatgattccagaaaaaagatgatcccaatgaaggaagaaatactataaaaaaatgatcatactggcctagaatgcaaaataagcgtgaaataagaaacaaaaataaatttctttaagttctctagggttcattgccttggttctacttttgtcccacacttcttgtatttttttttcttatgtagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctaggtaatcagagggcacttgtccatttagaaactaaatgaggatgtgatttcaggtagtaaaatattttataatcacactcatttgtatgatcccaagaatatgggatgga

SEQ ID NO: 1588 - DNA, 1971 bp, Homo sapiens
cctagtcaccagagttctctctttctagaggagtctaggaaaagcccagattcccatgggtttcaaaattatccctttggaatgactgtcttaggtatggcctgaactaatctaaaacttcagatttggcaaaattgctcaactttaggaatgtgcaagttaaataatttcatgtcttactgtatttcattggttctcgtatatctgccataagtatgttagagttggagaaggacctataaatgccttctggccagttttttatttcacagacccagaaaggttatatgacttgcccaaggtcacacagccaacaaatggcagaaatgagattagaattgaggttttcaggttcattgctttctctacccatttggggcttgaatcttgaaagagttccccataatttttcctcttacacttgttgcaagctcagattaaataagtttttataatgagaatattgttttgacagtgctgtgcttctttgtttatgcaaatttaaaataacagccagtaacaagggactctaggcttgactttgttcttgacttactccatcattttgccgcctttcttccctcctctcgctatacaaaaattttctcgtgttatggaaaatgagacatcacttaccccttgcttctctaaagtaatgcttctcagacttttcaacccatatagctgtagatgagaggatagtgactttacacccccaaacagggcatagttgtagatgactgaccacaggctttcttcagagtctccagtttttcttttcttttttttttgtgtgtgtatttgaattttgcattttactcttcacatatctgtatttattttgctactaaaatgaaagcttatatttctttccattgagcaaattgacattccagaaagaggcaccttgtttattctagggcttatatcccctgttgcattgacacgtcccctgggaataatctccactctagtttgaggatgactgctctgagggatacagctacctgtggaggtgtattctcatagaaagcatttggaggttctgaggcagtctataaatcatacgacacttatatttctactttggtatttatttataaacttttattgtttggtaaattttgcctgagggaaattgaccttaaataccactagacttggcagtgtttccttttctttttcttgccaggggccatcgggttttacttttctcccaaatgacccagatgttggatattctccaagactatatggattacagaggtgacaccttttggccactacattacctaaggctctgttagacttaacagtccagataggtccatgaagaataatatgggatatgagaatattacaaaggaaagcagggtgagaacattattcagaaccaaaaaatcaaaaggcgagaggagagtgatgtgtgaaggcaaggatggacagcagagaacaggcacgtgggcagaaataaacacccacgttcccatcagttacatgatttaaaattatgggccgtggagcaaatgttgtggaaatgtttttgaaaatgtgtgataaagtttcagtgactagagcttttagcgtcttgtaacattcacctcaacagttgagcacttactcatgatcagtgaaaaggtgaacattgaaattatagagataacaaataagccaggggaaaagtaagagcaactttttctgcatagacaataaagaatgtaggttattacctgggaagtctgtttaatatgtaataagatttgtgtgagatgatgagaaaaggctctaacatgagttgatcttgagcccaatgttgaacagctccagaccttacaatttaaaaaagtagttcagaccgggtgtctgagttccgcagtatacctggtccagtggacacttgcagaatgccgttggcacatgccactggccattgaggggtccccagatgcataaacagcctgatcctgtagc

SEQ ID NO: 1589 - DNA, 1050 bp, Homo sapiens
gcctcagtccttatggtgccaagaactggggaggatggggcactgggactggggtggtggtcccagtgtagtattgtacagtcaaaaaagtgtgaattttagagtcaggagatattccagaatcatttcactcttggctttctcatttacctggtttagttacccaacctttcaacttcaacttccttatccatatgatgggacaatatctgtcttatcctctgcacaaggtttttaagagggtgaaatgaagcaacattgataagacaaacaaatcctttgagaaaaagcaaaacttcaagcttgttcccttgcttgacctttgtactttttacttcatctgcctaaaaccctttcttcccaaataaccacatcaagtgttgttcaaatgtctgtttctcagagaggtcttctgtgattacctcatataaaacaggccccatcccccctctgttattctctgtcccttctcccatattttcctttatcacacctgtcccacctgacacattacctatgtatttgtttatttgactgttgctttgcattaaaaaatacacttatggcagcaggggttttttcttgttcgctgctgtgactgtggtgcctagaacgatgccttacgtgtaatacatgctaccaaacgtttgtagtgtgaatgaatgactataaatgctaagatactaagcagctttgttagtaccagcttgaataagtcacttaacctttcctgtgtactgtttcataaccttgcctatgtgctgttgcataacctattgcttctactcactctgtaatgttccatctactctccgtccttccgcagtcatttgccaggaatcacagatgcaccacagagattttgctcattgagaaccctaatttttgagatgctttcctgttatcatggccccagctatatcttccagaaaacataaacatatttgggaagtccaacctgtgatattcctaggagataagatattttgtttcttccctttgaaaaatcattcttccacaagtcccttttgtgtgcctttgtttttctaa

SEQ ID NO: 1590 - DNA, 1052 bp, Homo sapiens
acaaaaggaggaagatcttcagcaatgtaatattgtattatacctcaaggaactagaaaaaagaacaaactaaacacaaaattagtagaaggaaggaaataataaagatcagagcagaaataaatggaatagagacttaaaaaattacaaaagattggccaagtgcggtggctcatgcctgcaatcccagcactttgggaggccgaggcgggcggatcaccaggtcaggagattgagaccatcctgactaacatggtgaaaccccgtctctactaaaaatacaaaaaattagccgggcgtggtggcaggcgcctgtagtcccagctactcaggaggctgaggcaggagaatggcgtgaacccaggaggcggagcttgcagtgggccgagattgcaccactgcactccagcctgggtgacagagcgagactccatctcgaaaaataaaataaaataaaattatggaagatcaacaagataaagagttggtttttgaaaagataaatctttagctggactaagaaaaaagtagactccaaatcagagacgaaggagacattgcaactgattctacagaaatataagggatcaggctgggtgtggtggctcatgcctatagtcccagcactttgggaggctgaatcagggagatcgcttgaggtcaggagttcaagagcagcttggccaacatgctgaaaccccatctctacgaaaaatagaggtgggcacctgtaatcccagctacttgggaggctgagacagaagaatcacttgaacctgggaggcagaggttgcagtgagccaagattgcaccactgtactccagcctgggcaacagagcgaaactccatctcaaaaaaaaaaaaaaaaaaaaaaggatcataagaaactgttatgccaacaaatcagatcacctagaagaaatacgtaaaggtaaactcttggacacatccaatctaccaatattgaattataaagaaacaaaaaatctgaacagaggccagttgtagtggttcacacctgtaatctgagcattttgggaggctgaggtgg

SEQ ID NO: 1591 - DNA, 1049 bp, Homo sapiens
aagaagtttatctcagaagtagagactagaatggtggttaccagagggttgggtggttagtgggcttggggagttggggagatgttggcaatgagtacatatttacaattaggagaaataagttcaagacatctaatgtaccgcattatcttgctaatgtacagtaagatgacattaacgatgtattgaaaaatatttagaatggatgttgtgttctcacaaatatatcagataatgcatatgttaattagctagatttaaccattctgcaatgtatatataaagaacatcatgttgtacatgataaatatgattttatatgtcaaattaaacaaatttgaaaaggaaaatggaaaaaatgcatatataggaggatagcagacatgacaacatctggataatagcattatacaggacagaaagattaaaatggagatgaaaaattattagaataaatattggagacaaatttctcattaaagaacgataaactacttcaaattcagtgttcagagagtactaagtagaagaggtgagaacccatacctagacatataatgacatctccaaacatctcagcggttttgccacaaaggattcattttaaaaacatttttggaggaactgtttaaataagagaaatagaaccagcagatgttggcctggaccactttactaccttgctaacatgtctcactccttcaccccactttaggaacttagtgtagctcagaatctttttactattcacacacatttgaataaattctcggctaaatataaaatttgtttcaaagtaattttccagcaatcctgagcaaaaagaacaaaactggagacatcacataacctgacttcaaaatatgttacaaagctatagtaaccaaaacatcatggtattagtataaaaataaacacatagaccaatggaacagaatagaggatccagaaataaagccatgtatttgcagccagctgatcttcaacaaagccaacaagatcttacactggggaaaaaagactatcttcaacaaatagtgctgggaaaa

SEQ ID NO: 1592 - DNA, 1109 bp, Homo sapiens
gacagagatattaactagcagactgtcatagtgaaacaggtgaaaggtgatcagggccgatggcagtgagaaagaggaggaagggatgtatttaaaacattttggagatagaatctgcaggataatgtaggagtgagggagtagaaagagtctaagatgaatcaggtttctggcttaggcatctgaatattaaagaggccattttctgaagggaaaaaaaaggagttaaaaaagaagaatcagtcacaggagaagattagttctatttatgttgaatataaagactctgtgggacatcttgatggtgatgtctaacggagcttgtggttggaaaaatctagctagaactctagttagtttcgtcaggcatttactgcttattttctgtgtgttaaatattgtgtttaacaggatgtctgagctggagctattggtttgagagccatctgtttgtaagcagcaattgaaactatggaaaatcacctagaaggagcatgatgaatgaaaagagaaagtcttgggatgggactctggagatccccgatatttaatgaaaaggtggaagaaatagctaaggaaaaggagaaagatggtgtcacagaagccatgtcaggaagagaacttcaggaagcattgaggagtcaatagtccaaatccacaaagaggttgggcaagatgtaggcaggaaggtgccttctagatttgacaatttgaagccatttgtgaccttggcgaaagcagtttctatgaagcagggcaggtggaagctttgcagtatcatctttggggcaaaaattttattttcaaattcttgtctatttacactctctgccttttgcttctgttcctcatcctatccctttgccccccattcccactcttcctaacacaaaattgttgactgattttcttttctttttttttttttttttttgagatggagttttgctcttgttgcataggctggtgtgcaatggcaagatctcagctcactgcaaactctgcctcccgggttcaagcgattctcctgcctcaacctcccgagtagctgggattacaggcatgcgccaccacgcctggctaattttgtattttcagtagagatgggg

SEQ ID NO: 1593 - DNA, 1023 bp, Homo sapiens
ctactgtaatagccgtttaactgggtccccacactttccatcctaagttcttctgtctggtaaaccttcctgaagtaaggctctgataaataccactctcccactgggtccgttctcaggagccttcccatttaagtgcagattcttatcctgcactcagaggtcaccttcctttttggccttctcgcctactaagccactgaacaactttactgcgcatcaagagcttggctagcaggcgcctgccgtgagcaattctgatttggcgggtctgctccggggccaggggacccgcccttaataggcctccatgtgatcccagtgctcgggaccctatggaccacacactgctctcgcaggcttttcccaagcccgtagtcttcagcccctgtgcccggctatgctgttcttttaccctgaaacgctctcagccccctctccacctgttgaaatttttctcatgctttaaggcccagctcaaatatctccttcgtgaagcattttctgattgttccaaatggataagatgcaaactccttagccttaaatttaagatgctctgttttacaattccaggcccatctcctgccttcctgcctggttcctccgctatccctaagcccaccacaccgaaatggttctcagcataggccctttacacatacctccgccaggaatgtggttcgttttctctctctttctctctctctctctctctatatgtatatacatatctcctctctccccacccaaccccgtctctcctaaacttaccctgctagacccggctcatatgtcacttactccgtgccacattcatcacaacgacagtctttctagactcttccccgcccccatagccgctaagtcactccctcccctgtgcttctccagactttatacgcccgagagaacccaacgacagtagcttacttgtggtttatctgttaatttgaacactaggcagtgaacttggctcaggctgtgttctgaggacctagccgggagtccacaggcagtcag

SEQ ID NO: 1594 - DNA, 1046 bp, Homo sapiens
gagcttatggtctagtgggagagatgaatgttacacagatgatcacataaattgcatatgtaattacaaagcatgaaaaatgttgaaaaaccctagatgctttaaaaagaatgtaatagaaaattttatgtagattgatggcattaagggattcttctcctctgaaaaagaaacacttaagccaagacttcattcattcaacagaactattcaaacttgatatgggaaagttgaagtttagggagagaggtatcaagaattacttccaaatttctggcatgagcaactgggtggataaaggagccatttattaagatatggaaaactgaaggaaaaaggtttcaggaggaaggctatacacagaattgaagaattcatgtttgatcctgttaagtttgagacatccagggagatgtcaagcaggtagatgtgtatacagatctgctggaatggacctgcaaatttgggagttgttggcatggagagaacttgcagcatgagaagagaagatgactcagagtagagtccagaggaactctaaagttgagagatcaggtaaaaaagggacctgcaaaggaagcagataaagaaggcctggagaggtgggaggaaagctaggaaaatgaggtgttatggaaaccaggagaagagttaacaagaatgaagtgagcaactggcagaatctaagagatggagtaagatgagattagcaaagtggccagtggtgaccttaacaaaaatagtggtcactatgatctgggggtggaagttggtttaaaatgattaaaggtcgaatggcaagtgaggaagtgaaccctgtgtctcgtcaactctgtggagaaatttggctctaaggggtaatagaatgctagacctgggttttgttttgcttttttttttttttttttttttttagcacggaaagattctacagcctgtctgaatgctgattggaaagatccaacagacagaggggatggccagaggggaaaatgagagctctcagaaggctggaagggataggcttagtccacctgtggctggat

SEQ ID NO: 1595 - DNA, 1027 bp, Homo sapiens
gagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgaggcagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaa

SEQ ID NO: 1596 - DNA, 1027 bp, Homo sapiens
cacgagccaccctcaccacgatccctgccctggtggagcccccgtgcggaacacaggatccgaagatggcagcggaagctccgcagcggccccaaaagcgactgggcagggagggcacaggctccctcactgggtgaaggcggcgcaaagaatgggaagagccatcccgggagccaccgggcgttcagcctccctagggcccccaggcggctcgggccggggtctcaaccggggcgtttccgggggtttctgaagcaggcgaggggcagggcgggcgaaggccattcggctatccttctggctccagaatctcccaacgcgcaggtgtccaacgtgaccagcgcgacttaccgctccaatctctccagttttccaaggccttgctcagtcctcctgccgggcgggccctgaggatgcaagggacggaggaagtttcgtgcgtgcgcccttcctatagcgcccagtagaactaacagtacctgtctctgtggcgcaatcggttagcgcgttcggctgttaaccgaaaggttggtggttcgagcccacccagggacgcctctttgagcttttaaagtattcatgcattgtcaatcactagataaatggggaagattttatcttcctggagtcctaagccactaatttgtgacttatccatgtcaagggccagcccacctccccaaccggattcttaaccgggtatctcctgaaatcctgggtttatacgtgtgtaactcaggaatcctgaaacagagacctaggaacccacttctggtgtgataaaattctaattcagtccgttatacgcttaaatgagtaatttacatgcctccattttttcatatgttaataataggaggtcagtaatatcccgaggatgtgcctggatttactgattgctctatcaataatgtgaccagtggaatcattcatcatcatagtgatcctctccatcatttttgaagagtatttttcctcagtttgtgcatgatttatttaacccttttcaaaatgtttttgttagcca

SEQ ID NO: 1597 - DNA, 1076 bp, Homo sapiens
ccaaaacagaatccaatccaaaagcttaggtttttgttgctactacagtaattacatcttcatatacgaaggacagcacattattactgtccaagaatggtgcctcggacaactggttgcttacactgttttcagagatgaaataggaacataagcaggaagatttttgtctaaatatgaagcaagaaaggcttaaatgtctttattcaggggattaggcatcataagtttttttttttttagagaaattgttttcatgatatttcctatctccttttgtcactttgcttttgtcggtaaattttacaactaaataaggattaccaggcataaaaagcagcagacaatcatgatgcaaactgaaaataatcaatcaaaactgacccagaacttaaatagatgttaaaattagcagaggaggacattaaaactgtttttatacatgtatctcatataatcaaaacattaaatagagacatgggagataaacaagaaaagccaaaatcaaactttcaaagacaaaaacatttgagatgaaaattacattggatgaactaaggcagattagaaactgcagaagaaaagattagcaaacttgaagatacaagaacagacactagctaaagtacaaaaagaaaaaaaaatgttaaaaagtgatttttaaaaagcatcagtgagcagtcaggcaacttcaaatggcctaataatatgcaggtaactggagtccccaaaggagaaaaaaaagaaagagaaaaaaaatacttgaagaaacaactgctgaaaatgttctagccataacaagacctattaactcacggatccaagaaactcagcaaaccccaagcacaagaaacatgaagaaaattacactaagggataacataatcaaattgttcaaaatcaaggaaacattattaatagcaggtgtataaaaagacatgttacctatagaagaacaaagataagaacaacatcagatttcttttgagaaacaatgcaagtgagaagacagcggtacatctctaaagttctagaagaaaaaaggccaactagaattctatgcctagcaaaaatat

SEQ ID NO: 1598 - DNA, 1105 bp, Homo sapiens
aggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgt

SEQ ID NO: 1599 - DNA, 1058 bp, Homo sapiens
cccggataatttttgtatttttagtagagacagggtttcgccatgttggccaggctggtctcgaactcccaacatcagatgatccacccacctcggcctgccaaagtgctgggattacagtcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccattggtatacttttgcctctaggaccctctgtactgtacttcatggggtggtggggggcgggggtggtatggcatctacttgttgtcccaaggtaaacttactggcttcttctaccaatagagtgatggtagccacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagtttgagagtcttgaagcaggggctgtccctgggttttcttttaaggctaagaatgccttttgacaggctccattgcaattcaaaggcttatgaccactcacttttggaggttcgtagagtggttttgctatgagcccaaacctgggaatccaaacccagcagaatccagctattctcaaaaaggaatttgagggacctggagtgccaggatggtctcttttcatccctgggtcaagatcctggt

SEQ ID NO: 1600 - DNA, 1026 bp, Homo sapiens
gaatccttcatatggaagatctatgtgggtgcaaagaactattgttaaatgtagtgtttattaatttcctatttatatcatttctatatgtaactagatggttgcacaaaccatctttctctctcacccacagcaagtgataactaaagaatatgaactgtttgaattccgtcggacagaggttcctccattgctccttattttagatcgctgtgatgatgccatcaccccattgctaaaccaggtacaaaaccctttcttggcataatagaaggataattttaagtgatattcatcaaaatacagatagggaagtaaaaacatggtccatttatttgcctccttatttttagctattcttggttttgctttgtatttcctggtgttttggtatcatgattcttccatccactgtcatcataactcttctgcttcatctctcctgtacctttctgccagtacctccacccctaatcaagacagcttcttaattctgtagattctatttccctgtgtttccttctgtctcctcatttccatgcttacagccattgccttggtctagatcctaatctcttgcaagaatattgaaatagtcatctacttcgttccctactttttatttcttctcactccaaatgttccacaagtacaatttcctaaagcacagctctatcttattactcttggcttaaaaaacttcattggttcccatttgcctactaggttaaaaagaaactcctgaacttggcatccaagagccttcacaatgtgggctaaacctcttataaaacctagagttcaccacttacatagataatgccacatggtttcctgccagcatgcttttactgtgactgctttctaaactctagaatgtttggaataccttctcttcccatcttcacctatcaaaatactgctgttaaaaccactcaatctggccgggcacggtcgctcacgcctgtaatcccagcactttgggaggccaaggtggctggatcacctgaggtcaagagttcaaga

SEQ ID NO: 1601 - DNA, 1025 bp, Homo sapiens
aatcattaatactaagagaaagcagtaggttttgcaaatcaactagtcagttttgttgtgccgtattgattcaagtcgtggaaatagtaagtgttctttcagcaaggaaattacaacttcagctattggaaaagaaaagtggaactatccattattaaattcatttttgtcctaaagcaattacaatggaaatatatttccttatttaattcttaccttggacaaaaggcatttaattttctatagttgagacagttgctaaatgtatgacttataattgtcatagtagtgatgtatcactaccattcaataattattagatctaaggcattgtacaacagatgactcaagtgaaagggggataaatataagttctatctttcttcagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaaggtaaccagtttccatattagcccaccaaacaggaaccaactctgttattatattcttagctctaacgaatgataaatcatactatttttatttacagaaatgtataattctgtcttttcatttttgtttccttaataaaattattttcttatgaaatgggcttcctgatgcctaagcaatcaaaatttgcttctctttcttaatagctcgtgtctgcagttgttgaatatggtggtaaacgagtcagaggaagtgacctcttcagccccaaagatgctgtggctatcaccaaacaattcctcaaaggactgaaggtatagacatctcctctatgctctcctgagtgagaacagttgaagtccttgaggctgagagtgaatgaatatgatcttcaaagtatcttgaagattgctgctaatttagtactgtgtcagttaaatgaaattaaaactggcatcctcttgaaagctttttcttt

SEQ ID NO: 1602 - DNA, 1783 bp, Homo sapiens
agccactgctctccagcctgggggacagagcgagactccgtctcaaaaaaaaaaaaaaaaaaaagagccatctatgacaaacccacagccaacatcatactgaatgggcaaaagctggaagcattccccttgaaaaccagcacaagacaaggatgccctctctcaccacttctattcaacagagtattggaagtcttagccagagcaatcaggcaagagatagaaataaagtgcatccaaacaggaaaacaggaagttaaactgtttttagacgacatgattctatatctagaaaaccccatagtctcagctcaaaagctccttcagctgataaacaacttcagcaaagttgcaggatacaagtcaatgtacaaaaatcactagcattcctatacagcaacaacaaccaagctgaaagccaaatcagaaagcaatcccattcacaactgccaccaaaaaaataaaatacctaggaatacagctaaccaggaaggtgaaagagctctacagtgagaattacaaaacactgttcaaagaaattagagaagccacaaacaaatggaaaacatcccatgctcatggataggaagaatcaatatcattaaaatggctatactgcccaaagcagtttacagattcagtgctattcctatctaactaccaatgacattcttcacagaactagaaaaaattattttaaaattcatatggaaccaaaaaaacgccaaaatagccaaggcaatcctaagcaaaaagaacaaagctggaagaatcacgttacccaacttcaaactatactacaaggctacagtgaccaaaacagcatggtatgggtacaaaaacaagcacatagaccaatggaacagaatagagagcccagaaataaggcctcacatctatgaccatctgatctttgacaaagctgataaaaacaagcaatggggaaaagactcattcaataaatggtgctgaaataactgactagccatatgcagaagattgaagctggaccccttccttacacggtatacaaaaatttcaactcaagattgattaaagacaaatgtaaaacccaaaattataaaaaccctggaggacaacctaggtaataccattctggacctaggaacaggctaagatttcatgacaaaaaaactatgcatctgagaaaggtctaatatccagcatctataaagaacttaaacaaatttacaagagaaaaacaacctcattaaaatgtggaaggccgaggcaggtggatcacctaaggtcaggaattcgagaccacctagtcaacatggtgaaaccctgtctctactaaaaatacaaaaaattagccacgagtggtggctggcacctgtaattgtgccacgggaggctgaggcaggagaatcacttgaacctggggagatggaggttgctgtgagccgagattgtgccattgcacaccagcctgggcaacaagagcaaaaccctgtcgcaaaaaaaaaaaaaaaagtgggcaaaggacatgaacagctacttctcaaaagaagacatacgtgcagccaacaagcatatgaaaaaaaactcagtatcactgatcattagagaaatgcaaatcaaaactatggtgagataccatctcaacaccagtcagaatggctattactaaaaagtcaaaaaataggctgggcatggtggttcacgcctgtaatcccagcactttgggaggccgaggtgggcggatcacaagatcaggagttcgagaccagcctggccaacatggtgaaaccccttctct

SEQ ID NO: 1603 - DNA, 1034 bp, Homo sapiens
acctgccttggcctcccaaagtgctggaattacaggcataagccaccaggcccagccttttttcgttgttgtttttaaggaggaagaggggacatgagcaaggatgtaccctgtgcattcgctcccctccctgtggcttaattgctagttctatttttagttctttgagctagttccataatgttttccacagaggttgaactaatttacattccaaccaacagtatatgagcattcccttttctccgcatccatgccaacatctgttgttttttgactttttaataaaccaaaatagtaagagccatatatgacaaacccacagctaacatcatactgaatggggaaaagttggaagcatttcccctaagaactggaataagacaaagatgtccactctcactggtcctattcaacatactgaaagccctacccagagcaatcaggcaatagaaagaaatataagacatccaaattggaaaagaagtcaaattatctctgttcgcattcaataggattatatacttagaaaaccctaaagatccctctagaagattcctagacttgataagtgatttcattaaagtctcaggatacaaaatcaacatacaaaaatgagtaacatttttaggcaccaataacattcaagctgagaatcaaagtaagagctcagtcccatttacaagagacacacaaaatacttaggaatatatttaaccaaggaggtgaaagatctctacaaggagaactacttaacattgatgaaagaaatcatagatgacacaaacaaatggaaaaacatcccatgcttatggattggaagaatcaatattaaaatgatcatattacccaatgcaatctacagattcaacacaattcctatcaatttaccaacatcattcttcacagaattaggaaaaagaatcctaaagttgatatggaaccagaagaaagcctgaatagccaaggtgctcctaagcaaaaaacaaatccagagtcacattgcctgacttcaaattatattataaggctac

SEQ ID NO: 1604 - DNA, 1036 bp, Homo sapiens
tcctgacctcaagtgatccgccttcctcggcctcccaaaatgcatataggcatgagccatcatccccacccttgtataaattttactgggaaatctctgcaatttagagactatctgaacattttaaaatagccacaatagctgattctgtttcagtgaagtcccacaagaacaaatactctctcagttaattctttcaaggtattttagaaagagagagagagagacaagcaggaaggaaatgtagggttggggtttttttcatgatttatacataagcatgtatattccttgattaaagatgtttctggttagttttgtgcaataacattcaaaacggatgcttctgattgatgtagttttagtgtccaatgagtgatttaacaaaattatttgcctagtaatggttttgaaaataatttgatctccttcttggtgatatttaaggaaggagctaataggaacattcacttttgttatgaagccattttgatacggattgaaacaggaaacagagtaaaacaacacagtgctacccaagtgaagctagtgactgagctgtgttcgcatgtccagtatcagctacactcatggtttttttggtttccatggtttctttttcttggtttatcaaaggattcagaaaaaagatttcaagaaaagatagagttcctagaagcaccattaatttttgtgtcccattcttttttttatactcaaaatactaaatgtttctagtttccatgttttggggacatctaaatatgctagttctttcaaaaatgctttgaggtccttgtacagaggccattgtaatagcactgtattaagtatttgacaaaggcttatacatgaaaggagatgtgtagtattaatacaaacataaaattctgccgtattgatatcatgtcatggtaaggcactctgcaccctcttgaatataaaagaatatttctacatttggttccagcaaacactattgtgctattctgaaatccacagcacagaaattataagacatccgctcataaacaga

SEQ ID NO: 1605 - DNA, 1676 bp, Homo sapiens
agataggtcaaaattgatctcctgcatcccagaaaataacaagtacccttacccgtcaggtagcaattttagcaaccttaatcatggtttctctatttttatttctgacatatatcaagatcacttttactgtaaattgaaacaaaatcttagttgtaaacaaaacttaaaaataaagaagagaaagcaattattcctttcctccctagtatatttccaaaaatgaacataatttttagtgtaagaacagagcctttgtataagtaagctcgtcatcttaagcaaggagtcacctgaagatataggtcccttagatcctaataggaaatatacattagtttaatctgaaattgaagttgccattcaaagttatcttaaagtggctctttcttgcatactttatttctttaaaacagttcttttgcgataatattttttagtgattcaggcgctggttgtaatgaagcagagttctatatatgcaggccttccgtagttgtatgatttgtttctatagggcctgctctgattagctgtaattgtgattatctttgtttagatttaaacaccatttaaaatagaaggcatgtatttgctgctaagacaccaaggaactttgcagaagcaacttatctccttagcaacattctttttttttttttttttttgagtcagagtcttgctctgtggcccaggctggagtgcagtggcgcgatctcggctcactgcaagcttcgcctcctgggttcacgccattctcctgcctcagcctcctgagtagctgggactacaggtgcccgccaccgcgcccggctaattttttgtatttttagtagagatggggtttcactgtggtctcgatctcctgaccttgtgatccacccttctcagcctcccaaagtgctgggattacaggcatgagccaccatgccctgccctccttagcaacattcttaataaaattgccttctaaataaagagaggcagtcaatatttcttctctttccatagccatatgaagtttaacatgaattttgtattacttccctttttcatttcatatataatgaaatacacagaaataaaatgtagtaaccaattacagagacttctttaaagatataactgttgtgcttttttgaaggcaaagaacctgccctgaaaaagaatctgacctgaacacatgctgtcctaagcagttagtctagtgtgtctctggggtctatgcaggtttgcagtgtacagactgttatctcctgtctcagtatttgcccttcttatggaattactttccttcctcttactaccttatttcctcctcttcatttgtctcattagttgtattagccagatatatatttacttgtaggggagggggaatgtcaaatttcagtttctaggaattatatatggcatgagtcattgctatagcatcacagaaattttcatcaacgtctatctagaacagtcaggagttctagttatgagttctgtaatagatatttattgaacatgtgagaacaatgtaaagccaatagttggttcactcaaatatttactgagcactgggatacctccatgaataaaacaaagatcctaacccttgtgaagcttcattttaatgcagggggagacagaaataaaccataaacttaacaaataggtatattttatag

SEQ ID NO: 1606 - DNA, 1012 bp, Homo sapiens
cttccattctatacccaaatatcagaccagtacctcctgcctactattcatgatatattttcatctggttagatgtccagagcaagacattctatttttggagatgcttttgttttttccttcaagtaacctcaaactacttatcagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaaggatatgagtgatttagttttatttctttggggctaatttatgggaatttatgaggtgggacatgagctggtttcacaccaaacataatgaaggcattacttctacctgaaggatatttaaagtatgtcaaggcaaataataaattctagtgtcaatttcacctctcttgaaaacaggagaaagtgacagtatcattattgccaggaaattaaggcatcctcaaatcatcatagcaaaaataccaaagc

SEQ ID NO: 1607 - DNA, 1030 bp, Homo sapiens
cctctctcaaagagggctggagcaccttatgatcacaggctgatgtgtaagaacagaagctagaccttaggaagacctcatggtggaggaaattggattcagggcaactctttggacaggcgtgggaaaaatccctttctatagtcaaggacgaagaatcaggggaaaggaagggttaatttggaagatgggtagttataaatgagactctgggaattagatatgtggggaaaaaaaaaaacaatatggtggagaacaaggctgcttggctttgtccatcttcccaggcactggaatatacttgtcctactgcttgcctcaccccatctcccaccctctccaccaagggctaacctctatcagtgtctcctgctccccagagctcctaatcagtctgtatgcaaggtagaataactccctttccttcccttcccctaaggaaaacatagtaagttaactctcttcccctggctacattcacacacccaacactttcctctccacggtttctgggctctgctgatagtctcagctctggagaaggagggggagaggagggatgatgcatcatcttgtatccctgtcccgtgtttctgggaattgctcttggacaccccttgccagcaccttgtcctacttccacccgtaatcattcaaggcctctggccactttccagcccaaagccagggaaccctggaaagtgggaggccctggaggagccaagccttgctgaaacaaatggaggtagatgtatgaggcgtcactcacctgaatggggccatgttgacatctgtcctcatctgtcatcagcctccaggtccagcagcagttcagaaggatgggcagatacaagactgtagatggtctgggtaatggaagggagaaccacttccccacttccaggtttccaggaaccaggaggatagatgagttcacctccatgcacacgagtcctatttcagaacttgggaagttggggactgttttggaaaataatttcagtcagggtgggtagatgtcatccaagga

SEQ ID NO: 1608 - DNA, 1030 bp, Homo sapiens
tctcaaaataaaaatgagggtattcttttctgagctgaaggatcatcaagtcagctgatggagaccctgtagattgaacatgataattacctgtatgcagaattcccactgggatgaatatgaccacagagaaatgtgacagaacattctttttttttttttttttgagacggagtcttactctgttgcccaggctggagtgcagtggcgcgatctcggctcactgcaacctctgctgcctgggttcaagtgattctcttgtctcagcctcccgagtagctgggattacaggcgcctgccaccatgcccagctaaatttttttgtagtttttagtagagatggggtttcaccatcttggccaggctggtcttgaactcctgacctcgtgatccacctgcctcagcctcccaaagtgctgggattacaggcgtgagccaccgcgcccggccagaacattcttaaagatcatgagatttaatttaatatctaagatgactgacctggataaaccctcttttacttgcataccttaaaagaagggaatcctacataagtcagggttgggttagggaatgcctgcctggaagtaggaagaatggaaaagctggcctctggatgggcttttttagttctgttttagtgttactaggtttgcaagtccttgttgatatgacaggatcaagaaagaagctagaactaatttctcagacttagcttattcacagagtttgtttattccgcagatttcattgatcaacttaagagttagaattaaaaatcaaatgggatctctttctgctttgagatatggttcttggggaaaatatttgccttcaaatgagttggaaaaacttgtctagggattgagaatagggctggggaatgcattcctgatgtactaaccatttccctggatcactttagtcttttttttttttttgagagagagtcttgctttgtcgcccaggctggagtgcagtggtgcgattttgacttgttgcaagctctacctccctggttattcccctg

SEQ ID NO: 1609 - DNA, 1069 bp, Homo sapiens
tttttttttttttaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccggtatgtacctttctgcatcttttatcttaacatatagggtgaccccaaacactgctttgaacttcctcaaaattctctctgttgggaacatctaaaaaaatggcaggccatattttattttcacctgtattatagtgaaaataggctaaataataatttgctttttctcttaattgcttattttttatgttatttatgatagattttaaatcttcgtttggctaccatactgagtcacctaagttagatttacttaggaagtatgcttaagtcagataggcatattcagattcagactgaacatctcaacatacaaaaatctttatgaaatacatgaaaaagcttgaaggaggtagattttgttaatggtaggcttctacaacttgctatttgggaaaggtgagggtggttattcatctcaaacttgatgttcaaggtaaacaggttgctctaactgcaccacttcccacgccaaaaaattataactattttcacctcacagggcaaggtcatttagtgtaagagagatgggaatcctacaaaaaacttaaaatttgtttcactcctgggaataaaattccagtgttggtacctgttataggcctagtattagactgtgtactcttacctttccaaccctaccaccgcctttcttcctgtcagatcatctgaaaccttttcttgatgattctactctccgatttgtggacaaactgtttgaggctgtggaggaaggccgaagctctaggcattccaagtctagcagtgacaggagcagaaaacgagagctaaaggtaggttacaatttactgtctaatgagctcaggactgttttgaatggtaacagagttgctgagctta

SEQ ID NO: 1610 - DNA, 1030 bp, Homo sapiens
acctctaagttcatgggttgaaatatccaaagaaataattggcagctttgtctttttttagataacaggagttttgattctcatgtttctccatatttcctttttttccttcttactgttacttataaactgattgctctaagattttatctttgatttatttgaggcctaataagttgttttagaatgtgactccactggtacctgagctgtacacctcattgttgcctctttgtagaagtttctctgcaatgcacttgtagatagaataccaaaaaataactattatttattatattcttgagagcttaccatttgctctatggcatattgctggtcctctgctgccatgagtgaaacacttggaggagttgtcagtacccccttaactactacactttttattctgtagttgccgactgatcctggcctctttcagtattagcagtatcaagtagcctatttttctactcatttcccagtatctctctttaggagaaaaaaaaaagttctgtgactcctatcaaaccttccaaagttcttctgataccttggctatcccattacttttcctgagggaaaagagtgaataagtaatgtctgcttggtcccctggccaggctatggaactaaagaaaaaaagcagagagatttgtgccctttgtgtttggagcattgtagggtggtcagagaaggagagatagtccttgccttaaaacaatttgtaatttgtcaggcagtgtggcatgtgcctgtaatcctagctacttgggaagctgaggcaagaggatctcttgagcccaggagttacaatttagaagaggcaggggtatcacaaaatatatattcacgtattataaaatctaagtagcagtttcatgtaaattttagggttggttatagaatttcagacctatgttgaattttgttatatttaaggtggaatgattgatccacagtatacacagatctgtacagtgaagattatgtcacgatagggcatacttctttttttttttccttttttttt

SEQ ID NO: 1611 - DNA, 1024 bp, Homo sapiens
ccacccgcctcagcctcccaaagtgctgggattacagtgtgagccaccacacccgtccatccaaataactcttatagagaaggcactgcagcctcaacttcctgggctcaagtgatcctcctcaacctcctgagtaggtgggaccacaggtatatgccaccgcacccagctaattttaaattttttgttgagatgcagtctccttgtgttggccagactggtctttaactcctggtctcaagtgatccctctgccttggcctcccaaaatgctgtggttccaggcttgagccaccacgcctggctttattttgttttttgcttgccttaatgttccatacaggatttatttctttgcgggctatttttcaggaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggtatctggcttagagtataacacagaatttggaaaaagttaagaagctgacaagaaaacattgttaaatctctgtgttctaggaaattagataaataggtcatttaaagcagcagtcctcaacctttttggcaccagggacttgtttcatggaagataatttttcccctggagtaaggatggtttcgtgatggttcaagcacatagcatttattgtgtactttattattattatttttttcgagatggagtgtcgctcttgttgcccaggctggagtgcaatggggcgatctcggcttgctgcaacctttgcctcccaggttcaagtgattctcctgcctcagcct

SEQ ID NO: 1612 - DNA, 1050 bp, Homo sapiens
acagtgacagatcatcaggcattagattctcataaggaatgtgcaacatagccccctcacatgtacagttcacaatagggttcgcgctcctatgagaatctcatgccaccgatgatctgacaggaggtggagctcaggccataatgcaggtaatagggagcaatcgtaagtacagatgagactgttggcttgcctgctgctcacctcctgttgtgcagcccagttcctaaaagactgttgggttggggacccctgatttaaagcaatgaatactttgaaaaatgtgctggacaagatggctcaagcctgtaatcccagcgctttgggaggccgaggtgggtggatcacgaggtcaggagttcaagaccagcctgcccaacatggtgaaaccccgtctctactaaaagtacaaaaattaaccgagcgtggtggtgggtgcctgtaatcctagctacttgggaggctgagtcaggagaatcacttgaaactggaaggcagaggttgcagtgagctgagatcgcaccactgcactccagcatgggcaaaagagcgaaactccgtctcaaaaaatatatatatatatttattaatataatacataatttttttagcagattttacttcctaattcgtttctacataagtggaaatattatgaaattgagtttgaaaattctccacatacaactaagtggagggaaacaatttgaaacattctgagtgactaaggaaggcttgcctgtagttaaaatttaatgagacagtacacctggagagttgaattgattgtatattgaatgacctttgccgcctttttatcctctcaaagtgaggttttcataaaattcctttttttttttttttttttgagacggagtctcgctctgtcacccaggctgcagtgcagtggcacgatctcagctcactgaaagctccgccttccaggttcatgccattctcctgcctcagcctgccgagtagctgggactataggcgcccgccaccacgcccggctaatttttttgtatttttagtagagacggggtttca

SEQ ID NO: 1613 - DNA, 1050 bp, Homo sapiens
ctcgggaggctgagtcaggagaatggcgtgaacccgggaggtggagcttacactgcactgcactgcagcctgggtgacagagtgagactccgtctcaaaaaaaaaaaaaaaaaatttgggattctggccgggcacagtggctcatgcctgtaatcccatcactttgggaggccgaggcgggcagatcacctgaggtcgggagtttgagaccaggctgagcaacgtggagaaaccccatctctactaaaaatacaaaattagctgagggtggtggcacatgcctgtaatcccagctactgaggaggcttaggcaggagaatcgcttaaacctggaaggtagaggttgctgttagccaagaccatgccattgcactccagcctgggcaagaagaacgaaactccgtctcaaaaaaaaaaaaaaaattgagattctacacattctgttttctatgactccaatttatctttctgtcttggattatcttgtttttaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatctgtgagtttgttttagtacctttttaaaaaaacagtttttaatcagctgagtttaagactcaagttaataccttttagtaaagctatggttttagtgggaaggatggtactcattcattaattaaaatttttaaatccaagagagataagtaactgtacacaaggtcctgtatttttttttttttttttttttgagagggagtctcgctctgtcacccaggctggagtgcagtggcacgagctcagctcactgcaacctccacctcccgggttcaagagattctccttgaattctccttgaatctcagcccctcaagtagctgggactacaggtgtgtgccaccatgcccatctgctttttgtatttttgatagagacagggttttgccat

SEQ ID NO: 1614 - DNA, 1069 bp, Homo sapiens
tgtttataatagagttgggtctcacttggttgtccaggctggtctcgaactcttgggctcacgccatcctcccaccttggcctatcaaagtgctagaattacaggcataagccactgtgtccagcctaaagtttcttttaatgatattgatatttacctaggtttctttaatatttttattgctgtccgggcctggtggctcatgcctggccaacatggtgaaaccccatctctactaaaaatacaaacattagccaggcatggtggcgtgtgcctgtaatcctagctactcgggaggctgaggcaggagaattacttgaacccaggaggcagaggctacagtgagctgagatcgtgccattgcactccaacctgggtgacagagtgagagagagaaaaaaaaaaaatatatatatatatatatgtattcttactgctttggtatactaatatctctgcctgacagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaaggtgcatttctcagtggcctcttctgttaaaaagagtggcaagtttatgtctttaatcctggaggaactttaacatctctgtgtttgagtgatttctgtttctaagaattattcttggggtcctttttctccaagttttctaccatcttttcatattaagataggtcaacacattcattatagaggccatttatggcttatttttaagcatactgatcatacaacactctggttttcctggaagaatacaggtcttgaaattcatggagatagtagttgcagtatttgcgtagactttttatgtacataattcttaatgttttaatttttacaatgaaagtacaggataaaaaacttgaccctgtagttacattctcgttcagcagtattttgactgagcactattatttataagctctttcactagatgctgtgatcagtgtgaaaaatatgaaaggaa

SEQ ID NO: 1615 - DNA, 1525 bp, Homo sapiens
gtttatggttacccagttcttccctctcaagtcttctttttttttttaccagaatattagttctgaacaagtcaatatacttgttcaggccaagatgtgaactaaagattgtatgtcctttgagaactataaaatatcatcctatttcttttttttttcatctttttttttttaaatggtctgagtttgcttccaacatccatggaagcattacaaattttctttcctccgtagtcatatccttaccctgatgtattgctgtgtttcatcctcactccaaaatgcattttatatgttgtaaatatttttctacctttgtgttgatttaatgtttttattcttttatgttgagtacatgtgtatcttctatttttaaaatgtgcttatttctattaactagttctttattataaaagtggtacattatcacaaaaatagtgaatgcttattaagatttaaaaaattgtctgacaacacagaagaatacttactcaaaatgtctcctttctattctctgatcccttagaaccactctctttaggtaattgctattaacagtttttcacatatcctcctagaaaattttcatgcctatatagtgatcctatatatatattttatttatttatttatttattttgagacggagtttcagtcttgttgcccaggcaggagtgcaatggcgcgatctcagcgcactgcaacctctgcctcccaagttcaagcaattctcctgcctcagcctcctgagtagctaggattacaggcacgcacccccacgcccggctaatttttgtatttttagtagagatggggtttcaccatgttggccaggctggtcttaaactcctgacctcgtgatctgcccactttggcctcccaaagtgctgggattacaggcatgagccaccgcacccagccaagtaatcctatattataagagtctaagggtctagaggacaaaaagtctgtaggtctttacattgtcaagaacaatgagattgtaagtatttttggatgatagtaaatacctctccctgactcttagagtaaactttggttagtaatgtaatggttaatgtaaagtgctagactttgaagaaatgtaagagtgtggaaatatttctagactcatcaactctaccttttaagcattcatctatttgtttactccagaggcctttgtttatagagaggaaaccattttggattcatctttttacttgccactccattcaggcagctgctgatgctaaaatggaagacataactaaactttcccttctccagagttcgaaatttgagcaacccagccaagaagttcaagattgaagccaatgctgggcaactgtacctgacaggggtggtggtactgcacaaggatgtcaacgtggtagtagtggaagggggtgagtctgaaaaacttgagggagactgtccccagacaaccctaggcttagagtgattagcattgtggggagaaaggagaaaaagatcgtattttagtgccatacctgatataata

SEQ ID NO: 1616 - DNA, 1107 bp, Homo sapiens
cttaaggcctggtaggagataagtttatctcattccaccttccatagttcttcctgacttgctgttccacccaggcaccagagcaaataattcctcacttcatttcaaaaaactaaaagccttatgcatatgaattcgtaaaatctcatacaaatatccaaggaggccgggcgcggtggctcacgcctataatcccagcactttgggaggctgaggcgggaggatcacgaggtcaggagatcgagaccatcctggctaacacggtgaaaccccgtctctactagaaatacaaaaaatcagctgggcgtggtagcgggcgcctgtagtcccagctactccagaggctgaggcaggagaatggtgtgaacccgggaggcggagcttgcagtgagccgagatcgtgccactgcactccagcctgggcgacagagcgagactctgtctcagaaaaacacaaatatccaaggaaatggaggtcacaatttttttttaaccataaaatcacgttcagctgggcacatgtctcacaaatgttactaggtcttcttataaaagaatattatctgatttaaataagaaattgaagtgtttttattatatatctcttttctagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaacttggtgtgatatttttcacacattcgtaagtattagagtttgggtctacaggtgatcttttttccggacttttagcaattgctgtggaaaaaaacattttttgtcattgacatttatttatatatataaa

SEQ ID NO: 1617 - DNA, 1044 bp, Homo sapiens
ctttttacacaattgagttgatctcatgggtaatgtgcacaggaaatgtgctttttgaatatgtagtacctttttctccagttatgttttttttgtctttatcctggagatttttccattttgctgctttactgcagaaacgagctctgttaaagcatggattgtttgcagaacgtttcaaatcttataggaggaagtgtggagaagttactgtttcctgctgagaagagagggttaactcatactccatatacatctattagaatttttctttgcttcctgcctgcggcatttcaccagtgagacccatcatccagttattctgccttattccacttctgccattgctcctgtagtgttttgatttgtttaccttttagagaacagatagataaaacttgcaaaattataggccccatgcttcgaactatttgtgtttaaagttttgggagggatgttttgtggttctttgaataataatgcagagaaattagtagataccggacagaattacctgtgtttaccaataaccgatcaaagagttattttcttgcccagaggtaaaattataacgtgcaaaaacatcaaatatgataacagtcatcattgaagactcacatgttaagtatctgctatgtgcccagtcatctcattgtaccttaaaatcgtctgagaagtagattttttaatcactgatttacaaacgaggaaactaagactcggaaattaagttgcttaaggttactcagtaaaatggtggggttagggtttgacttcatcattaactttgtaaaataatgtttaacgttcttggtataccagtgatatattgcaaacagttctaatgtgagtgagagaacctcttctccaccctattttaaaacatttttactgacctatgcaagcattttacatttcctcaccttgggctctggggctttaactgtatggttacatcatttgcaagaataagttggtccctgtcccgtctctgctgtgtgggatcacaagcgacaattacagttttttttctagtcagcaata

SEQ ID NO: 1618 - DNA, 1032 bp, Homo sapiens
ttttttgcatttttggtagagatggggtttcactgtgttagccaggatggtctcgatatcctgaccttgtgatccgcccgtcttggcctcccaaagtgctgggattacaggcatgagccaccgtgcccggctgtgccaagaggttaagtaacttgcccgtggttacacagctaataggtggtggagatggagacagaattcaaacccaggcattcttgatctacagtatacactcttacccaccatcctacacagcctttcttattcataaaatattttctacagtgcaagaaaattttgatagcttgcttatttattcaagatttagactatatagattaactagactatcaagattttaaattcttgtgttttttgtttttttccccctctgtggcataactatctcttagtgatttgaagttctgataggcatttatttatgtttttgattaattaaaaaaagggaaaaaaatggaacataattattgaagctatcgtctaggtaaaaacctttctaaatgtaaggttcatttagattgatgacctgtagagtgtaacagtattgccataggcatacagctttttaatcacatatcatacataaacaaattagtaatacaggtgggtagatacagaccctaactttgagctctaagatgaaatttgtttataaatccctagtttccattcagttttttcaatatttatcaaacacctactgtgccaggcattgtttaggcacaggggatacagcaggagaacaaaatgaacaaaattttttgccttcacagagcttaaaatttagccgggcttggtggtgcacacctgtggtcccagctacttgggaggctgaggcaggagaattgcttgaacccgggaggcagaggttgcagtgagccatgatcatgccagcctgggcaacagagtgagactccgtctgaaaaaagaaacacacacacacacacagacacacacacacacaaagacagcatatactctagtaaggggagacagacagcaaacagataa

SEQ ID NO: 1619 - DNA, 1051 bp, Homo sapiens
ctcaagcaaattaatggaacccaagaagggggttgtgtgagccccgatttatggtggttgggtcagagcaaatgttaacctgagatttgtgattggcatgggaagtggggggcagtcttgtgagactgagcactcagtctgtgggatctgatgctctcttccagtgtcagaattgaattggagggcacctagctggtgttcattgcagaattgcttgcttggtgtgtgtggggagaactctcatacatttggtcaaagaagtctttgttgattgttgaatgagaatgtaggaaaagcacttttaagtttgtttattctctattctcagaaggctgttggggcattctagtattttagatgactctttctacttagtctagtgtgttattggcttaggttctttttgaggttcaaggtaaactttgtctcagccccccaaagaagtaataaatctattttggtctcttgcgtatttttactcttggtttacgcttaatggcatttctgtattcattgagcaggagctctgttataattggttattatccaccctctccctcccctttagatgcctaagtcaccttttttttttttcattccattgctctaggttcatagagttataggtggtatttttccaggtttctggcaatgtttcgaaacatggaactgtcttaattataaactataattattgtaatggtatatattaagcctttttgtctgtattgtgagactttccaagcagttgttatcttcttccttttagctgcttagtctcttacagcagaagggtgatttcatccatggccttaggtgggtttgaagcaatatgtaaaacataattttactataccaaattccatagtaagctaaagagtaaattttgtagcaaataaacattcccataactaaaagtgtgaaacactactgacaaacttcacatggttctgtgacatggaggtatcttgaaaggaaaattacaatagcagtggaaaaacactaatattaaaatttgctcacagaggccacccagaattactttaatgtt

SEQ ID NO: 1620 - DNA, 1034 bp, Homo sapiens
gccaggcgtggtggcacatgcctgtagtctccctgctgctcgggaggcagaggcaggagaatcgcttgaatctgggaggcagaagttgcagtgagccgagatcacgccgttacactccagcctgggcgacaagtgagactccgtctcaaaaaataaataaataaataaataaaaagaaccatgtataaaatatttaaattaataaaggaatctaaaatatatcaaggaacaactcttagacagttatgcaaatttgaaaaagaaccaaagagaaatgttagaaataaaagtataactgttgaaattgaaaacttagtggatgatttgaacaacagataagaccattggcaaagggagaattcatgaactgaaagatctgaagtaatttcccagaatgtaatgttaagaaataagttaaaaggaagagcataatgagtctaacatgtgtgattgaagtcttataaggagagaattaagaacaggcaatattttaaaggaataatggagaaaatggaataattgatgaaatatgtgaatatatatagggaccatatgcatatgaaggaagggggttaaataaaaagaaatctacttgtacatactttatagataactgaagaatatcaaagtcaaagagaagctcttaaaaacagtaggagaggatgggtattctatcctcagtatacagtattcttacagtatgaaactatcactgcacagatcatgaaatgcaaattgataattatagattattaattacttacaaaggaatgacagattgataactatggaagcaagaggacattggaataaaatattcaaagtgcagagagaaaacagccatcaaattagaattgtctacctagcaaaactaagttttaagaacaagggcaaaataaagacatttccataaagacaaaagctagaaaccaacagatcttcacctaatgacctttattttatttaattcatttatttatttttgtagagataagggtctcatgtgttgcccaggcttatctcaaactcctggg

SEQ ID NO: 1621 - DNA, 1955 bp, Homo sapiens
gatgaagaaggaaaaagaaattcgtgctagttttgctgttgcacctcatactgcaaaagttatggccacggtgcttgattaactgcttggttaagatgaaaagggcattaaatttttggtggaatatatgaacagatatgtgtttccgttgacagcagtcaggttctgtactgtctggtttcaggaatccactaggggtcttagaacatatacccccatgttaaggagggactactgtaattgcctttacccctgaatatttgtttagggttcttgttaattgttttctctctcacactctggcttagtacttacaggtaaaaaaatttttttgagacaagagtctctctctgttgcccaggctagagtgcagtggcacaatctcagctcactggagcctctgtctcccaggttcaggtgattctcctgcctcagcctcttgagtagctgagattacaggcatttgccaccatgcctggctaatttttactatagatggggtttcaccatgttagtgaagctagtcttgaactcctgacctcaaatgatcctcctgcctaggcctccaaaagtgctggtattacaggaatgcgccaccacgccctgccaagtacttacaagtaaattctttttttctttttgagatggagttttgcttttgttgcccagactggagtgcaatggcgtgatctcggctcattgcaacctccgtctgctgggttcaagtgattctcctggctcaacttcccgagtagctgggattacaagcatgtgctaccacgcccggctaattttgtatttttagtaagagacagggtttctccatgttgatcaggctggtctcgaactcctgacctcaggtgatccgcccgcctcggcctctcaaagtgttgggattacaggcgtgagccaccatgcctagccagtaaattcttgtaagttcgaatatggtatgacctctagtaatgtacatctcttgatgtctctaatttctgtattagtatattctttgtacttcattctgtagagcatatggtattcacataatacttttggttattgggtatggcacatacagtgctagggttctcattgtttctcagtcccaacaagaacatctcatcagaggagtttaaggtacattttaagttcattcattagtatctccccagataaacttaattgtaagtctgaatccctaagcaagaaattaaggtactcctttaaaaaatacattatttagtaaacaaagcatctctgacttctatacatacagcaccatttgttcagtgttttcagttcttaaaaaagaaataaaattataacatttagatccaaaaggggccttagaaacttttttgagtacattcattttacatagacttaggctagttgcgtcttagctcagcctaacgtatgtgaccacctgacctgatgtgatgccctttcactctcaaaatgtaacagtttgaatgataatgtactcatcctcacatagtggtggaggagtatggcactcagattttctacgtagttcagtgttctttctgctaccttgatactttttcagataattttttcttgttaaccctcaacaaagcaactaagtgattttaaggaagttgggagatttatctttttaaagagaagatgtagattctttgaaaaaagatgttgttttcttctatttaaatattcaagtgacactgccattatttgtactgagtgtccttacagttaaatatttatttaatcataggatattgaagccagagggtatgttatggacgatctaatctaaactagttattttatatgggtttttttgtgtgtgtggagacaggaccttgccctgtcattcaccctggagtatagtagcacaactatggctcactgcagccttgaccccccgggctcaaccgatccttacatcttgacctcccaaaatgttggga

SEQ ID NO: 1622 - DNA, 1049 bp, Homo sapiens
atttttagtagagacgggtttctccatgttggtcaggctggtctcgaactcctgacctcaggtgatccgcctgcctccgcctcccaaagtgctgggattacaggagtgagccaacgcacctggccttgttaccctaattttaaggaagaagaaactgtggcttggagagattaggtaaattgcctaaactctcagagctgcctggaggcagagagccagattcccacttcaggctatctaaatccaaagcccatgttgtttgccacttaaccactaatccatgctgcctctttatgtataaaacccagtataattgtgaataagaacaacaatacaccagagtttctgctataaatatcactgtagtatctataacttagcctagtgtttccttgacttgaatttcatgacctatttcatggattaatatacagttgccaaccttttttttttaaaccatgtaaagatatgtttaaaaacaactactttgtgtgttactaccattgtttcatggaaaaaagtgagaaggacataatctcggaataaagtacagttcttaagttaaaaccttaagcccccaagaatgttttaactcagtgaaacatgtcttcagaaacctgtagtaaacatgatacgtaatgatgaaacaaagcattccaagacagaagtccttcattatcattactattgatcattatgctggaggttccatttatttagaaatgaatgaatgaatagataggtcaggtgcagtggctcatgcctataatcccagcactttgggaggccgaggcaggcagatcacttgaggtgagcagttcaagaccagcctggccaacatggtgaaaccccatctgtagtaaaagtacaaaaagtagctggatgtggtggtgcacacctgtaatcccagctactcgggaggctgaggcacaagaatcgcttgaacctgggaggtggaggttgcagtgagttgagatcatgcctctgccctctagcctgggcaacacagcaagaccccgtctcaagaaaaagaaaaaaggaatgaatta

SEQ ID NO: 1623 - DNA, 1032 bp, Homo sapiens
acaaaatgagaaaaactgaagtccagagcagttaagataccacccaaaggaaaatgacaatttagtaaaagtcctgggactagaacccagatttttctgactctcagtcctctattatttctgttctgccaaatagccctcctaatctaacttacaattttttattttataacagcaccttagtaatctttaatttttctttcttatttcttagtcatttaccagggactgattcttctgttaaagtttcttcctccttttctctctgcctttcaattttctgttattgttgctctgtttgatatatttatattaatattatagcctgctaactagtttcccggtttgtgttacctttttcattcacttcagactacatacacacagatgtctagagatacaatggtttaagaccatagtctctggaaccagtgtgcatagatttgaattctggctctgtcacctcataactctataactttagataaataaaattagtttctcgtctgtataatgaatccagtaatagtacatacttcataaagtgtggaaactaaagagttaataatatatataaagggcttagaacagtaactgacatttaataaacaataaatattagctgctgctatgatgaggaagatgactgtgcctactactgccattattattattaacaaattaatattagcaaggcatactctgaaaacctttaaaatatatttttatattgctttatgatttaagaaatttctggccgggtgaggtggctcacgcctgtaatcccaggactttgggaggccgaggcaggtggatcacctgaggtcaggagtttgagaccagcctgaccaacatggagaaaccctgtctctactaaaaatacaaaattagccaggcgtggtggcgcatacctataatcccagctactcgggaggctgaggcaggagaattgcttgaacctgggaagcagaggttgcaatgtgccgagattgcatcattgcactccagcctgggcaacaagaacaaaactcc

SEQ ID NO: 1624 - DNA, 1027 bp, Homo sapiens
agttccagcttcttgggaggctgaggcaggagaatcacttgaacccgggaagtggaggttacagtgacctgagatcacgccactgcactccagcttgggtgatacagtgagactgagtctcaataaataaataaataaaaagttttaaaaaagaaaaacaaagaaaaggccgggtgctgtggctcacgcctgtaatcccagcaccttgggagaccgaggcgggtggatcacttgaggtccggagatcgagaccatcctggccaacatggtcaaaccccatctctactaaaaatacaaaaagtagctgagcgtggtagcgcgtgcctgtagtcctagctacttgggaagctaaggcaggagaattgcttgaacccaggaggcagagattgcagtgagccgagattgccccactgcactccagcctgggcaacagagcgagactctatctcaaaaaaaaaaaaaaagaaaagaaaagaaaatgttaaggtaactgggtgtggcgtggtggctcacacttgtaatcccaatacattgggaggccaaggtgggtggattgcttgaacccaggagtttgagaccaacctaagcaacatggcaagaccccatccctacaataaatacaaaaattagctggatatggtggcgcgtgcctgtgtttccagctactcaggaggctgaggcgggaggatctcttgagcccaggaggtcaaggctgcagtgagccataatcatgctattgcactctagcctgggtgacatagcgagtctctgtcccaaatatgaactctttagtaaaggattctggggtataacactttctgtatagaaaaaataaagttaaatgatttcctacactgtacacagaaatatattccaagtgaattactttggtgtgtaaaacaaaactttaaaatatttgaagaaaatataaatatttttatgattatagggaataaaggctcttaagacacaaaaaactaataaaaatttttgagtttgattacataaaaattaaacttctgcatta

SEQ ID NO: 1625 - DNA, 1663 bp, Homo sapiens
cttgcaggctacacacggtgcgtgaggcacccccaaagctccgatccgcatcagacttagcccagccgaagcccccaaatttttatgttaacccagcctcacgccactcctcctctccctggtcctccgagtccccagaaaaggactcgtatctaaactcgttatctaattctcgagttagcggtctgggggactctgagctcgaaggacccccagcctagggtcttgtatcacccaatccccttaaaaagtaggaattcggacgaagtccacttaaccatcccaaagtgccatcatctgcaattctaagaaagaatgatgggacgtgtgttacctgctaatatatctttccctccaggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcaggtaacaggcccatcctgtaactaccaggattatccttctgcccctttactttctcttcacttgagcaggggaagaaaacttggtctgcttgtttctgttccgtccccattaagatagcctttcctgaagattttgtttttgttttttgttgttgttcttttatacagacggggtctctccatgttgcccaggctagtcttgaactcctgggctcaagcgatccttccatctcagcctcccgaagtgctgggattacaggcatgagccaccaaacccggcctgagatttgttttatctgtattagtttctgcatcagagtctctgtcctttcattggggaaagaaatgaaagcttctgttgctctggtaactcatttcacctttgcaagtttacagttgctgagagatgagcaactttctccccactgtggattgtaaccctgtctgttttaaatcattaatttactttttaataattgatacataataattgaacatatgaatgggtatatgtgatattttgatatatgcatacaatatgtaatgatcaaatcagggtgttcaggatatctgttaccccaaacatttatcatttctttgtgttgggactatttcaaatcttctagctattttgaaatatacaataaattattattaactgtattcacccaactctgctatggaacattagagcatattccttctgtctaactctatttttgtacccattagccaacctcttcatctcccctcccccatcctttccagcctctggtaactatcactctattctctaccactgtgagatcaactttttaaactctcatataggaatcagaacatgtgatattttcctttttgtgccttgtaaccctgtctttttcttcatccccaccttccactgctgaagttcaacactggcagatactgcagtggctgctcaagtgaatggagaaccttatgatctggagcggcccttggagacagattctgacctcagatttctgacattcgattccccagaggggaaagcagtaagtttctttcttatcaggaatacagtgactactaaaccaagagatattgaagcaggaaattctaacatttta

SEQ ID NO: 1626 - DNA, 1031 bp, Homo sapiens
tgaagtcttgttctgtcacccaggctggaatgcagtggcgcgatctcggctcactgcatctctgcctcccgggttcaaacaattcttctgcctcagcctcccgagtagctggaactacaggcatgcaccaccatgcctagctaatttttatatttttagtagagacggggtttcaccatattgtccaggctggtctcgaactcctgaccacgtgatccacccaccttggcctcccaaagttctgggattatagacatgagccaccgcgccctgccagggaattgatttttatctgccattgccctctctcagtaggacagttcctttctcttcacctcttctgtcagctaaagaccatgagagggagaaagctagaagctgaagattctgaaaatcactaactggcctcttctttctcctaggtgtggcacattggttgacctttgccagggcccccaccttcggcatactggacagattggaggactgaagctgctatcggtcagttgtgggacagagttaggttaagattcctattttgagccgggcatggtggctcacgcttgtaatcccagcactttgggaggctgaggcagatggatcataaagtcaggagtttgagaccagcctggccaatatggtgaaaccccgtctctactaaaaatacaaaaattagctgggtgtggtggcacacacctgtagtcctagctgctcgggaggctgagacaggagagttgcctgaacctgggaggcggaggttgtagtgagccgagactgcactactgcactccagcctgggcaacagagcgagagtccatctcaaaaaaaaaaaaaaaaaaattcctggtttcactgggatgagcaggagaatcggaaggtgatactttctgtcggcaccccccttttttttttttgagaccaagtctctcggtcgcccaggctggagtgcagtggcgcgatcttggctcactgcaagcttcgcctcctggattcaagcaattctcctgcttcagcctcccgagtagctggga

SEQ ID NO: 1627 - DNA, 1046 bp, Homo sapiens
caagggagcaaggggaaatgcagatgtgtagagcaaaaagctctgaacttagactgggcatggtggctcatgcctataatcccagcactttgggaggccaaggtgggtggatcacttgagatcagcctggccaacatggcaaaaccccatggcgcggtggccttgggtaaatcttacttattttccccatctataaaatgaggctattaattcctttttgtcctaccagtaaattcacctcataaagataatgaaaaccaggccaggcatggtggctcacacctgtaatcccagcactttggggagggtgaggcaggcggatcacttgaggtcaggagttcgagaccagcctggccaacatggtgaaaccctgtctctactaaaaatacacaaattagctgggtgtgctggcctacgcctgtaatcccagctacaaaaaaggctgaggcaggagagtcacttgaactctgccaggaggcagaggttgcagtgagctgagattgtgccactgcattccagcctgggccacggagcgagacaacatctcaaaaaaaaaaaaaaaaaaaaagataatgaaaaccaactaattcaggaaaaaggaaaagttaaaaagtgctgtaaaatacagactgtcggccaggtgcggtggttcacacgtgtaatcccaacactttgggaggccaagttgggcggatcacttgagctcaggagttcaagaccagcctggccaacatggtgaaacctcgtcactactaaaaataaaaaattagctgggcgtggtggcatgcacctgtagtcccagctactcgggaggctgaggcaggagaattgcttgaactgggaggcagaggttgcagtgagccaagattgcaccactgcactccagcctgggcaacagagtgagactctgtttcaaaaaatatacatataggggctgggcgtggtggctcacgcctgtaatcctaacactttgggaggctgaggcgagtgaatcacgaggtccagagatcgagaccatcctggctaacaccgtgaaaccccgtctc

SEQ ID NO: 1628 - DNA, 1120 bp, Homo sapiens
tcaggtggcctttccctggctccaccaaagcttttctaaaccacctttctttctccctatgaacctgcaaacccctgatctttatttgccccctgtatgtactataattcagctacattctacccccagcttgcttccgcttcctctctgtttttgccctttgttttcctcaaactgccagcatccctgatctctagcgggctcacagctcactgacccttatttcctgcccctagctggaagcagagatccaaagctgtcttgatttcctccgttccgtctatgccgttcttggcttctccttccgcctggcactgtccacccggccatctggcttcctgggggacccttgcctttgggaccaggccgaacaggtgagtaggaggtagagaaatagaggcagataaaccactctctggtgggaaggagtggagaatacagtaatcaaggttctcagaggcatctggtgagtgggtcatttgttggggactgaccggatgtgttgcttttgaagtctaagatgatgtattccactcttgtctcattccttcaaaggtccttaaacaggccctgaaggaatttggagaaccctgggacctcaactctggagatggtgccttctatggacctaaggtaagcttgggaccctggttagtgttgtatttatttattttttgctttgttttagtaaatatttaatagatacaaagaatttttttttttgagacagtctcactctgtcacccaggctaaaatgcagtggtgtgatctcagctcactgcaacctccagctccctggttcaagcaattcccctgcctcagcctcccgagtagctgggattacaggtgtacgccaccacacccggctaatttttttgtatttttaatagagatggggtttcgccatgttggccagactggtctcgaactcctgacctcaggcaatccaccccacttggcctcccaaagtgctgggattacaggcgtgagccaccgcacccggccacaaagaaatatttttaaacttacgtaggatataaagaaaaacaatatactttctgccctcttggcatctgcaatctagtgagggctgctgaaggtaaataggccatatcagtgc

SEQ ID NO: 1629 - DNA, 1112 bp, Homo sapiens
aagggtgtagccatagatgggtggtggtgaagatctctgagatgaggagctcaaggaattgagaggccagggtgtggacatcaggtaatattataacaccattattagatggagagagctgctgagaactactgccagagtgagttgagtagagtgaactggaggggtagcgtatgatagagctaggtgacatgatgaaggtagtagcccgggatgagggtaggttaaagggtgggatggcacaggtaatggaggatagtggttctggatagtgcttctggcttatctcgtgccttcccatctgtttcctgtagattgacgtgcacctccacgatgccctgggccggccacatcagtgtgggacaattcagcttgacttccaactgcccctgagatttgacctccagtataaggggtataaaaccttgccctatcctcttttcccttgacagtgcatggaataagtccttctgcctttggccctaaaaactaaaccctccacaccctctcctgccagagctgaatatttcttaaaaactggaaggtgatcttgggtacacaattcgtgatacttccaccattccatccacccccccctttttcctttcaaggcaggcgggtgccctggagcgtccagtcctcattcaccgagcagtgctcggttctgtggaaagactgttgggagtgctggcagaaagctgcggggggaaatggtgagacctctgacctggatttctgttctggccccaaaccggatagttatgctccagatcctgtcccccttcatatgccagcctctttccttctcaagtctgctccatacaagcacacttctggccagagccagagtgactaatttgccatcacctgttctttccctaccaggccactgtggctgtccccgttccaggtggtggtcatccctgtggggagtgagcaagaggaatacgccaaagaggtaaggagttgaggtaagggagggggcagaagcaggtccagtagagagtctggtgccctgcagtgggcaggaagaggctgcaggggtggtagaggaaggagcacagccctcacagccacaagactgggctcgagtggctgctgtcctagatgct

SEQ ID NO: 1630 - DNA, 1105 bp, Homo sapiens
cggtctcctccgcagggttctcttcttcttgtttctgggacatggcgggaccgggactgtggagtgtaaggggcccgggaaggcaaccggagaagggaagggggaggggaaacggggacaacctgcgctgctgcttcggctcctgtcactagggttgctcagtcaaaatggcggcccttgcccgtgacgttgcgaccgccccttcctatgagagccagtgggagtgaggtagatagggcaatgacgtaacgatctaccaatagtcgccgtctaaaggtgggctctatagaggcgaccggcaagctggaacaccaacctggaaagagagtgagccacaaggaccaattggaagcctgtgggggatatcgggggcggggctgctggctgtggtacttttgcagctttggtgggctccggcttccttcactccagcccaccgcgtccgagagacttagcagggcgtcaaactggagagcggaaggatggaaccttttattctcaggtggagaggattaagctttgcggtgttagcagaaaatgatcgagctccagaaaatgatttggaggtcagattcgattttaaagtagtactaacaggccgggcgcggtgcctcacgcctgtaatcctagcactttgggaggccgaggtgggcggatcacctgaggttaggagttcgagaccagcctgaccaacatggtgaaaccccgtctctactaaaaatacaaatattagccgggcgtggtggcgggcgtttgtaatcccaattacttgggaggctgaggcaggagaatcgcttgaaccctgcaggcggaggttgcagtgagccgaaatcgcgccactgcactccagcctgggtgacaggacgagactttgtcgcgaaaaataaaataaaacggtaccaatggtattacgatgtgtcacttggcctgtggaagagagagactgagtctcaacccgagctgtcttgcaaaacactaatggcttacgttccgtagtttcactcttatgtgtagtttttatattccatcagggtgatcccttggggactacgctccttgaaacaaggaggacagtgtaagtatgtggtaaacatttggtaaatac

SEQ ID NO: 1631 - DNA, 1049 bp, Homo sapiens
tgccactgcactccagcctgggcaacagaacgagactccatctcaaaaaaaaaaaaaaaaattggccgggcacagtggctcatgcctataatcccagcactttgggagaccgaggcaggcggatcatgaggtcaaaagatagagaccatcctggctaacatggtgaaaccccgtctctactaaaaatataaaaattagctgggtgtagtggtgccaccttgcgtgcctgtagtcccagctactcgggaggctgaggcaggagaatcgctggaacccagggaggcggaggttccagtgagccaagatcgcaccactgcactccagcctggtgacagagtgagactccatctcaaaaaaaaaaaaaaaattaccccactttccctaattaccatactaccctctttaccttcccgttctctaccgaatctatgtcataactcttgagaataactttgcttcttctataggaaccttgagtcagatgtctggagaactaagcaaagatggtgacctgatagtcagcatgcgaattctgggcaagaagagaactaagacttggcacaaaggcacccttattgccatccagacagttggtatgtgcaaacttggaggaaccactcctgaaaggcaacctgcaccctccactgctgattgtttcttttccccataaccttcccatttgtctctcacatagcagcctggatttatacagaaactggcagtgtttaaaaagatttatctttcccttttactcagggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtacctggacagaggactgtaaaggggtagaggctgggagcacagcacctgccctgttcgtgccatagaccagataccacaattagctttt

SEQ ID NO: 1632 - DNA, 1196 bp, Homo sapiens
ttaggtggtcttggctttgcttcccttgaggttctgattttactttttctctccttttcaacttaaaaagtatcaaatgtctcctggccaagtcttttccctatcaagacatgccctacctgccctctcagttctacttcttccttgaaacagtgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggtactgttcttctctacaattttggaggcagaggttggtggggggggaacttaagaagcagtaatgaggatggttttatagctattccatagccttcctctttcttatcctcgtatgtgttctcactgtttttggtcaaattttactttgccctttttgttgttcctctgcaggtcattgttgaaaataaattatctgaattataatacgaatctgcatggttttgatttatttattttttttctttaggagtattcacattgtgtgtaggtacagaaagggcagccaattccatttttccagggttaaggttttagtaggatagtgggacgaagaagagggatcaaggagtcctgattatctttcaaggctcagtttaactcttaggtattttgtactcatccttttctcccttctctctcccttcttagaatcatatttcttatttttaaaagttttaaaaacattttttaatactgctgcttgcagaacaaggctacctgataggcagtgtgcccagagtagccagaagaaattagaagttatatttcttcttggtgttacctcagcccgttacttctaaggccttatgatccttatcatgctttttgtttggtgttttgttttgttttcagacggagtttcactcttgttgcccaggctagagtgcaatggcacgatctcggctcactgcatcttccgcctcctgggttcaagtgattctcctgcctcagcctctcgggtagctgggactggctaattttttgtatttttagtagagacggggtttcaccatgttggcaggctggtcccgaactcctgacctcaagtgatccacctgccttgtcctcc

SEQ ID NO: 1633 - DNA, 1050 bp, Homo sapiens
ggaccttccttgaaatgaagacatagaatgattgaatagtatctagcaattttctgttgcaaaaaaagattatcttaatttcatagctaaatgaatgtcttaacagattgtgatttacacttgtaagtgaaatgtgttcagagaggagaagtaggcagggacctgattacatagggctttgtaaatcagaatgaaaaaagttagaatcaggctggcacagtggctcacacctgtaatcccagcactttcggaggccaaggtgggtggatcacctgaggtcaggagtttgagaccagcctggccaacctggtgaaaccctgtctctactaaaaatacaaaaattagccgggggtggtggcgggtgcctgcagtcccaactacttgggaggctgaggcaggagaatcgcttgaatccaggaggcagaggttgcagtgagccaagatcatgccactgcacttcagcctgggtgacaagagcgagactctgccttaaaaaaaaaaaaagaaaagttagaatcaaattcatggtgctcttacaggattttaagctgccaagtgatgtgacctgcctttttcagattactctggcttctttgtagatcataggtcttaggatggcaaaagtagattttggaagaccaattaggagatcgttataggagtacagcagagagagacattgttgcagctatgacttgcaatagaatggaggtgatagtagaggtaagaaggatagatttgggctgtattaataggtagagctacagaattggatagattatggagtggggggaaagagtagaatcaaggacaattcctaaatttttggcttgagcatcttagtggttgttggtgctttttactgagatggaagaccgaaggagtagtaggtttgagtgaaattcagtttttgttttggccatgttaagtttgaaatgccgccgggcgcagtggctcacgcctgtaatcccagcactttgggaggctgaggcgggcggatcacctgaggtcgggagttcaagaccagccttgaccaacatggagaaatcc

SEQ ID NO: 1634 - DNA, 1045 bp, Homo sapiens
ttacctaatttttaatctttatccacaacacattataaatgatgatagcttaagaattataatagttttatggatttttttgtgctctagtgatcataccgtgattgattttattctaacctcctcccagggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggttggtgataaaatataagggttgtttcctgagactgggacatggtagggaattgaaccagagacaaattgaacataagaagaaagtgcttgacatgtgaactggagtaagaggaggccagggacttctacaaagaacgtgatgagtgatgtacctgtctagctagaccagagagggacacaagtgtttcacaaataagagaatgaaaagggatgaaattttggacatggtgatatttcagagaacagacatgattatagagtccagtgtatcattttctcccatgtcactccactcagagatcttttagcatagcccagtactctgtttcaataaagtagaagaaatggaaagacagaaagggcaagatttaaaatgacagtaagttctccatactttcatagttaagatacaaagggaggtattatcaaagagaaacactgggccggcgtggtggctcatgcctgtaatcccaaaactttgggaggccgaagtgggtggatcacctgaggtcaggagttggagaccagcctggccaacatagttgaaaccccatctctactaaaaatacaaaaattagccaggtgtggtggtggatgcctgtaatcccagctacttgggaggctgaggcaggagaatcacttgaacccttgaggcagagattgcagtgagccgagatcatgccactgcactccagcctgggtgacaaaagcgaaactctgtctcaaaaacaaaacaaaaaaaa

SEQ ID NO: 1635 - DNA, 1287 bp, Homo sapiens
caagcgatgctcccaaaggggatcctcagcctcccaaagtgctgggattacagccatgagctaccgtgtccagcccagtgcctgtctttttgacctgtctccaaatctgccttctctcaaacctaggctagaagcctaagaaacagccagtaacctgttggcttcattccttcccctcccattagagttactgaaagctctcgaaattacggttacaatccttctcctgtgaagcctgaaggacttcgccgcccacctagtaagactagtatgcatcaaagccgaagactcatggcttctgctcagtccaaccctgatgtaagtcacctcaagcttattcagagtctaataaaggaaaatgggccattgtcacctcatcaagtccttcactataattactgttaggtcttctcctacttctttagccttgacttcctgccttattttctttcatccagcatctaatcttcctcttgccaccgccctttcctgccaaaccgtgggtaacagcaaggacttaaaggagcccttcccatttacttctcttacttcttaccctcctgcttccccaggatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtagcctggaaaaattttgggaatggtgggaagaaatagtaagaaacttgggatagagcattttttaaggaagctaaagaagtagtgggtaaaaattcagatcctaagaattggagcatctctgggagggctttctgactccaagctaaactattgtttgacacatcctctctcatttccatttttttactctttcccctcagctcctttgtctagcagatctaattatgcttgaaaaaaaaacctgctacttaggatctttgagttccagcttattggtgtttctcagctgcaatgttgggagagaaataggggtagaatgtccattcatgatagaatgtctgttcatgagttgggatgggtcctgaccccattctccctcctgtccaggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagt

SEQ ID NO: 1636 - DNA, 1086 bp, Homo sapiens
taggaggttgaggctgcagggagttgtgatcacgctactgcattccagcctgggcgacagagtgagacctgtctcaaaaatatatatattatttaaaaaaaaaagataagtggaaatgaatagagatacttttgttagtttcccattttcctttctctccaggagtcccgacctctacatgttgtgctgggaaatgaagcctgtgatttggactccacagtgtctgctcttgccctggctttttacctagcaaaggtgggtaaaaaaacgtagtacctaggatctgagtccctcagaacgaaaagatctggattcaagacccagctctaccacttaccagcatttagcattgggtaaattaaatcccttaactttgctgagtctcatgccaccatccataaaaactaaaatgatattttgcagtgttgctgtgaggaaaaaagtgagcaaatatatttcgagggatatgtaaaccataaagcaatattcaaacagtttattactgagttccgtataggtatcagtgatctagtgtgtattcctctgcccaggttagttcttgaggactaaaaattccttctctgcagcattgcatctagaaataggtatttaccatgagttaccttgttgactttcatgttattactaagaaggagggagggcaaaagtcatcctttcatttttatagactgggtacttatggctttgagaaaggtggtaacttacctaagtatgtctcctttggtcccagtagtcttgttactttttcctgtcattataaaaccttgtgataccttcttttcactttcctatctagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaagtaagcacaaggaaattaaattgctacctatcatgtaccatgctgggctctgatgagtgagatata

SEQ ID NO: 1637 - DNA, 1046 bp, Homo sapiens
gagccaaactccatctcaaaaaaaaaaaaaaaaaaaaaaaaaaaaacaataattagctgggtatggtggtgggcaggccaagctgggcaaatcacctgaggtcaggagttcaagaccagcctgacaaacatggagaaaccctgtctctactaaaaatacaatattagctgggcatggtggcacatgcctgtaatcccaggtactcgggaggctgaggcaggagaatcgcttcaacccaggaggcagaggttgcagtgaactgagatcattccactgcactccagcctgggcaacaagagcaaaactccatctctaaataaataaataaataaataaataaataaataaataaaataaaaagggtttaggccaggtacagtggctcacgcctgtaatcccatcactttgggaggccaagacaagcagatcacttgaggtcaggagttcaagaccagcctggccaagatggtgaaaccccatctctactaaaaatacaagtattagctgggcatggtggcgtggcacctctaatcccagctactcgggagactgaaacacaagaatcacttgaacccaggaggtggaggttggaggttgcagtgagccgagattgcgccactgcactccagcctgggtaatagaggaagactatgtctcacaaaaaaaaaataaaaaagaaaggttttttttttgagacggagtctcgctctgtcccccaggctggagtgcagtggctcaatctcggctcactgcaacctctgcctcccgggttcacgccattctcttgcctcagcctcccgagtagctgggactacacgggcccaccaccacgcccagctaatttttttgtatttttagtagtgacggggtttcaccatgttagccaggatggtctcggtctcctgacttcgtcatccgcccgtctcggcctcccaaagtgctgggattacaggcatgagccaccacacccggccaacataaaacatttttataaaaaatatatcttcaggcctggtgtggtggctcatgcctataatcccagcact

SEQ ID NO: 1638 - DNA, 1050 bp, Homo sapiens
cagagctggaaaatttgatgcatttactgaactcttcctgaaagtttaatatggagtgggaatcagtttttgtcctaatttattagagaaggcttcctcttctctactccttgtgcaaacccatctctggatagctagaaaaggaacttcagaatggactatatgtgatgaccacctgtatgcactctaggctcttatctgtctctattttatgtggtgactatatctcagaagtactaccccttctgagtagtactattatttcctatgccaattttttttaagtctctgatgctgccctttttaaatttttgtcttattttttagcctctttagtattagggggtgaggtgacattcctagactctacagtagcagtttggcatgttagtgacaggaaattgtgattccctatctccccctcctcctaccttttctgcttttgtgattccattgttcctatctcattgaggctttcccaggcattcgaatttagttagtaggtcatttctaatctctgggccttgtcttttctctctccgttcccctccttccctaccacatattttttgtttattctgaggtggtttgtttctgaaagttaatctaggtcaccttctatatcctgtgctttctagttggctttagacatcttgttctagcaacaatgatggtagcagctctctccctgaccttgccccatgtgctgtccttctgtcaaggccatttgtgtgtgtactgcggcaggtgtgtgtgtggggggatgcgcccagactgttctcacaatgtcctcagtttttcaggttgtctgacagctttatgtacagcgtatttttagaaaaacttaaatatacttctttatttagggttttattctgatgagcaagtttgtgtgtatatgtgtgtatgagcatttgtatgtatatatacttatacagatctatattatatatacagtttttgtactatcatttaaaataaaaatgtttctcaataaaatgtcaaagccgaccatttcagggtgtcattgaatttgttttcatctcctgg

SEQ ID NO: 1639 - DNA, 1046 bp, Homo sapiens
actttgccagcttctcagctattcttggttaatagggtgcttgctgctatcttagtccaaaatcagcacacatttatatttaaaaataggaggatcagtctgatagtagcacaatccccattgatagccggggtgaacagaccaatttgactagcaagatgggtatcctatctagtgtatagagttctgaaaagctgttttgttggcaagaaggatacctttctttacaaaattagctttgagcctgtccaaagctaaggacatataagcatctgtgttcagcgactggaatctcaagtaagttctcaaagtcaatatttaggaaattggacacctaccatgtactagggtacatgtagataatttctttttggtaaatacatatagtcagcaaatgctgtgcacatattcaagtaatagaaagtaattctggcaggtactttattaatatatatagtcttggctgtgctgacagaaaaaaaagcaggaacttgtggagccttaagaaccaaagaactaaaaatcttgttgaattaaatcctggtgagagaaatcatcaagatgggaaagttggagggaactagagagataggaacctagagttctctgatgggtgatactcttttttttttttttttttttttgagacagagtctcacactgttgcccaggctggagtgcggtggcatgatcttggctcactgcagcctctgcctcccaggttcaagtgattctcctgcctcagcttccctattagctgggattacaggcatgcaccactacactcagctaatttttgtatttttagtagagacggggtttcaccatgttggccaggctggtcttgaactcctgacctcaggtgatccacccgcactggcctcccaaagtgctgggcttacaggtgtgagccaccgtgcccggctgggtgatagtcttaagtaatgggaaaaattatgaactagggcaactttcctaagacttccttcctctgtaaaaaagaaccctctactccaaggagatcaataggtaaaaaatacaggtga

SEQ ID NO: 1640 - DNA, 1050 bp, Homo sapiens
aattgttctctcctagaatgttatttattatttttttgagacagagtcttgctctgtcgcccaggctacagaccagtgtagtgcagtggtgcgatcttggctcactgcagcccttgcctcccaggttcaagcgattctcctgcctcagcctcctaggtcactaggatcacaggcgtgcgccaccacgcccagataatttttgtatttttagtagaggcggggtttccccatgttggccaggctggccttgaactcctggcctcaagcgatcctcctgccttggcttcccaaagttctgagattacaggcgtgagctactgcccggcctctctcctagaattttggagcattcttacttgacgtaaagaagggaacaagagccgggcatggtgactcacgcctgtaatgccagcactttgggaggccaaggcaggtggatcacctgaggtcaggagttccagaccagcctggcgaaaccctgtctctacaaaaaatacaaaaattagtcagacgtggtggcgtgctcgtgtaatcccagctgctagggaggctgagtcaagagaatcacttgaacccaggaggcggaggttgcagtgagcttagagtgcactactgcactccagccagggcaacagagcaagactccgtctcaaaaaaaagaaaagggaacaagaaaacttatcagtttatttttctttcttctttttactgggtttccttgatcaaggacaaaagtgtacttcaagaatatactctttcctgatggccaggtagagagggaatctttgtttttctgtgctccatacccagcccagagagactgaatgaaacaccgatggtgtttcctagaggaaaccctaagaagcccgtttcccctattgcacctcacttctctgccctttcccatctaaacagagaatttaatttcgacatatgtttatcctgttttgttcatatctcctacaagcttttattcttttactgttttctatttgaagtgaacttttttccctcaacccctccatctttttaaactgtctccatttttct

SEQ ID NO: 1641 - DNA, 1048 bp, Homo sapiens
ctcctgtcttagcctccctagtagctgggattacaggtacacaccaacatgcctagctaatttttgtatttttagtagagatgaggtttcaccatgttggccaggctgatcttgaactcctgacctcaagtgatctgcccgccttggcctcccaaagtgctgggattacaggcgtgagccaccgcgcctggtctgaaatatgttcattttaatccagcagaattcattgctgtttcaagatagaaccagatttggaaataaaattggaaggtggctatctgccaaaaatttcaagtgcctcttggccatgggtagcttattcaggaaacccaagtcttttaaggaaggacttggatttttttcttaatttcaaagaacgtttttgtgccaagggatacatatttgaggtctgagaaccatgaaacttgtttgtaggattagaagcaaaagttgactagagggaaatgtagagttattttaatttaactccctcattttccaaattaggaaactgaggtaaagatgttgcataaaggctgtatgttaccaagattaatctttttttttttttttgagatggagtctcgctctgtccctcaggctggagtgcagtggcgtgatctcggctcactgtgacctctgtcttccaggttcaagtgattctgcttcctcagcctcccaagtagctgggattacaggcgcacgccaccacgcctggctaatttttgtatttttagcagagtcagggtttcaccatgctggccaggctggtcttgaactcctgacctcgtgatctgcctgcatcggcctcccaaagtgctgggatgattacgggcatgaggcaccacacctggccatcaagattaatcttaataaatatgttgctccttcttttttttttttttgagacagagtttcgctcttgctgcccagtctggagtgcagtggtgcgatcttggctcactgcatcctcctcctcctgagttcaagtgattcccctgcttccctagtagctgggattacaggcacatgccaccacgcctggcta

SEQ ID NO: 1642 - DNA, 1048 bp, Homo sapiens
gctgttctcgaactcctaacttcagctgatccacctgccttggcctcccaaagtgctgggattacaggtgtgagccaccgggcccagctggctcattctttgatatactgcttttaattggctattagctgaggtgaccccaggactggtagatcaaattgctttcaagcttttgtttctagggacatccttgcacttctgactgtttcctagaagagcgttaggaaaaatttacaccagctaagaaacaaaatttagcttttctctgaaatgtggcttggttttcttttcttttttttttttttttggagatggagtctcactctgtcgcctaggctggagtgcagtggtgcaatcttgggtcactgcaagctccacttcccgctttcaagcgattcccctgcctcagcctcctgagtatctgggattacaggcgcacaccaccacgcccagctaatttttgtatttttagtagagacggggtttcaccatgttggtcaggctggtctcgaactcctgactttggcatccacctgcctcagcctcccaaagtgctgggattacaagtgtgagccactgcgtccggccgtggcttggttttcttaatttgcttgatccagtcattattaaggatgttgtaatggtacgcttttttttttttttttttttttttttttttggagacggagtcttgctctgttgcccaggctggggtgcactggtgcaatctcggctgactgcaagctccgcctcctgggttcacgccattctcttgcctcagcctcccgagtagctgggactacaggcgcctgctaccacgcccggctaactttttgtattttttttggtgggggtgtttcaccgtgttagccaggatggtctcgatcttctgacctggtgatctgcctgcctcggcctcccaaggtgctgggattacaggcgtgagccactgcgcctggccgctttttttttttttgaacacacttccttagagctatgtgttcagcagtacttctcaggaggcaggttgacatttcaagagtatttt

SEQ ID NO: 1643 - DNA, 2035 bp, Homo sapiens
atccttgtaatgtataaccttgtatatacatctttgtttgcttcactaagataacttagtacttcttggtcagattgtacataatgatttttaaggctttttgctttgtttttttctgtttttttgtttttgtttttgtttttgtttttgttttgagatagagtttcgctctgttgcccaggctggatttcagtgaccccatctcggctcactgctgcctctgccacccattatcaagcgattctcgtgcctcagcatccctagtagctgggattacaggtgatcgccaccatgtccagctaatttttgtgtttttagtagagatggggttttgccatgttggtcaggctggtctcgaactcctgacctcaagtgatccgcttgcctcagcctcccaaagggctgggattacaggcgtgagccacagcacctggccggctttttgcaagttagtaccaaattgccctcaaggagcggaagagcctcaaacaaaatctaccttgtgactgtcgcccaggttggagcgcaatggtgtgatcttggctcactgcaacctctgcctcttgggctcaggtcatcctcccacctcagccttctgagtagctgggactacaggcttgcgccaccacacctggctaaatttttgtatttttagtggagaccagttttcaccatgttgcccaggctggtctcgaactcctggcctcaagtgatccacctgatttagcctcccaaagtgctgggattacaggcatgagccaccatgcccagcctgtgcattctttttttttttttttttttttgagatggagttttgctctcgttgcccaggctggagtgcaatggcgcgatctcagctcactgtatcctccgcctcccgggttcaagcgattctcctgcctcagcctcccgagtagctgggattacaggcaggtgccaccatgccatgctaattggttttttttgtatttttagtaaagacggggtttctccatgttggtcatgttggtctcgagctctcgacctcaggtgatcctcccgccttggcctcccaaagtgttgggattacaggcgtgagccaccgcacccggcctttttttttttttgaaaaggagtctcattgtgtcatccagcctggagtgcaaaggcaatcttggctcacttccagctctgcctcctgggttcaagcgattctcctgcctcagcctcctgagaagctgggattacaggtgcctgccactgcgccggctaatttttgtatttttagtagagacgggttttcaccatgttggccaggaggctggtcttgtgaactcttgacctcaggtgatcacgcctcccaaagtgctgggattacaagtttgagcctctgcgcccggcattcttttttaaaagataaaaaagtctggctgcagaggaaccttatacctgaaatgttttgctgtctgaattcactccagagtgaaatgacttgaagtacaagttttgtgactgctccgagaatttttgtgtcagaggcttctccttctgccattttttgaacatttacctagaattacaaaaaaatcattccacatttcacagtatggtgctaggaatctgaccaggtccagttcataattttaaactttagagttttaaaaacatgtatgcttatcatgctgtaagcaaatgggaccccaggagtaaggggtaactttctgtttttcctcattaggtttcaactttctgtgctgtggggtcagtggtaagagaggtagatctgatgtgtatctgtgctaaagaagcatgagctccttacagtaactagcagccaattcctcttccccataacagttgcagacttctaatcccagcaccttgggaggccgaggcgggcggatcacgaggtcaggagatcgagaccatcctggctaacacagtgaaaccccgtctctactaaaaatacaaaaaaattagctgggcatggtggcgggtgcctgtagtcccagctactcgggaggctgagacaggagaatggcgtgaacccgggagg

SEQ ID NO: 1644 - DNA, 1030 bp, Homo sapiens
acaaaaatcagccaggcatggtggcgggcacctgtaatcccagctactcgggaggttgaggcaggagaatctcttgaactgggagaaggacgttgcagggagccaagatggcgctgttgcactccagcctcggtgaccagcaaaactccgtctcaaaaaaaaaaaaaaaggccgggtgtggtggctcacgcctgtaatcccagcactttgggaggccgaggcaggcggatcatgaggtcaggagattgagaccatcctggctaacacggtgaaaccctgtctctactaaaaatacaaaaaattagccaggcgtgatggcacacacctgtaatcccagctactcgggaggctgaggcaggagaattgcttgaacccaggaggtggaggttgcagtgagccgagatcgtgccattgcactccaacctgggcaacagagcgagactctgtctcaaaaaaaaaaaaaaagcgacagagcgagactccatctaaaaaataaaaattaaaaaaaaagggacaggtgcggtggctcttgcttgtaatcctagcactttgggaggcttgaggtggatggatcatttgaggtcaggagttcaagaccagcccagccatcatggtgaaatcccgcctccactaaaaacacaaaaattagctgaatgtggtaggaggcgcctgtaatccctgctactcaggaggctgagcaggagaatcacttgcagtgagctgaggtcatgccactgcactccagcctgggcgatagagtgagactccatctcaaaaaaaaagaaaaagttatatttcccagagaaaatatggatatttgaataagaaaggggtctagaataaaaatggaatatgcacgaggcctatgtgagtatggagaaggagagagggacatacacagttgctatccaaaaggatctggtattactgagcaagaggcaggagtttatacttatgtttagtttgactcaaactctgatggtttcagtatgcttgacagagatgtgagtgtgtgatacactcttatgat

SEQ ID NO: 1645 - DNA, 1037 bp, Homo sapiens
cctctgtcctatggattgacccgtaaaaaacaacctaatgcattggataggaggcagtgtgatttcttcttcttcttatgtcttgctgtccatgctgtgccattgtctcactaactcatctaagaagggctgtgattatcttaggaggaatgtattcccccactccccccaccatgaggtgactctgagtgtcttcgcaaggtagattctctggatgatagggactggcaagttatggctacctctgtttaaccccacagtgaagggagcaacctgacccctgctcatcactacaatgactttcgtttcaagacctatgcacctgttgccttccgctacttccgggagctatttggtatccggcccgatgattacttggtaagcatctggatatcaggacactgtgactccagtatcagagggatattcccaaaggaaggccccttttctccacagtctcgctctggtttttatttagaaaagaattgcatctgtagttgatttttgtgttgggcaaggccctgatgtgtctaaatctcttagttcttctctgtttgccccagtattccctctgcagtgagccgctgattgaactctgtagctctggagctagtggttccctattctatgtgtccagcgacgatgagttcattattaagacagtccaacataaagaggcggaatttctgcagaagctgcttccaggatactacatggtaagggagagagaagcactgtccacctgtgctgctcacttctgggcaaggctggggaggctgtcttcagcagggtaaaacagtgtcagcacttctatcttaagagtgtagttcaggccaggcacggtggctcatgcctgtaatcccaggactttgggaggccgaggcaagaggatcacaagatcaggagatcaagaccatcctggccaacatggtgaaacctcgtctttactaaaaatacaaaaaattagccaggcgtggtagcgggcgcctgtagtcccagctactcaggaggctgagacaggagaatggcgtgaatct

SEQ ID NO: 1646 - DNA, 1033 bp, Homo sapiens
ctcagatcatgtttttttccttccattaggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccagtaagtgggctcagggccactaggggggagaacataggcccacagcacttttcttttcttttttttttttttttttttttagtttcactcttgttgcccaggctgatgtgctgatgtgcaatggcacgatctcagcctactactacctccacctcctgggttcaagcgattctcctgcttcagcctcctgagtagctgtgactacaggcacctgccaccacacccagctaattttttgtatttttagtagagaaggggtttcatcatgttgggcaaactagtctacgaactcctgacctcaggtgatccacccgccttggcctcccgtagtgcagggattacaggcgtgagccaccgtgcccggccacagcactttttctttaggaagggacccagcttctggaaaggagtagccttgactcagcagttggatcagtaacattattgttgacagaagtatagaatgagcttgaacgagctttcttaatacaaaatgaaaagaagattaatttcgggtttatagtatatgtgggaaggagagctgttcaagagttaaagacttaaaaaattatagtcttaaatgcatgtctgcaaattatattagaactttattagggctgggcacagtggctcatgccagtaatcccaacactttggaaggctgaggcaggcggatcacttgagtccaggagtttgagatcagcctgagcatcatgatgagacctcatcactacaaaaactcaaaaattacctgagtgtgatggtgagcacctgtggtcccagctactcaggaggctg

SEQ ID NO: 1647 - DNA, 1086 bp, Homo sapiens
ttagaggaaggatctcattttctcctgtttttttaatgtatttttttctctttttgttttcttgatcacttattatctgaccttctggtttatggaggatgaggcagttatgtgtaggtttcacttccccatcctgatctgactaaactagccaacagattttctcaccctttcctttttgccttttccagtatgggtggcatccctgcccggaatagtaaaggggaaaggcttctgctttatattggcatcattgacattctacagtcttacaggtgaggagcatatggatcccaaattaagagagggtggatacagataaccagtcacgtttctcttttagataggtttgttaccaagttcttccggaagcaagaacagtgagttgcagtctggctacttacttcattagttttcagatggtttatttccttgattttgcctctttccccggcctttataacccttcctcccccatctccccagacataatgtataccttctgtggaaagctgagtcagtccttggaagcaccagggtagaatatgccatctgtctggctctttgcaaaaacctatgagatgagtcatgttccacatggggatacaactggaaacgttacccttttccaaggaggaaaaacaggagggtcactgtgttctgtaaaatgtattagactgtggaactaagaggcaatggagtgatcatcagggaggagctggaattgttagaccccagttttgttcctgtaaggttttaaatactaatgaggactggacggtacttgatttgttggttcagtattatcatccagttttaactaccctttccagtcttgcccatctgttccttcagctctccttttataataaatattcatgttcctgatttgtcagggacataaattgcccttttcccatggggggaataattgacttacctagaaacaacattggtctctgtgatgaaccagcactgccatgcctgttcttgggaaaaccagtgtaccagtagatgtgctttctcagcttctgtcttttcaagattttctattacccctttaaccccctaaaatataaagttatt

SEQ ID NO: 1648 - DNA, 1025 bp, Homo sapiens
atatttttggtacctcatacttggaggctgaggctgaaatagaaatttcttaacgcttgaattccatttctgcttaatctcatactccacatccttaactttacactctcccttttcagtaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaa

SEQ ID NO: 1649 - DNA, 1046 bp, Homo sapiens
aagaaagaaatgaggtatctcatctaaggcactgcttccgtccattagcacaggtagaaccttaactattagagctctcagggacctcagaggtcatcaagaattgatccttacaggagcttatataactgcatcacttacctgccttcttctggtctttgggaaactcgagattatatttcacattagctggatacttttagatcatgaaaagttgcagggatctaagaggtgagacttcagatccacaaaacctcatttttaccgttcagttcagctgtcaaagctgttaagcatttaatgagatgattgcattgtacttttctgcactcagtgctgccaagtgtgtgttattttatagacctcttttttttgaggcagtggcacgatcttggctcaatgcagcctccacctctcaggttcaggtgattctcctgcctcagccacccgaatagctgggattacaggtgcctgccaccacgcccggctaacttttatattttttagtagagatagggtttcaccatgtttgccaggctggtctcaaactcctgagctcaagagatctgcccacctcggccccccaaagtgctgggattacagttgtgagccaccatgcctggccctattttatagatttttttttttttttttgatggagtctcactctgtcacccaggctggagtgcagtggcgtgatcttgactcactgcaacctcggcctcccgggttcaagcaattctcctgcctcaacctcctgagtagctaggactacaagtgtgcgccaccatacctggctaattattgtatttttagtagagacggggtttcacaatgttagccaacactggtctctaactcctgacttcaggtgatacacccgcctccacctcccaaagtgctgggatgcacttgggaggcataagtcactgtgcccagcctattttatagattttttttttctttttctttttttttttttttttttgagacgaagttttgctcttgttgcccaggctggagtacaatggtgtgatcaccacaac

SEQ ID NO: 1650 - DNA, 1011 bp, Homo sapiens
gaacccccagtgtgggcctgggggtgggaggatgggacttaggtatgcctgctagacaggttcagggaaggactgatgggggtgtcatggatggacacacctctccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctccattcaggcctctctttttctgtgacttggacaatgtggagttgaagcgggtgagagaacatggaaggcccgcccttctcagggaagaggtggtagtgaccaagacaggcagggaaaaagcaaacttctatgtagtgccttttgtatcttggacactgaggcatccgttcatacctcatcacccatctccccctgcactcccccagaaaacctggaaatgacacaagtggctaactaaggactttatttcaaacaaaaattaaaaataaaaaattgagagctcttttccctgggtttggggaaggagtcagggtagggaattccacatggctaggccagtaccctcagtacactggagggctgtgggaattcccttccttgcccatgatggggaacctcagcaagtgcagggcccacgcagcgcccgccagcaaggggagcttgggccaggggtcggtccctgggaggggtaggtccctgggaggggtagagctgggcagcagcatggccagtggccaaccacaggatcaagtcctaagtaccgagaacctactcttccccacttcctgggccccagaa

SEQ ID NO: 1651 - DNA, 1028 bp, Homo sapiens
gtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttca

SEQ ID NO: 1652 - DNA, 1045 bp, Homo sapiens
actcccctccgcccccgtggactgccccttctgccctccagaccaagtaggcaggacctctggtctgctcctacttttcctccggaaacaccatccctccccgctcgtctcctttttctttccttagttaccctctcctcatggttacgctgcccctaaatttttccatcccaccgtgtgcccctttcctcccctcctttttgtatttctactccaagagtttaccttgctttctgacccttgcatgcctttggggtggggggcgtgggatttgacaccgtagtttctcttctcggttggccccgtatcacaccctaatttggaatctagcgtctccatcagcacacccctctgagagcatcccttccctggcctcctgccttcactcctgctctatactcatgcctcctcctagtcaggtttatggtagaccccttgtaactcctcctccttcaaaactacttcaagccctttttgggtctttgaccgctttgcttttttagggcatgcccgtctctgctgcctcttctactctatcctcctgtgatcccacacttgactttgtcctagtctttccctcccctaggctgcttttcctttcttctgttttttaaggcgccttctgctgctgcagcccaccctctctcccctgctgcagtccctcccccttcatacgcctcccccaccacatccctccatgctcttgcgggatgctgccttgtcttgcaatctctgtgcacaccgcctccattaccctaatctaggtgttacatttgcctttttgtacttcgtattgaaattcggatagtgattgccggttgacttgcaggtggtgtgtgctcgcgttgtctccgttctcctcagcagtcttcagtgctgtgtttctgcttactgaatctatgttgtgcattccttttttacacttttactctctccctccatatttcgatttgcccacttgaaatcgttctcattttttataaattttaattgtaatttccgcaaccttctgttgcctcttgtaaaacagtaggtttgcaaaagg

SEQ ID NO: 1653 - DNA, 2050 bp, Homo sapiens
ctgtgcccgctacttgtctcgatcttggttaggttgatgctaattttcctaaagcattttttaggcaatactccttagagcttttgtctgtcctccaagttcttaaagtttacctctgttgtcccaggaaagctttgcatgttgctgaagagccaggtggggtcagaattagggataggtggattatcattgtgtggatatagtttgtatcaagtcataggtgaatgtatggaccttgataattgctatttaagacttttccctattttagattcttctattgtgtttacaaattgtttttgtaacaattttcgtatttttcagttgtttggacaactgacagtggtgtgaaagaacagagtaactttgaaatttaagggcatacaaacttggacacaagtaagagcttcagtttctttgtgtttcttttaaagtcggcttaccaaggctctgtcctaatctttagtcctgaaactaaattggagcccatatggttcagtttgccttttctcctttcaaaactgtctagattctaacagggcttggtactgcagtatgaacaagccctctgggctctaaattttactgcagatggaaagtttttttgactagcaaagctggtttccaccttgtaatttttcccagtgtaacatatactgagtgttttccctttgatgtgtatgtacctggaggctaatgagtaaagaatgctttcaacaaacagaaccaaaataaatatgtctttgcactaattatatagtatgtgaagtaacatttgacttcaggttaattttcttaaggttaaagtagttccaaggactcttgattgatttctcgagagacgctgctggaaggttttagtgtgtggtggatatggatataaaactgtctgtatttttgaaggattagtttaagcatggaccactaagattggcttgcaagcattcaaaatcatgatatatttatgctagtcagtatatatgctttcctctttgatagccaccagataatagactcatcaactttccctcattaaagtcataagataaaataaaactgtgtatatcaatttgttttttgaaagtcagttttttaacttcattttatgtgagagtttgaaaatgaattaaagaggctggtgccacaagaagtatttttatgagttaagtgtgagtcatgtaacacagactaggtaccgtctcaaaagccgctttctcaattgcaactgaattctatttgactgatattttctaggtagattttggtaatgtttgaaataatgaaatcatggttattgatcaaaggaaatttgtttggcagcggttctcaggctttagggtacatgagaagcacttgggtgtgcttatctaaagtacagattctcaggctcaccttttaagggttatgattcagtagatctttcatagggcctagaaatctttatttttttactcctttgccaggtgtgggtaatgcaacccacatactcagttacatgcccagggtgatgcagtaggttgtaggccttggattctcagttcattttatcttcatgattatattgagagtaatgagctaaggttataccaacaaatagtgaattgttaggctctcgaattccaacctaagtggaaaatcagttaaatactaactgttctatctgatcgtctatactttatttattggatcttgctaagctcttgaaataaagatggatggttaagaggtagcacaagttaatattaatagttataataatcattttactgctttgcagcgtgtatagtgtgttatagtttgtagttttatttatttatttatttatttatttatttagagacagcgtttcactcttgttgcccaggctggagtgcagtggtgcgatctcggctcactgcaacctccgcctcccgggttcaagcaattcccctgcctcagcttcccaagcagctgggattacaggcatgtgccaccacgcccatctaatttttgtatttttagtagagacggggtttctccatgttggtcaggccaggctggtctcaaactc

SEQ ID NO: 1654 - DNA, 1057 bp, Homo sapiens
tagagataaatgaaaagcacaatcgaagtatagaggcaggagtgaatatgcctaagaagactggtggggagacagctcatacaaggcttttaaactggattgaagaacaaataaaacttcagagaaggggcaaggattttataggttgaggaaaactgtgaccaaagaggggaaaatgtgaaaagctcttaggctagcaaggggcttaaagttgctgtttgtctgtagacatttgtgatgatagaaactggaaaggaaggttgcagtaagattttaaaaagatggctttgaatgtaatcccaagaagtttggatttttttctctttatgagctcagaatatagctgtgtgtgcattaatacccaggacttcctgtgaattcagttttatataattatttaccagaagaagttgaataacttttccaaggcgaaagaggaaaatcactattagaattagagtaatttcagagccatctagtctcttggactgtcttgtactatataaagaagggaactaagaacaactaagctctgacacccagaactgggaacagctggtgaggagctggttgcctttaacttgtgtttgtattttatttcacaatcgaatccagcttctcagttatcctttctctttctcttctgttttaaatgactatacttactattgtgtttacaattgataactttcatccttgtgtgctacaagcctgttgtgttctagctctactttcctccaagtctgttcctctgatttgaagatgctttttttttttttgtgacagagtcttgctctgtcgcctaggctggagagcagtggcacgatctcggctcactgcaacctcagcctcccaggttcaagcaattctcctgccttagcctcctgagtagctgggattacaggtgtgcaccaccatgcccagctgaattgtttgtatttttagtagagaccgggtttcaccatgctggccaggctggtcttgaactcatgacctcgtagtccacccacctcggcctcccaaagtactgggattacaggcataagccactgcacct

SEQ ID NO: 1655 - DNA, 1050 bp, Homo sapiens
ctagttttcattgtatatagcttccttcacaagtagtatacaaatcctgactagagctttttctcctgcttttggaaatgtttatgttagctttgcagtttccctagctggccaactttggttgaatagaagtcttatttgaagccactcccattagctagcttaaggcctctctctattggggccaaatgttggtcttatgtaaaagtaagtattttattaaaattatcgcgtgtgtctttacaatgccaaagacataaaataaattagatatcatctgtgtaactaaagcaaattttcatcttatttgtggattgttggaatttttggcccccttaattttttccttcattttattatgaaaagtttcaaacctacagaaaaattgagagaattgtacagtgaatacctgtatacctatcacctagattctataattacattttgttgtatttgcttaatcgcatatgtgttagacatttttgatgatgtatttaagctgctgcctttctttataaaagcagtatatattggtagatcctactgggcagtcagtacttttgtgtgataagagaattggtgcttcactgatccagtggtcttgtgaagctggctatctgtgaaccccattgtcattggttgagagcttaattatttattttcaaatgaatttcagctagattatgttacaaagacagaattgaaaggcaagggaaattgctggtagaaaaggtttgtatcatcaaggaggtgaaaatactaccaacttgtttgcccaattgatacaaatactataacacaaatagctaccatttattgagtagttaccatgttctagagcttcctctcattttaattttcacaacaactccattagccgatgatattaaccccattttatggattagaaaattgagatttaatgagataaagtaatttacttaagggctcatccattaaacagcacaattggtattcaaacccaagtctgtttgactcccaaacccatactttgaacctgaagtctgtactgctgaaagtttctcctta

SEQ ID NO: 1656 - DNA, 1149 bp, Homo sapiens
aatgtcaaataagtagaatcataccatttgtactctcttgtatctggctttgttcagttagtatagtgcttaagattggcagacattgttatttaaaccaaatatttgtccctttttaattgctgagtagtagtccattgtatagatttactacagtttgttcatcctttcattgttcatgcacatgtgggttgtttgcagttttggactagtatgactaaagctgccatgaaataatattaaatgtacaggtctttatgtagacatatgttttcattgctcttgagtatataccaagaagtggaattgcagggtaagtgtaagtttaactttataaaaaactgccaaacagttttccaaagtggctatatcatttttacattatcatatgcagtggagagttccagtggttccataacctcttgatattttcagtctttttaattctagccattctcatggacatagtgataccttactgtggttttaatttgcatttacctaatgactcatgatgatgagctgctttttgtgtgcttaatgggcattcatgtgtcttcattgatgaagtagctgtttaactcttttgcccgtttaaaaaattgggttgtcttattattttattgtaggggttctttatacattctggttctacaagtcctttatcagatatatatatatatatatatatatatatatatcatatgtatcatatatatatcatatgtatcagatatatatatcatatatatctgatatatatatcatatatatgatatatatagcatatgatatatatcagatagatatatcagatacatatatatcatatatatgctatatatatctgatatatatgagatatataagatatagatatatatgagatatatatgtcagctatagatatatatgagatatatatatcagctatagatatatatgatatatatatcagctatagatatatatgagatatatatatcagctatagatatatatgagatatatatatcagctatagatatatatgagatatatatatatcagatatagatatatatgagatatatatatcagatatagatatatatgagatatatatatatcagatatatatgatatattttccagtagcttgaaaaagga

SEQ ID NO: 1657 - DNA, 1031 bp, Homo sapiens
cctctgaggagtatcgatgtttttgttttagctggcaataagctgtaagctgtgtcgccttctgtgggttaaacttcaaatctcagtttaattctttcagcctttgctgtgctactttgagtctgtatacatccaagaagggattagtctgagatacatgtggtgtttattcttagaattaaggatcaccttctctggttttctcttgtcttggattctccactcactctggtagcagccatggttacctagaatcttttccctatatgtttgagtcagaaagacgtcactttctgagttttagttacttaaattgtgctattttgtaacttatgcccacaagcagggcaaagccctcttaatgcaggagtgtaccccaccctgtgcatcattgctccatgttttgagtcccctccacagtctgcctgcttttagtgtgtaattcagactcctcagataattgtttttgtatttcgtccagaatttatagtggttacagcagaagggttggtctacaggaagtgtatgcactacttgaaatggagttttcagttctgtcaggtttttctttatttataatgaatattatatcttgatgaattgatccctttaacattatttatctctttatataagtctctatctgtaatatatctatctgtctttatccctggtaatattctttgttctgaagtctttctctcatataacatatgagccactaacatatagccactagtagccatgtcacctttctttcggttattgttttcgttgctatattttccatttaacctatttatacatttataattaaactgggtttctcatagaaagcttagagctgggtcttgcttttttatccagtctggcaatgtttttatttggaatgtgtagactacttacctttagtataattattgctatagttaggctaaatctactatcttgttctttgctatctatgttgtatcattatttatttttttcctcatttcctgccttcttttggatggatagagtatttttaa

SEQ ID NO: 1658 - DNA, 1032 bp, Homo sapiens
atatacaatggtaatttagaatgcttataatgtccagttcctctatcacataatggatgaacctaggcctcatatgtgagcagatatgagaagaagggatataatcacatttggcttactgagatactaataatcaacagttttatctttgttttatcaacaaaacaatggcatgaaaaagagataccttacttatattgaggttgatcttgaaaagaaattttgttactaccagtttatgttttgttgttgtttgtatgtaattgtcatttatttgcacacagttttccaatttcttttttatttgtcatattaggacctgagttcctagagagaatgagtgattcttgtttaatatgcctttattgtcccagcattttgctattttatgtagatattatgatggtaattcttaggaaatggaggtgcctaatgatcccaacatgagacatggatcatctaaaaagtaaacaaaaaaattttgtttagccagaatataattgacaaactattttacactctagaatcaaatatatagtttttttgtgttaatgtattaaatgtaggctgaatgtgtgaaactggatatttaagaatttgttttctttttaagatctgtgctattaagtacatttcttgtaagtggtgttaaaaatagaatgaagttattttagagagggaagctgatatttaaggagagactattatcagcttacactggaagggagaagctcgtatttagagataatagctgttggggcagatacaggtgttttttcccttttctttcatatatatgtatgcgtgcatgcatgtacacatacatacaaagaaggatagctatggaccattaatgcaatttttgtgaggccaagatggcagaacctctcccctttccctcctccacagacatacacctgctttttcctacagcattgtctgacttaattttcttgaaaccaatctatcctgtttaaccttaggctatcgcagcaaaggttggcatggacagtacgacagtgaattactttg

SEQ ID NO: 1659 - DNA, 1077 bp, Homo sapiens
cttaatagctaaatgatactaataatagctactgatatatactttacaaaactcttaacatctgtcatctttttcttgtacatctatgagatattccagttttacacagtgaaagggtttacatgacttatgcaagtacacattggtaggtgacagaactagaagttgaattagtctctcaatcttttttttttttttttttttttttgcgatggagtcttgctctgtcacccaggctggagtgcagtggtgctatctcggctcactgcaagttccgcctcctgggttcacgccattctcctgcctcagcctcctgagaagctgggactacaggcgcctgccacctctccccggctaattttttgtatttttagtagagacagggtttcaccatgttagccaggatggtctcgatctcctgacctcgtgatccacccgccttggcctcccaaagtgctgagattacaggcatgagccaccgcgcctggccctcttgacttaatcttgaactcatttgcctatccaactatctttccttaaaatactctgggaaatgctttccaccttgagtaccaaacatcattgatcttccttatttcattctctcttcaggttaattcatgtggctttcaaacacaaatcaaactttctttaataaagaaggagccatttcttattgcttattttagctccctgttgtttatttccttaagtctaaattcctgtgcctactttttaggatttttcataatctagtgttagtctgcctatccagcattatctttaattgtctcctgttcccttatttaaatcaggcaaatctgttttctcaaagtatttaagcacagactcattcctgtttcctatctttagcttatagtttctcttcttcattctgttctttggggatccacctaaggcttccctgataactgtaattatcaataagtgcttccattctgactgcctatatcactgtctgtaccatacatgtttgctatttcattgtaatgcagcattatatactgtctttcagtgctctctaattgtttacacatgtataaaataactggaatt

SEQ ID NO: 1660 - DNA, 1032 bp, Homo sapiens
gtaatctattatgaagtcatttttagacttgtttatattttgtaatcacccaggtaaaaactcaagtatagttgatagacagatatgtttccccatggtcttttgccattgtgtataaaatatgcttaaacatttgtggaattagattgtcttgaaaacctagtgccaacatatttctgtgtactagccacatgatatgatagtcagattttgaagaaaggctcatcaaagtttgaattttatgagtataatatgtattcaagtatcagtgttcaaaggcattagcctagccaatattaggtcatggtcaatacattgaaacttctcacatgggccttctgagcccataggccctgatgccattaaccatagcaactaagtgtggtgaacaggcctacgattaggccaggtcactacaattagtagttgtcacatcactgtgagaactgcagcaacacaatgaacttctcagttttagtttcttttctgtaaaatggggatattccgattatcagctattaagtagaatcttgacaaaatacaccaagattcttggaagataaataagctttgtgtaagttcccctgtcctccaaatcttcaaatacagaagagagctcacgtctgtgcatagtttataatacccagtgtgatcaaaaacatttttgttttttacttacttacaaagttagactgaatctcaaatttggatggttgagaatataatatacaagaaacaatgttttctcttctcttccttcctccctccctccctttctgtctcctcacacaaacagtagacatgtgtaaattatgcttttcttatgttgaagtggcctgattttgcccttgttgaacagataaataaagagcttttgtgtttctctacataatttgtattgatttcacacaaggcagcatgtatgtcagtttttctcaaagtgtggtctccagtctacttacatggaagacacttttgaagctgcttaaaatgcagatttctagactccaccccacatttactaagccagaa

SEQ ID NO: 1661 - DNA, 2278 bp, Homo sapiens
tgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgccttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattct

SEQ ID NO: 1662 - DNA, 1049 bp, Homo sapiens
gttcaggggctcattcattcacccacccattagctttggatatttaaaatctaagaaacactactgtgctaatggaggggggaagtgttacctttcctaagcaaagaatccataaagaagaacaaagtggaattccagaattagagttacagtggttaaagtcaaacatttattaggtatctgctgttgggggtggggtggggagattgtttgagatactgcaacagacacaaaagcaaagaaagaaacatttctgccagcttacaggctcacagaagaatgagacacttacgcatggccatgatacacagcagtgaaaggtttaagtgccataaggactagaaaaggaaggagaaagacctgtggatgagggccgttaagattttcatgaagaaagtagtgtttaaggtgaactgttttagtgtgagaaggatttcaacaagaaggcattcaacaaacatttattgagccgttatgtgccagacactgtagtaactgggaatgaaaagacatgggagaaaagggaccaaacttgcctagagaacaatgaatagttctatttgggtatgtgtaggaatgaagtggaaagtaaggcttcgaagagccttgaatgccaggctgaggtgttctatgaaaaacaacaaaaaacagcagcagagaagttttgttttttattagctgcagtttagaaagattgatgcttcagaacatagacagaaggaccaattaggaaattgctatgattactcagttaataagtgtaggcagtgataattgaaaagagggaaatgatatgagaaagtttgtggaagtgaaatcttaaatgatttaataccattgagtttatgcgaaagtactaaaaactcttgaggttttctgtctatgtgactagaaaatagaaatatatgagtcaggactttatgggagaaagttttagcattggccctatgatgatgtagatatggatgggaagtccagtatagatgtccaacagtcatttcttatttactaagcaatgtctaatatttggggcactgtttagggtgacc

SEQ ID NO: 1663 - DNA, 1006 bp, Homo sapiens
aaagcaccgtgcaaatcccagttattatgtttattatgaggttcagcatgattaaatgcaaagaatttgttccatctgaatgaggcttttaaaaatacactggggccagtaattacagaaatgtaggctcccctaaacatgttcccaattaggaagggatgtaactgaatgaactggggcatggcgggggactctcagatccttgacatgttcttggtcagctcagtcaagcttttcttgatcagaaaatggaaaaaagcagaaaattctcatcccttgtgtctttcttagaagaagataataaacccagtggccaaagaatgttaacatttaactgattttccttatgtatcaggacctttttctgaaactatgattgttaaggattttaagtaagacccaaatcagtatggggtatgattttcttgtttgtgattaaaacatatggaagtaattatagatctcaaagtaatttttatttatacacaaataatacatacgttcctgatccttgaaaaaattgaaacattacttgatgacatctaagacttctttgactactactgtctctcctgattcccttttacttttctcagaggcaatgaccattatcagtttggtgtttttctttctgagcttttccgtctttagaagtagagaaaaccaaggtggacatggtacgcaagtctccacatggttttcttctgtggtttagcctcatctcctgggccagatcatatgcttcttgagaccagaaaccacatgaactccttgatctgattccacaccactcccaggcctggaatagaatcatggagaagtgaggggaatggtgaggaacagttaactaaacgcttgtttgagaaaaattattgtcctgcagtttactcaaatagagctagtaactcggctgggcaagtttcagattctgtgtttcaaaaccacctcaacccacccagtggaaaccagaatattctcatggctttacaaaaacgcctgagcttta

SEQ ID NO: 1664 - DNA, 1088 bp, Homo sapiens
taaataaaataaagtgagagacatgtgactcttccattcactgaaacacttagaagccattgtctggttactaactggcgtaatttcaatattgtatcttagggaatagataggcctgactagagggagaaagaaaggggagcagctgatcactggagcagtaagaacactcatttatcgattaaactctctgtttcatataggaaaggtttgtggtgccctcaacaattacaagtgtaacagcaaagatcacttattacagatcaccatagcagatataataatagtgaaaaagtttgaaatattgtgagaattaccacaatgtgacacagaaacatgaagggagcacatgctgttggaaaaatggtgccgatggacttgccagacagggttgcctcaaaccttcaatttgtacaacacacagtctgtgaagcacaataaagtggagcacaataaaatgaagtatgtctgcatgcaaactcctctgaggtatacgagtaggagtagaactgctggtagacagggtatgcacatttcaaagaaatctgttccttatcctgtctctattttttcagtctgccagtccccttcctgccttctttcatatctatctaggattccatcatcacacttttgaagttgtgggcctcaatcatgttataatgcattgtgattgttgtcagcaattggtaagcatctcaaaaaagaacaaaccaagtcacccagatcactccccaaagtgggcagaagagaaaaggattgggttaaaggttgcaataacagtgaccccctcctgccaggcatgatgaatcttcctatctagacaaacttgctttaatctccttttgtttcccactctacttcctttgagagatgtcagagataatgatggtgagtgggctaaattcactttcttcctctcacttccttctccacttggctcttagcttcacctccactactccccatgcacacatgccttcagatataatatttacagctacttattgccttttatttgctgtgctctcactgctaattatcctacattatgtttcattctctttggttttgttgccaagaaatat

SEQ ID NO: 1665 - DNA, 1092 bp, Homo sapiens
gcctgggcaatagagcaagaccccatctcaaagtaaataaataaataaaaagcaaagcaataaatgagaaagagaaggtatgagatgaggggaaataatgatgaattatcatctaatttatttctatcatccatttccatctcttaataactgaactccttaaaagagcagtcagcactccttgtctctgactcccgtaactttcacttactcttcaacactttataggttgattttcacagcttctttcaggctttttgaagggcttttcttccatggtctgtgcttaaatgtttttactctccaaagctccatccttagctctttgcctgtttggatcagtttccagtcttaccatttataaagtagggtaatggagcagaatagagacaagacacattgttaattcataaatttttgttggcaatatttatgcaattggaatgtcaaaactagagcgttagaagctctgtctataaactcaagcatattgcagtcagtcacagtgatctgatgatactataagacttaatacatttctgtacaagttatgtaaaatataaaatttggcagaaacttcaaaacttgaactttcatatttaatgctctagttgaaacccaacaacaaaatttttctttaatattaaaatttaaacttacaccacttacatatgctaactgaggagggcaagtatgcactgtcctttaaaagaagatcaatattaagtagaagaattaaggtaggattacatttttaaagaaaaggttagagccagataactttgtcctcagaaagaacttgtcacaataaattcctgttttttatgtttttcttctcgtcttggtttttgagttagttcctctcctgttggtgtctcacttattaaggtaatggtcacattgcttgtcgatatatttttagagtgtagcattgttataaaaaatagtaaaaacttgtttttgcttgctttcattgttacttgccacagagctttttttttaaattagtatcttctgtgtacatgtcaatgtgatttatagatatttagacattaactgttcaaatccttaggtgaaatattagtatttctg

SEQ ID NO: 1666 - DNA, 1025 bp, Homo sapiens
gtggtttcatacaaattttaggaatgcttttttctatgtctatgaaggatgtcattggtattttcatagggattgcattgaatctatagatttcttggagtagtatggacattttaacaatattaattcttctaatccatgagcatgggatattttcccattatttgtctcctcttcagtttctttcatcagtgttttatagtttttattgtagagaactttcacttctttggttaaattaattcctagacatttagggttttttttggtattattataaatgggattataagatggatttcttggtttctttttcagattgcttgctgctggtgtatataaataccactgaattttcatgtcgattttgtatcctgcaactttactgaatttgtttatcagttctaagaattttttggtagagtctttaagttttcctaaatacaagatcatgttgtctgcaaacaaggataagttgatttcttcctttccagtttggatgccctctgtttttttctcctacctaattgctctggctaggacttccagtactatgttgaataggaattgtgaaagtggtcatccttgttttgttccagagcttagaggaaagcctttatttttccccattcattatgatgttagctgtggatttgtcatatatggcctttattgtttcttctatacccagttattgagagtttttatcatgaagcagtgttgaattttatcgagtactttttttagcatctattgaaatgatcatggctcttgttcttgattctgttcatgtgatgtatcacttttattgatttgcatatgttgaagcatatgcataggaagcttttattcctagggtgaaccccacttaatcatgataaataatctttttaatgtgttgttaaatttggtttgctagtattttgttcaggatttttacatctatgttcatcaggcatattggcctgtagttttctttttttgttgtgtttctgtctggtttgggtatcagagtaatgctggcc

SEQ ID NO: 1667 - DNA, 1031 bp, Homo sapiens
tttctagttttaatccattgttggaaagatatttgatatgattttgatttttaaaaatttgtaaagacttgttttgttctttgaaagtttagttgaatttgtcagtgaagccatctgtcctggacttttctttgctgggaaactttttattactgatttaatctcattactcattaattgactgttcaggttttctgtcttcctgattcaattttggtaagttgtatgtgtccaggaacttacatatttcgtctaggttttctagtttgttagtgtatagttcataatagtctctggtgaacatttgtaattttgtgatattagttgtaatgtctcctttttcatttctgattttacttgagtcttttttctttttttccttggttagtctagcaagtgttttattgattttgcttatcttttcaaaaaacaacttttcatttcattgatcctttgtaacattgttttagtctatatttcatttagttgtgctctgatctttactatttctttctttctgctgatttggggtttggtttgttcttactttttagttccctgaggtgcattttaggattatttgagatctttctgttttttttttttttgatgtaagtgtttattgctgtgaacttatttcttatcactgcttttgctgtatcccacagatcttggtatgttttgtttcacttttcatttgtttgaagaaattttttatctcatgttaatttctttcatgacccagtggtcattcaggagcatgttgttcagtttccatgtatttgtacagtttcccaagttcctcttgttattgatttctagttttattcctttgtagtctgaaaatatacttgatatgattttagtttttaaaaatttattaagacttgttttttatcctaacatgatccatcctggagaatgtttctcgtgctgatgagaagaatgtgtattctgtagctattggatggaatgttctgtaaatgtcttttaggtccatttgatctagagtgtagcttaactctgatgtt

SEQ ID NO: 1668 - DNA, 1030 bp, Homo sapiens
aaaatagagctactatatgatccagtaatcccactgctaggtacatacccaaaagaaagtaagtcgttataatgaagagatatctgcactccaatgtttattgcagcagtattcacaatagccaaatttggaagcaatctaagtgtccattaagagatgaatggataaagaaagtgtacctacacacaatggagtgatagaaaagaatgagatcctgtaatttgcaacaacatggatggaactggaggacatcatattaagtaaagtaagtgaggcagagaaagataatcttcacgtgttctcattcatttgtgagatctaaaaattaaaacaattgaactcaaggagatagaaagtagaatgatggttaccagaggctgggaagggtaatgaaaggtagggggtaagtggagatggttaatgggtacaaaaatatagttaaatagagtgaataagatttagtatttgatagcacaacagggcaactgcagtcgacagtaatttattgtacattgaaaaataagtaaaatagtataattggattgcatgtaacacaaatgatgaatgcttgaggtgatggatacctcatttattttgatatgattatcatacactgtatgtctgtatcaaaatatctcatgtatcccataaatatatgtatacctactatgtacccacaaaaattttaaaaacgattgtcccaaagaaaaacttagaaacctgtagttatcttgcaggaaaattgttgacttatatgtgagagaattggtcgaacaagttaaggaaaaatgtaaaaaacaaattttataaaggaaggagagaggacagagaaaaattgatgttccaagtgaatcttgttagcatctttttgggtaaactgattttctctcaacaaaaaggagcatctggtaattttatccttgagtgggcagggatatgaaagaaaacagttccagttgtttatgggttcttcagaaaacttgagaatttagctctctaaacgtctggctaaaactactttaaggtctgt

SEQ ID NO: 1669 - DNA, 1030 bp, Homo sapiens
aggaagcttcatgatgatgcgaccctgagtgcctagagccatctcctgattgttccttgtcatatgtttttctgcttgcacttctggatcctgactgcccacgggaggcatcagaccttccctgggatgtggtgtggctgtgatgagaccctgagtgtccagacctatctaccgattgctcttggtgggacccctgtcttcctcctctgcttggccccgggtgtccacgaatggtgtcctgaccctcttgggatgctgagtgcctggagctgtcttgtgcctgatcataatgggatccttgtcttcctccagtgctgggcgcagactgtccatgggtggactcagactgttcatgagtgctcacctggtagaggaaagaccctgaacgtccagagctttcccctgactggccacgtgcggactctttgtggctctgctgatggggcccagcttttccctgtgctgacactgactgtgtgtctgagtcttctgaatgtccctcactgtcactggcctgactaccactgtaccctcggtgtccactgtctctgactgcagatgaagcttgtccatgcccaatgcctgagtgtctggagctgtctgctgactggagctggtggtgggatccatgtctttctcctgcacttgatcttgcctgttcatgggatgacgcagcctgtccacgagaggaagactctgtgtgacgagtgcctgattgtctggagctgtctgcagagtgcccgtgaccggctctgtcttcgtgatgggacccagggtgtctggagccatctcttgactgctcccaagcagatccaagatggtttctggaagcagacccagaccacctctcagagtcttctgagtgtccctgactgtcactgtcctggctaacactggatccctggttcctgcttgtcctgggccctgatgattgtccctggcccacctgcgagtgtctagagctgtcggcccgagaggaagcttcatggtgacgcgaccctgagtgcctggagccgtctcctgattgttt

SEQ ID NO: 1670 - DNA, 1043 bp, Homo sapiens
accagtagaaactcagctttgtccaaaacctggaaaatgataggcattcaatcaatgttagtttcttccaaaatttggcctcatattcctcactttttatctttttttctcacctagagggtccaaggcctagaatgcttattaaagaccttgcaaaaaataatagagttacactttttaaaggtcttactagaattttctatagccatggttctcaatatgtagtcttggggtgcatgtgaagtaaaaactactttcatcataatactaagatattatttgtctttttaattttcattctcttacaagtatccagtagagttttctagatgtgtgatgtcacaacagctggaaggcagaactaggtactataatccagttgtcttctattaagctagacatcaatgagattttcaaaagtgtaaaacaatgccactcttctcattaattgttttctaaaaatagttacattttaataaaaatatggtatgttaatatgtaatggacttgttaaatgaataaatactttaaaaacttctcagttttagtttctaatatggaaaatattggtagacataatccccataaacaaaagctcttcatgtttctcagtaatttttaagagcaaaaaggggacttgaggcagaaatcctcaagaatcacttctgctgattctactgagaattacttctctgtagaaataattgttcattaaatggataaaaaatacggagaaaactatggtttaccttcatcctggacattgtcatcatgctcaatctcttgtttttatgaataacttttaacttttttctctaagtgaaatggacttttttgcaatcatattttttagctagaaggctgacaagagccaaattcataatagaaaactgatcctatatgccagaaatgctgaccaaagcttggagatctgccacacaaaataattccatttgggagtttttcataaaaatgcttggatctccaccccagttagatcttctttttaactgtactctctgatcgtgttaacactttgcctc

SEQ ID NO: 1671 - DNA, 1060 bp, Homo sapiens
taaaaccttgttataaactctatagtactatatgaattaatattatcacccttattgttattttgttaaaattcccacaatctttgattttttttgacttcacaattcttttttctccacttatgtaatatttatggtcccacacatatgatttagcttctagccttagattgatttaattatttaaaacgtgaaatgttttgtcaacctaactggactttaatttgagagacaagaaactagaattctatattgtattccttaaattcttcctaataaatgattttattcttttgttcattcaatgaacagatcagtctacgcaaatgtgtttgggtgcaatgtacctggcaatttcatggggcagtcgggaggacagtgtggctgaagcacagtgagtgagagggtgagtacttaaaacgtgtggtccagatccttaggccttctgatttgggcttttaccttaagggaggtggagagtcactgtcaggattagaataggggagtgctctgatttccttttcaaaagttccactctaccctcatgttgagaatagactgagaagggtcaagagaagaattgcagagatcaattatgaagctttgcaataatgcatacaagagatgatttgctaaatatatagttatgatcaaatttattcttatttacataaagaaagatagtaggaaaaatcttctgttaaagcatatgttcttaggctttgaaaatatggtcattttaccacatcacctacatatctaacatggtagatatataataaatgctgaagcgatgattattagttgctagatttgaaatcttgtattaaggggattaaaagttgtacaatccttctcaaagagtctaagatcatctagttttgctctttgggcctgttggtagggacacacctgggaccttttccagctggaagttttcattgtgatatggtcaagtcatgtgacataactgcctagggctgctgtagcacaaatgccttccccgcgttctagttttgctatgttgcatgttactaacaccagtcatgagcactcggct

SEQ ID NO: 1672 - DNA, 1057 bp, Homo sapiens
cactggacgtggcggccattttgttttggacaccgagcaggagctggcggccgctgcagacgaaaggcaggaaagggcaggccgggtgagcagacggatcggccgactagacagccaaccagcaacaacgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcggtgagtttcggtagtgagaaggagccgggggaggtgcggtcttgaggagcggaaggggccggcggacgcggaaagggggtggtggcatgtggacatagctacggtgttggagcgtggaggccccggggaggaggcggagcccctgcgaaggggcgggggaggggctgaactggaacctggtggcgggattgatggaggttggggtttgataggataaaaaggaaacttggcgggtagagcagaagtggaagtcttgacagggctttgaggatggtagggagattaagaagtacaagactttgaggaatgttggaaattaatggcggctttagggttaagttttgtggagggctctttgcgagctaattcccaggtgaatttagaaaacctttcctactcccccagatcgtcagtttcttgttaaagtccctacttgattctggagttgaaagccacttttgaaactaggcatgcatatatatatgtatatatatacatacatatatatatatatttttttttggggggggacggagtttcgctcttgttgcccaggctggagtgcaatggcacgatctcagctcactacaacttccgcctcccgggttcaagcgattctcctgcctcagcctccggagtagctgggattacagccatgcgccaccacgcccggctaattttgtatttttagtagagacatttctccatgatggtcaagctggtctcgaactcccaacctcaggtgatccgcccgcctcggcctcccaaagt

SEQ ID NO: 1673 - DNA, 1580 bp, Homo sapiens
tgagatgtagtcttaatggttttcttttgagaacagattcttaaaaataccctatctctgtagtgtgtccttgttcttatatatggccctgagttttgtgatcacctgaataattctaacatacgtttggctggctgactgtggagatacatttgagttacatgtttatttttaatttaaggtcatcattgttttaaaggagctgtttgcaagtgcaggcatggaattagggatttttaagaaatgtaaggaaaggagatttgactttcttgtgtttatttacatcttaaggtaaaaagtggaccgtctggaaatagattctcagaggaaaaatggagcacacgggcctttttgagaaatcaatcttgttcttaagtcacaagaactcaagtgaacttgtaatttaagttttgcccagagtgtgatgaacttcctatggtgtttgagtaagcctttgaagacagtggtagtccatgggcaggtatgaatcaagtcatataattgtcaacctgtagttcaaaagcagtacaatccaggattgaactatagaatgttcttacgaaaacttaagtttcaactggcagtgtatgacttctgtagccaaactagtgaggtaatttgtggagatgcccatttcatgggaccacacttgagcttcttggagtttctgctctggatcaaaattctgctgcttgtataacatgttctgaggcaaaggcttgcttctggtttgggatccttttgacacccacaacaggtttatctcccttcacaccagcatctcacttgcttctttttctctgcactttgagttgccaaatcctgttggattgcttttttgatctcaatcccctaacaccttttcttccagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcagtgctgtgtaccctgataattgtcgggccctactcccttcccttttctcttgggctgcttatggacacgtttgtttaacatctttaagcctgaatttgtattaatataataacttctgaaatcacatatttttaatagtgctgcatgtcttttatcaataccattccttttctgataatgtgcaatggtgagaggctatgacctgcgtaacaacaggtaattcatgtcatctccattccattttaaaacaccctgctgttgcttgaatcaaagcacattcaagttctagaaacaagtcaaacataagaaatttataggtcttttggcctatatctctttgttcctggtgctagtaaaacactgatacagctggaaaaagaggacaagttgacccacagcacttacctatatatgttcatttggggcactattactctgttccctgtatagttcttgttccctagaagaatctgttgagatcaggaaccatagcatttatttttaaatttaccataatg

SEQ ID NO: 1674 - DNA, 1048 bp, Homo sapiens
cacagcttcaagtcataggcaggcttctttgtttgtcttgttttgttatttgaaactggcttatttttcaaattaccatgctggtagtgcaaaagtctcatgatttttccaagaatcaatcaagtgcatattatagagccagattatatgccatcttcctccaagctcttgcaaatttaaattgtatagttgaaaataccccccaaaatggtcagtttagggttttgcctttctctgcccctgtcccaccaccatcaccaccacataccaccctgtagctccaaatcctggtttgagtcacatgagaatatagaagagagagagagatacaaagatgaagtagagttaagagggtggtgagacttggagctgggcattggctctgaaaccaaataaattcaatgtcacatttggtgcctgtggagaaccagagatgactttttttgcttaaggtagagagcaagatggaattattatcagttaactaactggctcttattgataatcttgcctttgaaatttattgatgtttgtcttgtgacctcatgacccagattgggaaagagtttaatgatgttgctgctgttaatactaaatctcatgggagccttctggtttagagcttagtggaaaactcccaacacctgtccagaaaaaaaacactattgaagcccctgtgtatatttgctttggttctcttaaaaggtgtcttgggtcttccataacttatgaccttgaagttgccaaggaataataactgttaggaaagaaaagttgataaccaagggcttgttttcttctctcccattatatgatacttactgagtgaagtgcaagctagtttgggtttcaggatgaaataacatgtttccaaattatcttgacttggatcctgagagacatcacgagggtgggagagactaaaatagcttttcaaaaagctgagtttgttttgttaactgaattcacactgcttctcagataaccacaattgtcagttgtcataaggtaactagaattaaaggtagaaatagctaggacaactcaa

SEQ ID NO: 1675 - DNA, 1971 bp, Homo sapiens
atttaagtttaagggattagagggcaaggggtccactgtgggtggggtgaggaccttatcctcagcttgctggctgatcacaaactttacttctcacagtgttaccgggacttagctctggtgagtcgtgatggcatgaatattgtcctgaataaaatcaaccagatacttatggagaagtacctgaagctgcaggatacctgccgtactcaggtaaggccagaaagaaaagacaagatccagctcaaagagagaggatggatcttctctctgtcaggaacgggaaagaggaatcagggctaacacacccctatcattgtgtgtctaaattgtaatgtgctcctttcagttgtaattgaattagctcccttctcaaactcacagttcctgctcttcatctgtttttccctctttcctttagttggtgtggttggtacgggaactggtgaagagtggggttctgggagccgatggtgtttgtatgacgtttatgaagcagattgcaggtgagtttgatggcaggagcataaagaagaaaggaggagagcccagagactacatagagacaatggagaatgattaagtgccaaagggatggaattcttggattgcttagactgtttccttctgatacagacatcttctggccacatatgttgtagaaataaattgattgaaaaatcatggggggccttttaaagcagtaagtcttgcctcattttctttcctgctaaacccagggcttgacagaatatttggcctattttagccagtcttcactctgagattttatagcatttcagagcaggaagaaatggggagagaagtgagggcaattaatttgttctcaagtccctgtgctttcagaaacctagacatcttccctggctccacccccattatctgaacgcttgctccctaataattaagccctttactggggccagaatgagggacaaactatgtcacagaacagaccctgacatttaggttttattctcatcttggcatcggtgacatctgtctgagctatcgcatattcaagcggctactcccaagattgcatgtgtttgtttaaaagtgacctgctactacctcaccattagcccactgggacttgcttcctctttaaaattttatgtaacactgatgctcctgttttgatgtgtatgaaccttaatctatgtgatatgtgactttgtgaacattgaattttttaattgagacctggggcaaggcatagttgtagctatttttatcctctttcctggcacttcttccctgtttggcacttccagcccctgcttcttatcccaagactggtatggcattgctgtgtgttaattctgccccacagagtttcatagcaagcactaaagactgttacctggaaataagaaactcttggcctgttgggggcctcagtgcaggactcaggacatccagttgctagactgcagctgttgtcagccacctgtacttctcaggctctatctgagatatcatcctttctttccaactgtgggcttcttatatctacttctcagacgttcattttcaagggccaaaatgttcccactccaactcacaatctgtgggaaagtagcagctctggtttctagaaaaattcagaaccttccctttccttctttctggaggcaaagggtgaaactttaaagcctgacagaacagaaggcagtttatctcagcagtgaagggatggcagtaatgggatggcagtcagggtggaccagcagaatgggtgaagagatgtattggattggctgacttgctaatcggagctattctttttttccccttttgaaatcaggtggagatgttacagccaaaaatatctggttggcagaaagtgttctggatatcctgacagagcaaaggtagcatccaccacgaagggtggggtacaggccagataatggccattaggagtgtgggtgtgggaaatgggga

SEQ ID NO: 1676 - DNA, 1049 bp, Homo sapiens
tgaatcaagaaggtagaggttggtgggtaggagagtctttggtggtcagatttaggaagcctgggacagggcaagctttgccaagtacaactgcgaatggcagaggtacagaacaattcatgtagttcctagacagcccctacttggcagactccagctgccacattactactaagaaaaaagtgagacagataactgtagtcctcctcccctcttcctggcagctccttggctcaggaggtgagccagtggccagtgttcagcttcacggagtctagcaggggagtcagaggtcaactcgtgagactgagtcagtagagggctggaattagtcctgtaagagaaggcccctccctgggaacagtcttgcctcgaattccaaggatccagcttgggcaaaatccactttggaggagggagtctccgtgtgcctcctcccgacaaggtcctttttatatccctttccctttcccagggtcctgctatgttctgaacaataactgtacagctttgctccccaccccacctcaacacacacgtgcttgtgatcgtgcatgcacccgctcccctcctacacacacacacacacacacacacacactcactctgaaggcagttgtccaggacctgggaagtcaggaaagaagaaagtgctggaaattgtagtactcttatattgaacatctatttcattgctttaagtgcctccactgtgttagacaaacatgtgttacctcatttaatcttctggacagccctgtgagtattttagtttctacatttatacataaagaaactgaggtttgaggccgggcgcggtggctcacacctgtaatcccagcactttgggaggccgaggcgggcggatcacggggtcaagagttcaagaccatcctgggcaacatgatgaaaccctgtctatactaaaaatgcaaaaattagctgggcatggtggcacatgcctgtattcccagctactcgggaggctgaggcaagagaatcgcttgaacccaggaggtggagtttgcagtaagccgagatcgcgccac

SEQ ID NO: 1677 - DNA, 1032 bp, Homo sapiens
ctgtagtggagactcactttcatttcccctggttcactcacactctaggaactgggacataacaggtatcggccctttctcctcttggtagaagttcccaggaagagggaaataaggacccagggcatgacaggaggaactgtgatctcagccgagtactggagggaggaggggtgcagatcctggacacagggtactttcctcccccttctctagatgaggccctgcctaccccacacacctccagacataaactctctacaccacctctttggccaaaggtcagcacaggttggacttctttgctgccagggatgcaaatatttattctaccactgctcccacacagaatcagccaccatggccagtcctctcagctctggctttatctctagtagttccccattcctttctgtacacacatgctttgggaagtatcagagaaaacccacacccctgatggtgtgcacacataaataacaaaacttgggggcttcaagttcttgaagtcttccagcatcatagctgttggatctctgtttaggggtttattttagggcctgtgtctggctgacccagtcaaaccttgagatgtaataaggaaggagagtgggctatgggataaaagctgaggagcccatccaggactcttcccctctctttttccatttagtttccagatgaaaccttgaggagcggagagctgctgaacatgatcgtggctgttattgactctgcacaggtgaacattgagctctgacctccccagaagatctgggaggcagcattagggacatagggcctctgctctccctccaggcctgcagacagggagcccatgcctcccaggcaccctccctcctggctacagtggtgtgcgctttcagccatggggcctgggaaggaaaagtggaacacaagcaaggcaggctgaggttaggccaatcctgcctggagttccccttattctccatattctttgggcactcctgttccacagcaaaagctgagggggttgtgattttagctctc

SEQ ID NO: 1678 - DNA, 1031 bp, Homo sapiens
cagaactgcggtcactattttgtaataaatgtggctggagctgatccagctgtctctgacctacagtatctgtcattatctctctgtggaactgctttttccttgagagttttctcctggcgtggagccacaggccccacattcctgccctgactggctgtgggccagagccccgtatctggaccttggtgttttcctctcaggagaccctgtgtgaccttcgtccttggagaacctctggtgactgatgtttgtctgtgctcctgtgtagctcgccccagttttactctccgagtgccaggctcccactgctctgtcttgggaactggaggacccgaggggtcggctcaaagggcagaggtggacagaagcacacagaaatgccacctccggcagccagcccaaactgctcccccagaatcaggtgtggccgggcctggggaagagtcttaaccagcccaaacaagtgtttgactgtgggggaaaggatgctcaagatatccctctgcctcgcagctgtctctgagaagccaatctttgagggggaagagtggggtgcccctgcctccagatgttcctactcctacctggtgactgtcagacattcccagaaggagcagtccccaggggggaccctccggtactgcaggagagtttgacggaagcccctccatggagtgaggctcagagtgcatgtggtggcaggagggatggtgggaatcaaaaggacaaaggcctctcgatccccaaatgaggtgtccagaaagttcatcatctaaaagcttgaaatgatgaagctcctgcttctcctaggaactacagtccccctctgttttgagctgtgggtccttgaaattttatgctactttgcctttccccttctagcccctctccccaacatgagaggtcaggggacatgccctactggcacacttgggtctctattgcgggccctcctgttccaaaactttacaacttgcccccttccaccagcaagcccggtgcagcctcactgacagactaggtaaggc

SEQ ID NO: 1679 - DNA, 2234 bp, Homo sapiens
ttttaccctccctcttttctcccctgcccccgccgtatcccctccctcggtaggcccccccacaccgtgtgttcccccactgtacacccccccccgagtcatgcgagccctggcgccccccacctcgagtcggcccccggaggttttgtttatggttgggttcgcggcctagtgggccgcgccagagccggggcctcgatttgggagcgtggccggggcggggcttggagcagccgtaggaagggggggccatgcggctagagcctgagaggggagagcgagaaagagcgcgagcgagcgaggcctgggccttgcctgaggtagggctctctcttcaccccggccggtgcctgcggaggagagggcctcctccctttccacccactgcgggcctcctctgatccggatccggcctggtttgggggtggcgtgggggagggagggcgatggggtggagctcccccaaactcccccatgtggccctcagtttggtgtgcgaaggattaatttgttccggctgggaggtagggaggagattggccccgtgggctctcgatgtggcgctgaggggggtgagcctcccatcctccacccgtgggcttgcgtcccctctccgtttccaggctctttgtcagctcctcttattaccctcccttctttctcaccaacccagttcttggaatatgtttttgctgctgtctttagcttcctgtttatactgtagtttgggtaccccaaacaattgtgttatttgggaagctggacatggaggcccccatagggtgtatttacgcttaagggacgtcactagagcactggggtatttgttcactcttctcataatggtacaggaatgcccagtttcttcaaacccttaaccttgtggacagcccttaaattgctttgcaaactgatgtcacaaactggagactgctccttttccaccattcttgaaatgtagccacctctggtgtaggatgttgtggaaagaaaaacaccacagtaacaggcgtttttgttattattgttaacgtttttgcctttgactctccctgattattaaatggagaaatcctttttttttgtcttctctcccatcctaccttcctccgccgcatatcctgttttggggatacctgatgtgacttgctgggaggtgatggacattactagtaaccagcgtttctagagaattaaaacattttggctgtgtatcagttgataaaactgctttgagatctgtctccattgtacttaaagattagactatcccaatgattacagagaattaaaacattttggctgtgtatcagttgataaaactgctttgagatctgacaccattgtccttaaagattagactatctcaatgattgtttcctttgtgaatgggaaatattgctggcacataaactagtgatgaaaggcctaaaaatgtcctgttttgtttttcatctttaaagctcctccttgctatgtcctaactgggaagtactcttactaactagatatcaaggtggtggggaaggggatgcaggggccatttcaacaaagcatctacagaaattagttgttctgttagaggtagcaaattttacccaactcagtctagcttcagtttctgaattgtttcttaaattagattgtaagctccctgagggcagctactaagtcatactgcttttgtattttcctgaagtattggacacatagtagattctcaataaatatttgttatttagttttttcagtgaaatttctctggctatttttttaagtagctagttttcaaaaaagagtcaagggcactcctgtgttgaaacctctgtttactctcgcacgatttccttggtctccaatacttctcaccctacttcctttaaatctttttattttctaagaaagagcaagtaagtaacaagattcttcatctccagtgtgatagctgggaatgggtctgcttgctactaattctgtgccctcaagtgatccattccagatcacttacttttgacctgttgctcagtgttgtcactactaggtggtaaaaattttcttagtcacatttcgaagcacttgtaagagggaaatgttactagcaagagtgattaggagaatttttttctttcttggttaattatatctttcaagatgactttttaatatgtttacatctgactggtacagtatatgcaatagtgtatagctagtcatgcagtttatacctgcaatat

SEQ ID NO: 1680 - DNA, 1028 bp, Homo sapiens
tacataaaaaaggttgtaaggcaggtaaggctgttttcttaggtgattgaatacagtatttaaaattatttctctggagtgtagactaatctccttcctggaaggtttttgtttccagactttactgattatctttccttctgtcaaaggtacttcagatacttgcatctatgtaaaaggcttttgattattagttaaatgtaaagtctgcttatgggggactagtaaccaaactgctgtaacttcttaaaaaaatccatcacttacacatgctttatacatttcttgttacataaaaatggattaacagccatagctccttaaggaatttatcaagctaattatgttgtaagaataaatgaatcttattgatttgttcctttgaagaagtgaaagtgtttggtggtgaaggtgctgatgagagagttaaaaacatattttgcccacatttaatacctaattttcttttaaatctttcagtattctaccttgtaaatactgttatttgtatatactgtaaatgatgacatcggtgggcactaaccgagcccggggaaactgggaacaacctcaaaaccaaaaccagacacagcacaagcagcggccacaggtaaataatccaaggcatacggattcatggatagcgttgcctgctgatactggtttccatgcagtacagcatcattctgtgctttgaactgttggtttaggttccttatttttgttttctagtccttggctctttttttacttaggtcctgataactgttcatgacatgctgtaaggcaagatgcttacttttttgttgtttaatactgtattatgaggcttagcactttattatgggtcctgtgctttttatcttttttttttttgttttgttttaagataggagctccctttgcctaggtcaaagtgcagtggcacagtcaccattcatttgtagcctcaacctctggggcttaagtgatcctcccgcctcagcctcctgagtagctgggactaccagtgcacactaccatgccag

SEQ ID NO: 1681 - DNA, 1053 bp, Homo sapiens
agacagtgtttcactatgttgcccagggtggtcttgaactcctgagctcaggcaatcctcctgcctcggccttccaaaatgttaggattacaggcgtgagccatgaaacctggcctcagatacaacagctttctgatactacagagtcactccagctaaatgcaggaggtttgtcaatttctttgagacaatgggaaataataatggaaaacttttaaaaacaattgaatttaaattggtgggttttttcttcaaaagtgttatcctggattaaattttacactgttgaccttatttgaatatttactatctggccaatcaagatatgcttttgatttgttttgggtttactctagaataattgtctccagattttatggggggaatcaggtggggctatttatgtttttttaaaagtctgaatgttttttcgcaaatcacattttatcttaccttccagcatcttctgtctagtgctataaggctgatgttatacagtatcaaaaaggaaaataagctggagaatataggtttatgttacgaataaactagctactagtgaaaccaatgggaagcaaagtcagctcccagggatattggatgtatttgggtgggtgagatcatttcagaaaactgaagtcgcctttgggaagataatagtaattctttctcctgacccatcttgtgccagcaacagatgtgcatacagaggagggagaaaggttacagtttcctgaaacttgccaggttttgagatagcagcataaattctaaaagctgttttgagtctagcttccagagtgttcctggtgtatatttagctacagggttgttctaacttactgtgagcataaaatgacccactaactgtaatgtataataggcttgggttggaagagtaggcagcaacaaactaccaagtcttgggtaggtaatctttttaaaacaaatgaattaagagatggggtcttgccctgtcacccaggctggagtgcagtagcatgatcactgcagccatggacacctgggttcaagcaatcctcccacctcagc

SEQ ID NO: 1682 - DNA, 1083 bp, Homo sapiens
gaaaagttaatccctgcatttgcttacctaagtttgatgccttaatagtggaaggactagatgtcacaaagtcaaatattaaggcaaaaataacatctagttaaaacgatctcccataaaaaccttaattcagcagcacttgggcccttactgctcaaaagctaaaaatgaacttcttttatttatttcttcatcttggttatgatctttctttgggaggggtggggctgtgaagggagtagtagaagacaaatgtggtttgggaagaggtgggagttgggaactgtaatgggaaaatatagagggattttctttcttttatttttttttttttatgtctagcatgcctgtaagttcagtatgcatatgatcatgtgactccactatattttattgggttccttgcttctactctttctttggctaaaactattgagcatatattgaagggcttgaaagtcaatccattcaggattcctcagggtagatagttttctctttatagggctttcactttttcttgatgttgaattccccttacctatgccaagtttctgactgtagcatccctgacaccaagagtgactaatccctctgttttccagctttctgagaccaagatcttcactgcctctaatgtgtcttcagtgcctctgcctgcggagaatgtgacaatcactgctggtcagaggcaagtgtgcagtaaaatttagtaccatttcttaaacacatctgctgagattactgtaaagagaagtggcactggcctttgtaaactcccatggtgtcaataataataaccaaattacattacatcattacattcctcttaagttgatggagagacttctttttttttttgtttttgagacagagtctcactgtatcggccaggctggagtgcagtggcacgatttcggctcactgcaacctctgcctcctgggctcaagcaattctcctgcctcagtctcccgagtagctgggattacaggcgtgtgccaccacgcctggctaatttttgtatttttagtagagacggtgtttcaccatgttggccaggctggtctcgaactcctgacctc

SEQ ID NO: 1683 - DNA, 1050 bp, Homo sapiens
acacatacacagttccttccaaagacagtcaggtttttggcaggtgaagcatcctctttgtcttcttaagcagacttggttgtagaaatgtttgagttgggtaatagggggtagctctaagagaggacttagttctggacagactgaatattcttataagaataagttaacattatttattgactactcattgtgctgaatgaacaccatttgccattactcttgagagaaaatcaatgacataaacttgtcaatacattttaatccttttgcagccctcattaaactatgatgggagattgtagcagttccccatttcttgatggatcagaattgtcttgtatatttacttaaaccaggtatttgtagacaaggcctccagaaacctatggtcttcccatttctgccacttactagctgtgtctccatttctatgtaaatagggataaaagtgctagtccttcccatcttcccaaaggtggctatacaagtgtggtttcagtagtgatattataaataacttagaacttatgacatattacttgttgactcagagcatttaaaacatccaaggtcattaacgacatcaaaggaatcatttaaactaaacaaagatgctacaagtaccagttttctcatagtcattgagtcctgagaagtactgctttttctttttttctctttttctctcctattttttgatggagggatactaaagttgtaagcagaccatgtgtgtgcatataattttatttttccagttagagtaattagtttaactagaaaactgccaagctagctactaattcagaactcggtcagtttttaattgttgtcttaaaatgttttttgtgtgtgttaagttagtaatttggtggtcgatgtcctgccacataggaaaggtaacaggtgagaagaggtgggaggagaagggaaatggagagaagtgttgggattaaatagaaaaagaagaaagaaaataggacaaaggttgtaagaaggtgtaatgaagatcaagaagtaactaccaacccttaaagataaatgact

SEQ ID NO: 1684 - DNA, 1088 bp, Homo sapiens
ggtggcgggtgcctgtagtcccagctactcgggaggctgaggcaggagaatggtgtgaacctgggaggcggagcttgcagtgagccgagatagcaccactgcactccagcctgggtgacagagcgagactctgtctcaaaaacaaaaacaaaaacaaaaattctccagtcagccaaattttatccctgagaagcagggagaaggaagtaatgatgatatgaagttttaatggctctgtttttttagtgattactatgtgccatacatgtattaagtgctttaatttatttaatcctcctacagctttacttttattcctatttccagatgaggaaagagagattaaaaaatagtttttccaagcttacatagccaggatttcaatctaagacagtctgactctaggtcctatactctagtggactatgctgtatactcagtgtgacagtattctttacttgcctgatctatactggctctcggtctggataagtgtctttatgagtagctgaacaaggttactggctgtaggtttctctcatctctttgttgatctacaggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatggtgagaagatggaaagtgacttgaatctttaaagcattggagcattactgtcaagaggctagcagggggagggggtggagaatgtgtcctgaagtgaagaaaaggggcagctagttggttaccttcccacatgtatttcccctaatcaaataagctgaattcaagaagttggggaataataaaatttgaggctatgtatttctcatcacatttagaggctgggcatggtagcttacacctgtaatcctagcactttgggaggttgaagtgggaggacagcctgagccttaggagttcaagaacagcctgagcaacatatcaagactcca

SEQ ID NO: 1685 - DNA, 1032 bp, Homo sapiens
ctatagacattcccttttttctgatgagaggaattcctttcttctaaatttctaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcaggtgatttggggtgaggatggaggttggggttggtgaatagcaataacagagctctctggtccttattactcccttgacctggcagagaccacattagccctgcttttgtcgtaagtgggtgacctaagaactgtgggaagtgaagacagaggaggcttgttttaattttcccctttcaacatccacttttgctttaactgctctctacccctggctggccattgtgcttaacatatgatctcagacctccttggtgtcccatattatgtcttatttccttgttatgttcttgactgaagctccaggtcacgtaactatagcactatggctgatggcagcctctttttttctgacagcacgttatctacgcagcagaataccctttcatcatcaacatcttctgggcgcacttcgacatccactcttttggtaagtgtgatgctgagagggatgtgtggttttcttacacttagaactgtccaactgtaagattgtcccaagagagaattattgaaaatttcttcatgaggtggcaaaataattgatttgaggttgcaggaaaaggagtaaagggatgttaggaagccaagagaggcagaagaatccctaaacattgagctctgggtcattcctaaaagccctgaaagtgactttctgatttttttcccctactgaatatatagttgggctttgtatgctttaataaattctggaagaacatacctttccaactggtagagctgttctctttccttggtcttgggtatgcccaagttctgaaaagaatcagtgcaaggctgga

SEQ ID NO: 1686 - DNA, 2479 bp, Homo sapiens
acagcttctgggcctcagaagccaaaggccagaatgttcatctggaatcctttttggtttcttagataattatgactattattttattttttgaggcagatcttgctcttttacccaggttggagtacagtggaacgatcatagctagctcactgcagccttgaactcctgggctcaagcaatcctctcacctcagactccccaagtagctaggactacaggtgtgcatccccatgcctggctaagttttaaaaatttttttagagacagggtcttcctatgttgcctaggctggtctcaaaatcccaggttcagacagtcctcctgcctcagcctctcaaataactggggttatatataggcctgagccactactcctggccccaagaattattttctctgatttgattaaatccctaactctgagtgtgtttgctggtctggcctggttagaggaaagtttcctgactcaatctgggactttgagaataagtggctgacattagtagctttttgccctagtgtatcttctgtgaccttcaagtatttggtacctattaagatgaaggatatatggaaacgttttagaagatacctgttcctgccctcatagacaaagtctagataaatttcataccgatgacacatccaaataacacagttacacatttttaatttgtggtcactaccttaaaaccctgacattggagaaaagtgaagtattctttccagaggagattatttttaagccagattttgaagagtataagagacagagacttgtagaatagagagtaaaactggttgttcgtgtatgttttgtgtctactctattggtatcaagaagccagcctactagaatcagtagtatttagctcaaggaaagcttcaagacctttcatgaatcatttaatctctgtgtactttactgctttttccttaaataaaattgaaggaaataatccgtgtcctgttctaacccagaatgaggatgaatgttctgttgaattagcttgtctcttggctccttgttttgctaacatcatgaccagttcctgttattgctatatgtctgtatctttcagccacaagtatatggttatgatgacttgcagatgcttcagacaagatttccattggtgagtatgtgggatagagctttggaaaagaaagtagtcttaaaattagtgttgggagaattatctccgtcacagacatagctctttcccatcccagccctccatacactctgatttaaggcatattagaatatagggatttgggggagggtttccaacagaagataacttttttttttgagacagagtctttctctgtcgctcaagctggagtgcagtggtgtgatcttggctcattgcaacctccgccgcctgggttaaagcaattgtctgcctcagccttccgagtagctgggattaaaggtgcccaccaccacccccagctaattttttttgtatttttagtagaggcggggtttcaccatcttggccaagctggtcttgaactcctgaccttatgatccacccgcctctgcctccctaagtgctgagcttataggcatgagccgccgcacccagccttttttttttctttttttaaatcagagttgtggcatcttagtaaatacattttaacctattctatagcccagtaaagtactctggagcactcagggtgctttctgtttgtcccagacactttaaattatcgaatgatctgttttctcagtagaataagcttggtataaactgatagggatgacacctagagggttgaaaatattggtcctcgtggactttgatgtattctcaagtgggcatacccgtagaccttgtctgactgtgctcatggccaggcaggggggacagtgtatgcaagagtaatgtggagtttgtgctaactctagccagcttaattagtgactggataaattgcacaactctcacattcttctgttttttcctccgtggaaatagtactcatgctggggaatgagtgacattgaatctctgctcttttttcccctcttttctaggattactacagcatcccatttcccacacccactactccgctgactgggagggatggtagcctggccagcaacccttattctggtaggattgggatgggactaaataaataaaaagggagatagtgttgggattgatggcagacacctgattggtagcaagaagggatgtgataaatcaggattggtagattcaaaatcctgctaaagttgggcatgtcatggcttttcctattcatcccactttgtgttgtctccctgtgatttctagatgatatcttagccaggcatggtagcacacacttgtagtctcagctacttgggaggccaaggtgggagaattgcttgagcccaggagttcaagaccagcctgggcaacatagcaagaccccatctccaaaaaaagtgatatcttgacttagtttc

SEQ ID NO: 1687 - DNA, 1498 bp, Homo sapiens
tggatacaacactggtaagctgaccttgtctctggctcggtgttatctgtggggtgttattggataaatttcagggaggaagacttggtgcttgagaaaatgggattggtgagggtgtgccgctgccccaggtatgattgttaatgcttggctgacttgggtatctgtgggagcagcaccaacagaggagcttgatactaggacatgtgtccactatttgtgacgggaatgcccaagagtatgtgttggtttttagaatatgttggttggccaaaagtgtgggtggaagtagggcaaggagccccaagattttgctgaaatgtcagtggaggcaagtgttaatagtatgtatggcactgatagtacaaaaggggggtgtattcactgagtagaaggattaaatgggttcatagctagcagcctacgataggtttggcttaaatcactttgtagcactacttttcttatgtgtccttttttattccctagctagaagacctaaactgtggagaaaaaggagtaggcgtgaccatacttaatagagtgggaattggactgggagagttgggcctttaggttccttcatttgtatggctggtctctttgcaagtctttttgcatatgtgatggcagggagggaattgtaggaatcctctggatgggtacttacctaaaagatactcagcctctcccttgcttccatacctgacatctgtgctctacttttggaggacagggagtgagaaggaatctttgaataatataattgtaccttttcagcgacttgtagatgaataggggaggagtaggtttctctgattgcttagggttggggatgggggttgtccttcaaagctgtcagctcagttacagtttcatggtgatttggatagagcagcatgtgtttttcacccttatgtgggctctgggtgggtcagttgcccacagttttcaataattgggaagagcacagaaggcagtaagggctaggaactgatagccaagtggagctttgaactgtgctgcatgagttagagtgggtcatgagttaaattaaacaaatcctgagaagccccattgagatttaatacatagactccttgtggccacccctgtcattgagcaaggttcaccctaaatcttggtggggaggattataagccttttgacttggagtggtggcccctttctgaggacattaggttgaagtcttagttggaccaggttcacgaattttaagaggtaggtgatggataatataagagaattggcatacctgattctagaaatcccaccttcttgcctcccttcagaattcagaaacgtattatatcagcccttgagaacccccagttcccaaccccacaaagggcttttgtcattccattcatttatttttatgtatttgattccttttaggaagaaaatatccacccccttacaagcatttctggacggctgagagctaatttggcccaaggctgggggctgtgttttg

SEQ ID NO: 1688 - DNA, 1068 bp, Homo sapiens
tgagtggcatttgggtggattgatttgaaatggacattaaaattaaaagtttattatattcctgctagactttggcacagaagtgttttgaaaacagtgtatgctagtgaggtttggtcatatccccttgcccaccaaaaaacaacttacctcactctctctcacgtatactcaacacgtacctgggaagggccaaagaacccttagggagcttttgtttcatgaactcttacctctcaggactaacttgaagctggaaaaccgaccaaaattcccttgcattggtatagctagaaaggctacagatatcacctcatctcaggaataagggccaggtagctagctgagctaatcctcctgtctgtttcctcctcccccaggtgtttcagtcacctccagtaacacgggcgtgccagatatctcgggttctgtgtactccaaaacccaggtaggtgcctggctctggataaaagtggaaaagagatagacatagaggaggtggagttgcaatggtagaaataacagtggacaagaagaaccctaggagaggtggcaggaaacccatcctactttttctaaatgaaaggtcttctctagacttcacttcctctaagaagttaaaatttagccctctgagaaaaaaaacgagaaacgtaataggaaggtaaagcgtggcaaattgtttatcgtgtcatgtaatttactgtgcaactctcctggccccttttcctacctactcccaacctttttcataacttttcaagagaataagtatgagagtgacaggaaactagttcattccattctttgagtaaatctataacagtgggagtgggaaaggagacgacctagtaactaatgaagcatttgagtgatccacaggtttgttatgttgcttttatcccccatcaccataaatacttaaagtttgctataaagcactgggggtctgggggggcacttcatgcacaagaccttcagcacttcaaatatctcagtatgtgtttatttcttttgaaatatccaacgagttttttttttttttttttttttgagatggagtcttgc

SEQ ID NO: 1689 - DNA, 2031 bp, Homo sapiens
cccttaaaactgccttccctttccttttcttacccttcctcaccaccaccttcacccaatccctccccagcgccagtcatgggcacacagcacatacagacacaagcgcacataacacgagcggccggcaaaggaaatctcagagaagggccgggttgaaaccttttttgcccaattcctttggtgcccttctcctcctgtgccacagttgtcctcatcccatcagacctgggtcacaccttccctctttcctctcccagccttccctcttccctgacattttagctttcccttctaatggtggagttctattgtcaaagtttgtccctttattttccatatatcctggttctgcctcagctaccatatttgcagatgattctctgttgccagcgccagcaggaggagcaggtaatgaaattgaatgatcatatgcttgaacccactccttttcagtccccatttcaccttcacagcctcagggaacttgaaaagactgcgcggtcacaaatcgggatacacaaacacaaacaccttgctgagctctctggcctccccttcctctctcctcctcccctccccaacaccctctttatctttgtacccttccccagctgtggaaaacattcggttaccagaatggaaaagattcttggggcagcatctggagcctgaggcctcagactgcctctcatacctgcctgaaatgggctcacagatgtgatgtgtggtaggggtggggatctgtggggcgatgcaagtggcctcttgagagctccattataggtggctggagctagaataagggcttccttcctcaaagacagctttccaaattgaggcattaatggggatcaatggaaatgaaattgccttgtgatcacccatctccaagagcaggggagagagggggtagtgtgagaatgtagaattgaaaatgagtagaactcactcactaccttgtctctaaaggtatcttgccctcttcatcttttccctatttaaaagtcaaaaatgccttcctgcttgtaagaaaggggctttagcagctatgcagaccaaattttctatggttctaatagtagtgaggggaatgggagagcaagacagtttgcacatctccacctgaagatgttacaaatttgtaccactaactagacacctttttcctcctcatgatcctcccattcccctgcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtcc

SEQ ID NO: 1690 - DNA, 1035 bp, Homo sapiens
ctcccctctgagcggctgcggctcctgcacctccccggggagccgccccgtcgatgccactaaggccaaggacatatagacggtctgccctcccccactcaaaccgggatcatgacggtccccaaggagatgcccgagaagtgggcccgggcccaggcgcctccctcttggagccgaaagaagccctcttgggggacaggtaacgggaggcagcgcctggcagctctcccgcacccattatttcccccctccaatccctacattcacttgtccccagcctccccctacctgccttgatcctctttccagacccagagatcctggctccgaaggatccagtccctaccttcttcgtttgcatggtctttggtgattgcgcaggggacttggcccaagagagcccctctagggaagtttatgggagtgaagtggcttggtaggcagggggcactgtggcctgggttttgttactgcagtgtgctctgcaggggtcctggggtgtgtagaaagggttctggaatgctgtctttggctcccggacaggcttaaggcattaggtttgctgcctaaccaagttacccctttttgcagcatgaggtcatggtgacccccggggagacgggctggggaatctattataggacagctccttgttctgggacatgaatttgatgcctgcagtcccagacctgcagaggtttcagataggtttagctagataggtgtcactaactgagtgacagatgagccctttaaagctaaatgtgtgcagatggtacaaggaaggtccagttagagagcaactgtttcaattacatttcattcctccctcctctatctctatctcagtctgcatgacccatatccctgaaacgcaccccccacacctttttctacttgaagatgagctttgaaataaggtgatgtcatttcgggccagtcagaagcagttgctggtgacatgtgacaaccagaggctcctgtaggggggactgcacatggggctgggatgctcccgcagagcagctccagggc

SEQ ID NO: 1691 - DNA, 1043 bp, Homo sapiens
ttggtagagacggctgtgaacatcggctattcctgcaagatgctgacggatgacatgactgaggttttcatagtcactggccatactgtcctggaggtgcgggaggagctcaggtaaacaagaagcccaggggaggcggtgctgtgcgttgtgcccagggctcaggtgggggtttctggaccatttagacttgaatccctgctccccactgccgttctggaagaccacaaccgtatcatttccacctcgacaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggtaggcatcgctatccttagcttgggcagtatctttccagtgagcacttctgtccagggcttttatatcttgttctaatttcccctgatttcagagaagactggtctcaaaggggactgggaggagctgagactcccaggtgtctcctggaaagactggctctctcaggtttctctgtgctccaggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaagtgagtgtgggctgtgcaggtgtgtaggctgggcttgaggctggggaggggcccactgaggtctctggactgcagaagaatgacgggaagggggttgtaacttggtaggctctaaagtgtgtggccggtggccatcttcaccctcttgtcatctcttgtctctgcagcggctcacattggtgtggggatcagtgggcaggaagggatccaggctgtcttggcctccgattactccttctcccagttcaagttcctgcagcgcctcctgctggtgca

SEQ ID NO: 1692 - DNA, 1027 bp, Homo sapiens
aagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagttatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaagtgtgtaatttgtctcttttctgatgtttaaccaagactggtggtgaaagtaaagacagaaactgtctcttaaatgtaattgagtgggtagatctgggatatcttggacaaattggaatctgactgg

SEQ ID NO: 1693 - DNA, 1053 bp, Homo sapiens
agcacccactgccctgggcccctgctggccccccctgggcactgacccttccctgcccactctgtctctctgcttcctcttccccctctgtgcctatctgcccctcctgccctctcagcaggctagtgctctcagcttcccggcccccccttccaggccgctgccgcctgaccctgtgtccaagagactccaggtaaatctgggccagggcccgccctgagccaaggcaggtgggaggcttggtacccaactgcagttctcatccctgctccctgccagtggtgctcttcattaggtgatcggggtgcccctcagccttcagacactctgagccccagaagcagcaaagggtgagcctcctgccttggtttctaccaccatctggtggtcaatggcgggactgcagtcggccagggactgcggttgacctacaccttcctcccctgagacatcagctggcatgcctccaagccctctgcgcatgccctcattctctcctgccccctggctgactttgcatgttgacttgaacccctctggggaatctctgtgcatgtccacagcccctggttatgctctcacagccactgcccctctctctgttcaggctgagctggctgaccgacccaatccccctacccgccctctgcccgctgacccggtggtgagaagcccgaaggtaacggtggggggagagaagggcacggcctctccccccacctagggctgtggtgctggtagccatgacggtggtggccgtggcgagatgccccctcagtgcatgagggcacatatcccggtggtgcctttaatggtgacaggtttgtttgcagacaagggtgaccgctggtgctgcccccaagctggtgttccccagcaccagtgcgttgggggtgggcaacatgacacccccccacctaagccggcctcctgccttctctccctcagtctcaggggccagccaagcccccacccccaaggaagccactgcctgccgacccccagggccggtgcccatcgggtgacctgcccggcccaggggctggaatcccg

SEQ ID NO: 1694 - DNA, 1026 bp, Homo sapiens
gcccgcgcgccgcgcggcgcccgaggcgcagctttgtgtgcggcgagaccctggggcaggcgctgggcggggtggggacatctgacgtcagcgcgcccgggagcgcgggccggggaggcggggagccccccaactcgcaggccggagaaaacacgagtagctaggtgggcggccccaaacctcaactcccggcattgccaagcaacagccattcagttcggttgctgggacacgcgtcaccatggcgacggctccgcgccgcgcagtctgagtacttaaagagcaagcgcgcgcaacgcccgggcgtcggaaagcggccttctgggactccgcaaactcccgttctccctcccccctcccccttgccattccctttgccttccgggcgccaagtctctctggcctccaaggtgaacccaactccccagcgcgccccgggttcccgggtcgggccggcttcaggcggtggggagcgggatcccgggccccgggcgggcgggagggacgggacgcggtgcagtgttgttttttcccccgccaatattgcactcgtcccggcctccggcccccccggccccccggcctccccgctacccctagcggggcagcccccgccctcctggctctccatcccggcggatctttgatagactggagtgtcgccgctgccaccgtgagtaagtgggtctgggaggacttcgggcatcctccctcaggcaccctatccttcacttaactccatccagcacctcccccacccgcatccccaaatcagccaaacttcccctagatccctaacttccaccctcccaggctttctcttctactcgccgattccttccacttccccaccctatcccggaaaatccctaaaataagcagttgcactggcttagaaaacaaccaaaactttatggcaatgtgctgtcatctttcctggggttagtgcctgagtaataccccttgaaaacttctcatcccctgaagggtggggtgaccacccctctgggactgaactccttttgg

SEQ ID NO: 1695 - DNA, 1199 bp, Homo sapiens
aacatggtgaaactctgtctctactaaaaatacaaaaattagatgggcatggtggtgggcacctgtaatcccagctactcgagaggctgagccaggagaatttcatgaacccggagacagaggttgcagtgagccaagatcgtgccactgcactccagcctgggtaacagagagagaattcatctcaaaaaaataaataaataaataaataaataaaaacaaaaaataaatttactagggtagaccatgcagaaagaatgtgcctgggtactgggacctcttctagctttgctccagaaatttggggaaggagtaaagacagtagcaattccagaggctccttgaagaggagttggggttggggaggataaagttaggtggtggttggaaatgggagagagcaaggagaaaactcacagtagctgctgtatggaccctgataccctgtacctctttccttgccctccaggtcctggagtacaatgccattggaggcaagtataaccggggtttgacggtggtagtagcattccgggagctggtggagccaaggaaacaggatgctgatagtctccagcgggcctggactgtgggctggtgtgtggaactggtgagaggggtagggcaagggagaagaagtttcctgcaatggtggtgacttgggtgggaaggggagggatgggcctgaaacttatttctgggttgtgtttgtgtttctttgtctctagtgtgctacggccaaatttagagtgaatcactccaagggttaactaatgtggggagcctcttttggcattaggtatgaagatggctgtagatagttgtagacagtgtggactggggcctcgagactgggcagagaggtgtcagctctttcctctgagcagaggatggctataaaagtgacagaggaggccgggcatggtggctgacacctgcaatcccagcactttgggaggccaagggggaggatcatctgagttctggagttcgagaccagcctgaccaacatggagaaaccccatctctactcaaaatacaaagttagctggatgtggtggcacatgcctgtaatcccagctactcgggaggctgaggcaggagaatcgcttgaacctgggaggcagaggttgcgatgagctgagattgcaccattgcactccagcctgggcaacaacagcgaaactccatctcaaaaa

SEQ ID NO: 1696 - DNA, 1488 bp, Homo sapiens
atacaaaaattagctggcctagcagttggtggtggcaggtgcctgtagtcccagctacttgggaggctgaggcaggagaatcgcttgaatttgggaggcggaggttacagtgaacccacatggcgccactgcactccagcttgggtgatagagtgagactctatctcaaaaaaaaaaaaaaagaaaagctatttaaggaaccaaaacatagtttgactgactgcaagaagtatcacagggaatgttagagtgttttattaatttctttgtcagacaagtgtttaggaaactctcactccaggcctaatgctgtgctaggctctgcaaatgctaagagggggaagttactgtccctgcttccaaggagatcatggtctagtgggaaacccgacacgttcaggtaccttcagatgggcactcagaagagtaagcccttagttaatgtttaaagatgtttaaagatgtctgagactcataggtcaaagtcagatttcagttccaccttattagacctgcactgctaaggagctgctttaggtaaggctgtgttcctagtcaccagggtgttcaaacacagtgctgggggcaatgtgggaatagccttcttttatttaggaagtaatgtgaagtcagtttcatgaatagatcttactttaagcattcattgaggtttttggcaagaatagagtacggtatatgaaggtgtttcctaatctccctgacaccaggaataatctagggctcattagagatgtcaaagatctgttctagtttcttaacctaaaacaagagtgttttagttccattttataggcggggagtctgagccaaacatgttatgtcactttccaagtctccatagcacagaagtcttctgtctccccatcctgactttcccagctcatagggactgtcaaaggcagcagctctggccggctgtgatgcctcatgcctgtaatcccagtaatttgggaggctgaggcaggaggatcatttgaacccaggggttcaaaaccagcctgagcaacatagtgggaccctgtctctacaaaaaataaattaaaaaaaaaaaatagccaggcatggggtatgtgcctatggtctcaggaactcaggaagctgaagtgggaggatcacttgagcctgggagttagaggctacagtgagctgtgactgcaccactgcactggataatagtgagactctgtcccctaccaaaaaaaagcaaaactatatacagatataaagtagcagctctgttgctgatagaaggaacagtaatgaggagccctgcaggtcttattccactctttctagctgcaagctttcttcctggtggcagatgacatcatggattcatcccttacccgccggggacagatctgctggtatcagaaggtaatgtgggcaggaaaatagcagtgggtatggggacaggccacagggaggtggttatatatggcctggttgaggtgttggggtgatggc

SEQ ID NO: 1697 - DNA, 1034 bp, Homo sapiens
cttggcctgtgcagctcgggcctgccccccgaccttgctagggaggggtggagggtgaagctcccgggagctcattggcactagaggttctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtccatgccgcccacgtgctccccggggctccgcaggcaggactgggccccggggcggtgcgctgggctacacctccctccccgcgccccgtcctctcccgccctacaggccctagcagggcaggcgggaggtgagcgcggccatcccgctcccggagttccgggatcctggaggtgggggctgtgccctgagggagggcacagggaaccgggatggggctgggggacagcgagtgctgggaagtgtgcgagatttcactccggggctcgggtcgagctaccccgtgcttcaggcggtcctgcgcctcctctccccaagacccttcggggacacagcactgcagacccgccggagacaacttgtgcgggagcccggagtcctcggaataacacttggtaagtgttaccgcgcccttcttcccttacgccagtccgtagttcgtggtccttcgccggtgtccccggagcccagcggctgtggatggcagaagcccagagtgggactggtcagctgcaggagcagaagaaaggtagggcaccctgactcccgaccccgcgcttccgaataaactgcccttcgcccccggccctgctctcaggctgtccgaaggcagtctctccacgcccctcgggcaagcctgggtaggggcgcggcctcctagcgtcttccctttcccactcctcccaggtcttctgatagccgtcagcgtctccgttgataaaatcatctcgcatttcggggccgcccggaacttggtgcagaaggtgaaggtgg

SEQ ID NO: 1698 - DNA, 1042 bp, Homo sapiens
cttcttttaggagaccatctagctggctgcccccgacagtgagtgtgttggctcttgtgaagcggggggcacctcccgagatgccttctcctcaggagcttgaggcctcagcacccaggatggtgcaaacccataggtaaggaggattggggagaatgcactagtgtgtaaccatgtatgctatcacagcatggatgggaggtagtgtaaaaaaccctgggctttaaaataagaccgtgcttagtgtgcattgcagcttttctatttattatcgatgtgtcactcatttgagccttggatttttttttttttttaagagacaagagtcttgctctgtcgctcaggctggagtgcaggggcacaatctcggctcactgcaacctccccttcctgggttctcctgtctcagcctactgagtagctgggactacaggtgcccaccaccatgcccgtttaagttttggaatttttttttttttgagatggagtctagctctgtcgccaagctgaagtacagtggcatgatctcggctcactgcaatctccgcctcccaggttcaagcaattctcctgctaagccttctgagtagctgggattacaggcacatgccgccacgcccagctaatttttgtatttttagtagagaccggggtttcaccatgttcgccgggatggtcttgatctcctgacctcgtgatccgcccgccttggcctcccaaagtgctggaattataggcgtgagccactgtgcccagccaatttttgtatttttagtagaaacggggtttcaccgtgttgcccaggctggtctagaactcctgacctcaggtgatccacccacctcagcctcccaaagtattgggattacaggcatagctactgcacccggccaggattctttctataaaaaggatatgatgcaataccttttttatggttatagagactaaacataattttttttttgagacagagtctcactctcgcccaggctggagtgtagtggcatgatttcggctcactgcaaccacgcctcctggg

SEQ ID NO: 1699 - DNA, 1014 bp, Homo sapiens
tcctctggctcccctcagggcagtgcgggctctctgtgatcacactgctgcaagacctgaccagttgagcttccggcgtggggaagtgctgcgtgtcatcaccacagtggatgaggactggctccgctgtgggcgggatggcatggagggtctggtgcctgtggggtatacctcccttgttctgtagccctgggaccctttcctgcgtatgtgtctccttcctgtcacctgggaatggaatggccagtgaacaccatcccagaagcattttccctctgcaaaatgacgtttcttcccacgtctgtttctgctaatatttaaaataaactttccttcttccctcctatacccacctgtaaggtgaaatctgctcttcttccaaatatataaaaaaggaattgccctccaggtaatccctttcctttttcccgtctatataagggaatgtcttccttcctatctatctgcaaaatggaaatctagacctccttcttcatccataagtggactgtgccagtacaatacatgcctcagcccccaagcctagaaggacctctagtctccttcctgtgtggaatcttccccactccatccctcccaagttgcctgtattgataatgtactcactcatgctgtactaggtgctgaagcctggacacccttggtgggtgggcctgtggtgatggtttgcatccttcctcctttgtcccaataaagtatgggagttgaatgtgtgtctttcactgtgggtttctggacataggctatgggggaggggaaaaaggacctcctatgggaggcataaggcagatgtttcttcctagcccaggtttagtgcttaatgctccctgaagaatagagaagtagtccctcattgcttcctgaatctcacaagtgcttctctagtctatgactttctctgtttagttagactaataggataggagcctgcataaatatgggggaggagagaagacttagcccttgaaattgtacttcatatctgaggtgaag

SEQ ID NO: 1700 - DNA, 1028 bp, Homo sapiens
tcgtcaccataaggggaaatgtacaattaggacagcattggtccaatattagaaaaaagtaatggggacatgtttactattgtattgcttaccaatcacacagcaggtgtgtgtgtgtgtgtgtatatatatacacacacacatatatatatacacacacatacacacatatatatacacacacacacacaacttggcacatttaaaaaccatcttttctcttataagaacatctaaaacatatatgcatatgtatgtctgaaaagacaacaaagctttttaaattttatttttaaagagacagtatagtctgttaacttctggtcaagagagtaggaaggaaggagacaccctggatatacctcctgatgtcattcaggagggtgagggaagatgggctaggggtgaagagaaatatactgtctctttaagaaagggacattgaaaactgtacaattaagaaaacaagagtagtgttttcaattgataatctatactcacaacaaatactctgataggtgaatactgctgaacagtttatgtagtgacttttgttgcaggggtgggtttagagttctttttatgtaggtttttaaatgattttattttgaactgaatctccatttgcacagcacagcagacacacaagaactacagcgcattaaaaacagcatgtgtgctggcgggggcctggctttctcattagaaaaaaatatgtttgacaggttatgaagggtaaaacaaaaataattgcaagaactaccgtgcccttctgaccccatgggggccttccctatcccatgattccattttggggagtagaggtagggagggggcagcagttacaagtgctttgagctgtcaactcacattttactttgacctggttgggcaagaaaggagagacaaacttccctagtcaggtatctaggaagaagcctcagctactgtttctgtttaaggtctctggggtagctcttggagccaacagagaatagatggggtaggaatagggatcctggccctat

SEQ ID NO: 1701 - DNA, 1076 bp, Homo sapiens
ggctgggtgcagtggctcacgcctgtaatcccagcacttttaggaggcagaggcaggcatatcgcttgagcccaggagttgaagaccagcctggacaacatggtgaaaccccatctcaacaaaaaacacaaaaattagccaagtgtagtggcatatgcctgtagtccaagctacttgagaggctgaagtccaaggattgaggtggagattacaatgagccaagatcacgtcatcacactgcagcctaggtgacagagcaagaccttgtctcaaaaaaagaaaaagacatagcagaaaagctgaggaaatccaaataaaatctgtagtttagtaaatagtattgttccaactttaatttcttaattttgataactgtcctatagttgtatatatatatatagacatatatataacattaaggaaagctgaatgaagagtgtacgaaagctcttcgtactacgtttgcaactcatctgtaagtttacattggtttgtttgtttgcttgctttcaaataggacctcactctgttacccaggctggagtgcagtggtgcaatcctagctcactgcaacctctagcttcttgactcaagggatcctcctgcctcagcctcctgagcagccagaactacaggcacaggcaactatgttcagctaattttttttattagtagtagagataaggttttcctatgttgcccaggctggtctcgaactcctggtctccgaaagtgctgggattacaggcctgagccaccgtgcacagcctccactatctaattttagaactttttcttttttttttttttttttgagacggagtctcctgttgccaggttggagtgcagtggcactatttcggctcactgcaacctccacctcccgggttcaagcgattctcctgcctcaacctcccgattagctgggattacaggcatgcgccgccatgcccagctaatttttgtatttttagtagagacggagttttgccatgttgaccaggctgctctcaaattcctgacctcgggtgattcactcgcctcagcttcctaaagtgctgggattacaggtgtga

SEQ ID NO: 1702 - DNA, 1111 bp, Homo sapiens
tgtttcgtattgccaaataatattccattatatggctataccacgttatgtttattcatcaattgatggacatgtgaggtatttccactttttggctcttatgcataatactgctacgaacatttgtgtacaacttttgcatacacttgtttttatttctcttttatacctgagagtggaattgcaggttcatatggtaactccatgttttaccttttgaggaactgccaaacttttccaaagtggcctcaccgcttaaaaaatcctaacagcaacatataagaatcctagtttttccagattctatccaacacatgttattatcagttcttttgaatttcatcattctagtgggtgtgaagtgtatctcattgtggtttttatttgcattttcttaattttgggggaccagtctcagcaccacccgtagggtatccgaagtccggtggcgacaaaggaatgagaagagacaggttaagtgttcataaaggtgggagccagggggccagttgcaaaatggaggctgcaaaaggcccagagttctgatctccacactgtttattgagtacagtcacttagatctaagaagcagatgttcagggcgaaacagtcaaagggaagcagtacgtcatacacataatctgtagcagtggcggtttaagtgaatctcctttgtgcttaaacaacgtatctttagttagctggtgggagtgggcttaactaggagcctgcatatctagccacattccagtgcttcagaggagcgtctttcttcttgagcacagtgtttatagataagagagcaggttgtgctcagagcatgggaacataatggcgataagaaggctttcctcctcagagtcctcttgtggctttccacaacttactgtcccatgtttttatggccagtttatgcaggcaccctgtaagcctttttcccaacatgccccccttttttcttttttaaaactgccattgctattaagacttgttcctggtgtctggtctctctccagaggcatcttccgcatctgcagactaaaagcaaacagcataaacaggtacacattaaagcaaaatttgcgatagttgattctctaacggtcttaat

SEQ ID NO: 1703 - DNA, 1032 bp, Homo sapiens
gtttttgtatctccttaccgtctttggaaaagagtttgagacccacaaatatgtcatggtaaatttaaaatcaggtagcagtttattgtcagagccaaatctggaataaccaatttagttgccatttaactgtgctagaccacacttttgtaacactgtatgcccaagaaagaaaaaaaaaatctacagatgattaatgcagttttccatcctttttaactttttccagttcagccttttctcttttctttcagcatggaggcgccattgtgtcggctttgagccagactgggtctctctttaagccccggaaagcctatctgccccaggagttgctgggaaaggtcaagtcaaaggaaaatttgtttctacttagattgttatcctgtttaaagaaaaatatttttattaatctatgtattttgacataatttcagacttagagaaaaatcatattcctgtatgcccttcccctggattcctaaaatattaacttgatcatcattgctttatccgtctccgtctttctccagagtttcttttcttttttttttttttgagacggagtcttgctctgtcaaccaggcttgagtgcaatggcgcaatttcggctcactgcaacctccgccttccgggttcaagtgattctcctgtctcggcctcctaagtagctgggattacaggcgtccactaccacgcccagctaattttttgtatttttagtagagacgaggtttcaccatgttggccaggctggtttcaagctcctgacctcaagtgatccgcctacctcagcctcccaaagtgctaggattataggcgtgagccacggcgcctggccttgatgcttctttgtctccaaataatgtctcattcctaagaacaaagatactctaatataccctgagcataattatcaaagtcagaaaattgacattgatatcatacttttacctaattggtgggatttattctgatgtagccagttatcccagtatcttttatagaaaaataaatcccagataatgtgtt

SEQ ID NO: 1704 - DNA, 1023 bp, Homo sapiens
aatcctgaagtccagaagacactcttggagtggagagagagctccatgctggtttggaggagtagacacagaaaaggaagtaatgcatacaaaagaagagtagcttgttggggtgagggtctagaagtaagatctcttgggagatgataattacctcagaacgtaatttggatatggtagcctctgactacacgatattctggggaacacagtgcagcaggaggaaactgccacttacctgtgtttgtctccattttagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagcc

SEQ ID NO: 1705 - DNA, 1047 bp, Homo sapiens
gcggtgtggccagccaactcaaggaggatgaagcaacctttgcctctaaactgcctggaactaaatgtcgatttttctgacccctcccagggagtgctgagtagtgatggtgtctggagggtcaaatccattcccaatggcaaaggtgagacttctccagatactgatggatgggggcttgggtagagcagaaacatggagaaaggtacatttcctctgcttgtcttcaggttcctcaccactccccaccgctacaactccaaaaccacttatccctacagaggccagcatcagggtctggtcagacttcctcagagtccatctccatccccggagcatctgtatgattcagaagtacaaccacgatgggtatggggaccccagaggctttgaggcaagaaacatgggtccccaccaatgcaggatgaggctcttgaggccatcttccctgcccttccccaggacaagaggctgaggagttgagggaagagatgtaagtcttggatcgtgtttacttgtggcagggaagcaggtcggctggaggcttttggccaaggggaaagtgtcctaaaggaacccaagtaccaggaagagctggaggacaggctgcatttctacgtggaggaatgtgactacttgcaggtagtggcgtggcaatgtgcactccagggtggaagctcttctcatcctgctaactatctttcgtcactcacccccgcccagggcttccagatcctgtgtgacctgcacgatggcttctctggggtaggcgcgaaggcggcagagctgctacaagatgaatattcagggcggggaataataacttggggcctgctacctggtccctaccatcgtggggtgagtggaacttggaggagtaaacattcgaatcccattgggagagtggcttaatgcaaactggtttttttctttacgaggaggcccagagaaacatctatcgtctattaaacacagcttttggtctcgtgcacctgactgctcacagctctcgtctgccccttgtccttgggtgggagcctgggcctg

SEQ ID NO: 1706 - DNA, 1211 bp, Homo sapiens
actctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggcacagtgatgtcagcctgattctctggaaagctggaggactctcagtgaggttaacactcagactccaaaaggatgttctagggtgtgttttccaaactgtggtccccagaccacttgattcagaatcatctgaggcacttgtttaaaaatgcagattccaggctcccatcctagatactctcatttgacaagtgagttggtttgctgcttgctgtagttaggacttctggtctttctgttttcctcttgaaatgtaatttctgagaccatcactaccagagggagagatgatggtt

SEQ ID NO: 1707 - DNA, 1115 bp, Homo sapiens
gtggagggggtcgggagggcggtggagtgatgaagtgcagaggttgaaggagtgcagggacagaactgggggtcggacggagagtgggcaggcaggaaaagtcttaaaggcctggggtgacttaaccgtttggggtgagggccttgagctttggatatgacaggagggaggagagaccaggatggactgggaacccaggcttccttcaggcctgggctgtgaatacagcttggggtgatctgtcctttagcactcatcgtaatttccactctgtttcctccacctctctcccattgaaaacctattcagggccgggcgcggtggctcacgcctgtaatcccagcacttcgggaggcagaggcgggtggatcacctgaggtcaggagttcgagaccagcctgaccaacaaggtgaaacctcgtctctactaaaaatacaaaaattagccgagcatggtggcagacgcctgtagtcccagctactcaggaggctgagacaggagaattgcttgaacccgggaggcggaagttgcagtgagtctagatcgcagagtgagactccgtcccccccacaaaaaaacaaaaacaaaacaaacaaacaaaaaaacccattcagtcccgtttgactccggaaattcggtgagaatgaaaataagtttttaaggcttggagagttaggcacttttagagtttcaggaaggtggagtgtaatgcaattttttcttctccctttaccccatattttctgcatttattttatatcaccctttttatgtctggatctttcccaagggaagaagggatggcactgcagcttgagggctcgaggtcagacttgaagaagaacttccataaagagttttataatagtgggtgggtgagccacagtggtaaggtgtccttttctggagtgacttgaaaaacaaaaatctgaactagtttgtaagataaagtcctgctgagaggcaaggaaacagatgaattgacttcacagacttagcaatgtggggccttgagggctgagctgtttagtccagttccctaaactgtttcttggaaagagtgaatttgcacactaatgggagtgctggaacctgagctgaggatctcagaagg

SEQ ID NO: 1708 - DNA, 1022 bp, Homo sapiens
tgttcaatcagttttagtttcctggccctggttgttctccccttgtggttgactttagccagattgtggtcttcatgaattttcattcattcgttcattcattcagccagccacttcctattgagctcctgggatgtgccaggcactggaggagatttattctgacccatcataggtcacttgaagtcacttctaggtctagactcgctgaaataaggtcattctaaacaaacagcaaataattctaaaaataattcctgttaagccctggaatgcaggtgacctctgactctctctctctctctctctctctctctctcttttgtctttcttacacaagccaggcttctggcctcatgcctggggaacaaaggaccctgttgagttgtttagtacatacacacacacaagccaggctgcagggcaggaaaggtgacacagtggagagtccaggattcttgtggaggttgggggaggagtggggtggatgatccagactgtgtgcttgtctgtgtctggagttgtatcccttcttcttccttttttttccttttgagacagagtctcgctctgttgccaggctggagtgcagtggcacgatcttggcccactgcaacctccgcctcctgggttcaagctattctcctgcctcagcctcctgagtagctggcattacagcatgcaccaccactcctggctaattcttgtacttttagtagagacggggtttcaccatcttgaccaggctggtctcaaactcctgacctcaggtgatccgcccccaccttggcctcccaaagtactgggattacaggcgtgagccaccgcgcccggccaggaattatatcccttctttcctctgagcacttctgggcacctgttatcactgtctgaacactcagtaccaagggatgggggtgcacacctaacacttgcccctccttagccctattctcagaaccctgagggagggagacacaggaggctgccaccaaggctgccttaccaagcagactggccct

SEQ ID NO: 1709 - DNA, 1272 bp, Homo sapiens
cagcctttctttccttttttttctttctttcttttttttttttgagatggtgtctcgctcggtcaccaggctggggcgcagtggcaccatctcagctcactgcaacctccgcctcctgggttcaagtgattctcctgcctcagcctcctgagtagctgggactacaggcgcgcaccaccacacccagctaatttttgtatttttagtagagacagggtttcaacatgttggccaggatggtctgtatctcttgacctcgtgatccgcccgcctcggcctcccaaagtgctgggattacaggtgtgagccaccagcccggccccagcctttttttccttaataaccctttcttgtgggaagtctgtgttgctatctaaccaccgtcctttctgctaagagtccagacagttttctctcctttgatagaatgcactcaacacattaattaatttaatttaatttttttgttttcttttttttaaccttataccagcagtccaaacctcactagcattaattaattttaatcaatgagaatatggaataaaattctgtaggccacacaaaagaaatgtgagacttgatccccaccctcggtaagacacagaaactggcctgcatgacccagagaacatgggtaagcaggattaaatgtaaggacaaaatggtctttggggtagagcacggtggctcctgcctataatcccagcaccttggggccaaggtggaaggattgcttgagcccaggagtttgagaccagcttgggcaacaaagtgagacctcatctaatttatttttattttattttatatattttttgagacggagtctcgctctgttgcccaggctggagtgcagtagcacaatctcagctcactggagcctctgcctcctggattcaagcaattctcctgcctcagcctcccaagtagctgggattacaggcatgtgccaccacaactggctacttgtttttgttatttttagtagagatggggtttcaccgtgttagccaggatggtctcaatctcctgacctcatgatccacctgcctcagtctcccaaagtgctgatattataggcgtgagccaccgcacccagcctattttattttattgattaatttatttgtttgtttgtttattttgagccagggtcttgctctgtcgtccaggctataatactgcggcatgatcttgactcactgaaacttcgaactcccaggctcaagtgagcctcccacctcagcttcctgagttgtttggtctaca

SEQ ID NO: 1710 - DNA, 1046 bp, Homo sapiens
gccccaacaggatctggggctggagcactggcgtcagccgaggtagttgccccctcctcaatttatgagtctcccctctgttcagttccctattccagagccccctggactggattctaaatgtggtcctcaccccctccctcatggttgatttcctccccaacctcttccctgtctcccttttactctccttcatccccactcatcctctgtgcccaggtctctctcgtccatcctccactcctggatccattcaccaaggggcctgagtgaggtcccaccccctaagccacacaggtcctctgcttctcccccgctacatctcactgggaccccagcctggcaacggctagtgcgtcgtcggtgctcagttagccccaacatctctttcctttcctccaacaggaaacacaccttccacctctaaaccttagctccaccaagctccaaggggagagaagagagggcatatgggaatgttttgctggaccccatactgcactcccaggccaggaagctctgcatcaggaagccagcaccattttcacctcctctggggtaggactgaggggaccatggccaagaggaaacagatgcccccttagctcctccctgggtagcctgagcgggccagggcctgagagcatgccagttttagcctgtcttcctgtccttcccagccagacccctctcatcctcctcccccagtggttttctcattacctgtcactgacggagagcccctcagaggtcaaggccaaagtgaggtgggctcttggcatgctgtgcaagcttggagctcacccggcaaagagggccaatggggtgctcctctggggcgggcctgtgggctggcttagggatagcagacaggggaatctggggagttggactaatgtggatctagaagggaggtggttgggctgcacgatgccttaagactcctcccagctctgaagttctacttctaggcaatgaatgatgaaacgctggcccaagtgcagtcccttccccatcccacagggcggagaccccagccatcccta

SEQ ID NO: 1711 - DNA, 1033 bp, Homo sapiens
ctgaacccaccggaccctagtttggcttatttcttgccaaggccagtgctcctgactctttcttcactggtcttgatgctttccttctctccttgacctcaaggcctatcaagcagctggaagcctctccctcaggccccatcccagcaccaggcccctgcctccacctcccacttctcccttcccgtctctcttccccctctttccagccttacctctagtggctccccatgccccttggcaggtcagagcacactcagctttttcccacttcagcacctctgcacagacttcctccagccagagtggcagaagacagagaagcatgtccaggatttggaccagactgcctggtcccagttctgcactgggcctgttacttacggcctagttttaggaaagtcagcctcatctgcaaagcagggaaataatttccaacccatgaggttgttgtatggacccagttgagaatgtatgaaaacatgcaacaactataaagattgttaaaatgtaagttattcactgtgtgagcattattctgctaaatgtatgcatgtatgtatgtgtgtgtgtgtgtgtgtgcatatatatatatatatacacacacacatatatatgtaattttttttttgagacagggtttctctcttgctcaggctggagtgcagtagtgcaatcacagctcactgcagccttgacctcccaagctcaggtgatcctcccatcttagcctcctgggtagctgggactagaggcatgtgccaccacccccagctaattttttttttaagagatggggtttcactatgttggccaggttggtcttgaactcctgggctcaagcaatctgcaatctgcctgtctcggactccccaagtattgggattatgggtgtgagccaccatgctcagcctctgctttatatttttatttccatagctcctaccgtgttctaacaaactataactttgtctttggtttattgactgtctccctccactagaatgtcagctccataagggtagggattttt

SEQ ID NO: 1712 - DNA, 1111 bp, Homo sapiens
ggcatgtggagagaggaacatccttgccctcagagggtggaccagggtgagcctgtatatctcctccacactctggttccaggcctggctcctggactctttggctgtgagaccttgagcaggttatttaacctctcagagcatcagtttcctcatctgtaaaatggggatgaatactgatccctaagtctttgagttgtcaggaagatgaaagataaggtatccgtgtgcctggtgctgcgtatgtgtccacagatcatggctattatccccgggggaagggcagtgacaggggtgtgtgtagatggaaggagaggcctcaattgcaggcaggcagagggctgggcctttgagcaagatacacccaagagcctgggtgagcctccccgaccttcctcttccctatcttcccggcaggaccagtccatgggcaattggcagatcaagcgccagaatggagatgatcccttgctgacttaccggttcccaccaaagttcaccctgaaggctgggcaggtggtgacggtgagtggcagggcgcttgggactctggggaggccttgggtggcgatgggagcgctggggtaagtgtccttttctcctctccagatctgggctgcaggagctggggccacccacagcccccctaccgacctggtgtggaaggcacagaacacctggggctgcgggaacagcctgcgtacggctctcatcaactccactggggaagtaagtaggcctgggcctggctgcttgctggacgaggctccccctgatggccaacatcggagccagctgcccccaacccaagtttgccaattcagggcccctttctagagctctctgttgcaggctccagacttctccacccagtaggcaaaccaaaagatgcttcctcaacagcacaaggggtggaagttagacagtgaggattgttaaaggcagagccatactcctacccggagagcttgacagtgtccctctggggtggaaatgagttccttagctccatcaccacagaggacagagtaagcagcaggccggacaaagggcaggccacaagaaaagttgcaggtggtcactggggtagacatgctgtacaacccttccc

SEQ ID NO: 1713 - DNA, 1442 bp, Homo sapiens
tcaccatgttggtcaggctggtcttgagctcctgacctcgtgatctgcccgcctcggcctcccaaagtgctgggattacaggagtgagacaccagcccctcagcattttaaattcaaggtgtgatataaccttgaacctctccactcctgtaatgtatctttgttcataagacattttactttttaagtatttcctatttcctagaaatggggttactgagtcaaagataacatttttgagggcttccataaacatactgccagattgccttctcaaagggcagggtgcattgttgaagagcaggacttgagtgtgcctgctaccctgggacatccacccacagctttgagtaaccatgaaattcccgttagggcagcctatgtttgaagcctccctaatccctgctgttggctcccaacccttggtagtgggcattctgtcccaccccattggaaacttctgaccaaaattttcatgccttcttaacctgtaatgattttgtttctgtggctctgtactttcctggtgcttcttttgtttttctgattattgcttctttcttcttcttctttctgctttcttcttcttccttcttcctcctcctcttcttcttttgtttcttcttccttttttctttcttcttccttctttttcttctttcttcttctttttttgctagctctattacttctatttagcacaatgtttcctctggggtatttgttaaaagtcaggttcctggactctaccctgaccctttaatgttaaaaaagcttcccaggaaatgtgagcattttctctggagcctgtctttagccttctctcctcacttgactgcatttacaattagagctgcatttttctgacgtgtccatcatctctacttccattctcagactagcctgtcgagagttctggacagacattctgactgtaggacttctccatctacatgcatcaacttatgtctaaaactttcttcaattaactagtcttcatcccaagctggctctcttttctgacttactttcattggtcagtggccttgttattcttcagttcactgagactgaagtcttggggattgtgcttgactactccttctttcttgtccccatgtctagtcctggtaactctagaatttctctcccaactttctcttcatacctgctgccttccctggaaaccatgcctctgttaccttcctcccagactgctgcatcagctttctagctgttccctcctgagttctcttccttcccgtccatcacatacatctctaatggactgaccttttcaacttgcgttgtcatgttcagtggcttccactgcttactgaataaaatccaaactcttcagcctggcttcagtctcccttcacagtgaaatctcttgcttctcccctaggtataggcagtctgtgctgtagcctgggcaggta

SEQ ID NO: 1714 - DNA, 1092 bp, Homo sapiens
tccactgtgttgacttttccaggttgagggcaagaactccatcatcctgaccttcagacagctgatggcagaagaagggccttggggcctcatgaagggcctctcggccagaatcatctcagccacaccttccaccattgtcattgtggtgggctatgagagcctcaagaaactcagcctccgacctgagctggtggactcgagacactggtaaccagtggtggggagagaagcctgctgttttccacactaccgtgggtcaggggcagagtggagaggacagcaccctctccaggtgctcccaccacacacccagccctgccctgggccaagtggcctatctgggatagggatagagactttgaactgctcttgctgaagaggctccacgcctggatcccttgcccccactatttaaaattctcttctgagctgggctccctcactcagtccctgtatttgatactggcctaaagaccccaccccccaccctgccagcccttcttctggcttccccttccatctgtgtccctgagaccctgagaagagctgtacatagagcttgcttactaccactggttcttcctcttgggctttcagcccagactccaagcagctgctatcaaccctctctcccttcatctcttagccttgcttatttttattttgggaccgagctgcccactagatgactctgcttttccctgcatttggggctaaggtgccaggtacttatttgcacagggagcaggagcagcaaaaaatctctggttctccagagcactcgtcctctctttggaggggttattaggttgggagaaatgttgatacttttgttttgtgtgtgtgtgtgtgtgtgtgtgtgtgtgtgtgtgtgtgtgtgttttaacatctgtgaaccaggctattagtcctgctaaagcgccaatcctgctgtcagagctcacccccttcctaagacaggtagaaaaatgtaatgtagctttttccacaagccacttccctgtcccttcagtctcaggagccctaggagagtctaagctggggcatcccctggcccagaggactcccgtggtgggcacagttctaagt

SEQ ID NO: 1715 - DNA, 1026 bp, Homo sapiens
ccaggaggcggggaagttgcagtgagctgagattgcgccactgcactccagcctgggcaacagagctagtctccaactcaaaaaaaaaaaaaaaacaaaactaaccatgctctaaaagtgcacatgcacatggttcatagcttcttagtgctgcctgtcagtccttgatatgcatccaccacttacccatttcctatcagctcctcatccataaattattccagggtgaatatccttgtacatttccacaggagctagtgctagaatttctctgagacatgtaactgggagagggatcactggatcctagagtttacacctacctctgttccatcagattactttccagaaaagctgttcttgtctgccaccttctcaccgtcactgggttttttaccattctaatatttgtcattctgccaggtgtgaaagcggtatcttgttttaatctgtgtgtccctgattcctggcaggtttgggcatttcttcatgtacttagtcattttggcttcctcttctgagaactgcctgctcatttcctccagcctttcattttcagaacttttttaaaaatgggttttttatcttgttgatttgctagagttgctagtatagaaggaaatatctattgggtgataactttgttgatgatgtcctttgaggaacagaagtcttcaattaaataaaaagcagcacacatttcaactgtttccattttcccttaagaggatgacacagaagggaaatgcagttatgcctgcagacccttcatgaactgcatggatcctcctgactccttttctcagcctcttgactaactcaaagagccatttaaaaaaatgccagatataggccaggcgcagtgctcatgcttgtaatcaccagcactttgggaggctgaggcgggcagatcacgaggtcaagagattgagaccatcttggccaacatggtaaaaccccatctctactaaaaatacaaaaaaattagccaggcatggtggcgcgcacctgtagtcccagctactc

SEQ ID NO: 1716 - DNA, 1026 bp, Homo sapiens; identical to SEQ ID NO: 1715

SEQ ID NO: 1717 - DNA, 1026 bp, Homo sapiens; identical to SEQ ID NO: 1715

SEQ ID NO: 1718 - DNA, 1026 bp, Homo sapiens; identical to SEQ ID NO: 1715

SEQ ID NO: 1719 - DNA, 1026 bp, Homo sapiens; identical to SEQ ID NO: 1715

SEQ ID NO: 1720 - DNA, 1049 bp, Homo sapiens
actgctcttagtcttcacctgtttccaaaaacattgtttgggggcgggtttcgtgaggaggcttaaagagccatgagaaagggaggacccagcagtgactccctggctaggggtggggctttgtgttgggcatcagggccctaatgccctgtttacccagtggcccgccagcctgatcctcacagccaaggagcatcctgacctacagtacagcatcagtgtgagcttttgtgtatttgaagatcttccttggttcaggcgctttctgcaagtcactcgaacaccgcttcatctgaccacacccgctcccaatttaaagaagatcgttgatacactgttagccctataactctggcctttttcttttaaaccactctctacaagagatgattatcacttgcatgtgagtttctgcatttctgccatctctccttctctactggaagctctgggagggccgtgtcagtcttatccacctcgaatacccagttcctggtgggtgatcagcatatagcagacactcagtgaatatttgttgaaggggaagggcctgagagtggacagagagacacaggcaagggagagggaggaaacaaaggggagggagaaaaacagccaaaagagttcatttaacttgagtttgtctgtccaagaggaatgagccattgggaatatactggataccattgaatacttccagctgcaaaggatttatcagtgaggagctctcagctgctagtggcagagacctgatttaaaatcaggcttggctgggcatgatggctcacccctagactcccagcactttgggaggctgaggcaggaggattgcttgagcccaggagttttttgagacgagtctgggcaatacagtgagaccgcgactctacaaaaaaataaaaataaaagaattagctggtcatggcaggcacggtggctcatgcctgtaatgccagcactttgggaggccgagatgggcggatcacgaggtcaggagatcaagaccatcctagctaacacggtgaaacccccgtctctactaaaaatac

SEQ ID NO: 1721 - DNA, 1049 bp, Homo sapiens; identical to SEQ ID NO: 1720

SEQ ID NO: 1722 - DNA, 1049 bp, Homo sapiens; identical to SEQ ID NO: 1720

SEQ ID NO: 1723 - DNA, 1049 bp, Homo sapiens; identical to SEQ ID NO: 1720

SEQ ID NO: 1724 - DNA, 1049 bp, Homo sapiens
acctcagcctcacaacgtgctgggattacagacttgagccaccacacctggccccagaaatgttctatttcaactttgtttttgagacagtcttgctctgttgcccaggctggagtgcagtgacatgatcttggttcactgcaacctccgcttcctgggttcaagtgattctcctgcttcagcctcagcctcagtctcccgagtagctgggattacaggtacctgctgtgacgcctggttaattttgtatttttagtagagacggggtttcaccatgttggccaggctggtcttgaactcctggccccaggtgatccacctgccacagcttcccaaagtgctgagattacccactgtttgttcttgacacctttgccgacaatcagttggccataagtatatggatttatttctgagtctgtattctgttatactattggttatgtgtctgttcttataacagtaccatgctgttttggttactagagccttgtacaatttgaagtcaggtactgtgatgcctccagctttgttctttgtgctcaggattattttgactatctgccattgcccaatatttaaataacgtgtatattagaatgacttgtagagccttcacacatctaacacatatcctccatgccacaattgtgtgtcctttgagggcgaacttaacttttgaaagtggcccgacatcacttggggccacattgggtgaagaaaggagaagatgatgatcaagctgaatgacacagtagcagcttggctgcaccacaatgagacagattttcctatgggctcaaagtgcatttccaagagaagctttctagtagggctcaagtggcggcatctctgtcgaactctctccatccttcatgtcagtatccaatgtacatctacttatagccacttgacagcccccttcctggggcaaacactcatattcctgagggatacaggtccccaaatttatggctcctggatctccctggtcttctcttcccaataccagttagctgtagcctgaaggccctgctgcagcttgggaa

SEQ ID NO: 1725 - DNA, 1009 bp, Homo sapiens
taactcaactgaaagtgtacttaattcaagaaagtttctcgctagaaagctctgttgaggtcagaggattgaagggccactttggggacccttgctgaagatgatgggctctgctctggggatgcccagcctaggtggtcacagaacccagcttgctataaatacttgccgaatggtggggacttcctgatgtgccttcatcctaacatgctctgcagggcccatgacttagccacagactccatccatattgtcctgggggaaaccccaggcctggagtcagggacagtggagggcaaggatttgggttttcttagatcccagtttgtctgttgtctcccattgatttcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaatctgtgagcatgcttcctctgccctggcctctcttgggccaagacctgctcctgggctcccaaatgctggctccagtcaaggcttcagtcgtggtcctctgggagcatccaggctggggtggtttggcaaggggcttactagaccatcatgtgcagagagca

SEQ ID NO: 1726 - DNA, 1029 bp, Homo sapiens
tttttttttttacatctgatttcattcaggactagttgtagttctcttagtccattagctaattgctaaaatatctcccatcactgaaaaaagaaaaaaattctttgactcctcattcccttccatctactgccccatttctccattccctgtagagcagaactcctcagaagagatgactgagctcactgtttccccttctctcctcccattctgtcttgagcccacttccatgaggcttttattaccaccagcccacagctcttgccaaggtgtccggtgtccagacccagcacctcatcgaatccagtgggccgttctcagccctcactctaagtgactgatcatccccttcttgaaatccttgtctcacatgggcttccaacgccctctcctggtttacttcctacctcacgggctgctccttctccgtctcctttgctgggccctcctctcttcctgatctctaagtgttgggatccccctcttttcctgtccctctctctctacttgctttcaagccaccctcacccagaagcatgactaaatgccagctccacactgatgatgcacacatttctacatttcttttcttttctttttttcagatacagtcttgctctgttgcccaggctggagtgcagtggtgtgatcttggctcactgcaacctctgcctcccaggtttgagcgacgctcctgcctcagccctgctagtagctgggattacaggcacgtgccaccatgcccagctaatttttgtgtttttagtagaaacggggtttcgccatgttggccaggctggtctcaaactcctgacctcaggtgatccacccactttggcctcccgaagtgctgggattacaggcacgagccactgcgcccggccttgacaacacccacatttctatccctaccctggacctctctcctgaactctggactcatgtatctgatgcctcctgatatctcaaatggaaaacccgatggccctcagacctgctcttctctcagtgctccccagcttggca

SEQ ID NO: 1727 - DNA, 1013 bp, Homo sapiens
ccggggaataatggaggagatggtctggtctgtgctcgacacctcaaactctttgtgagtatgtggggaggggctgtgggggaggagggcgtgagggctctgggatctggggttgaattaccactttcttcctagggctacgagccaaccatctattaccccaaaaggcctaacaagcccctcttcactgcattggtgacccagtgtcagaaaatggacatccctttccttggggaaatgcccgcagaggtaggtggctccagttgaatacctccatcctacagtaaccactgcctgtgctctgctcttccttcgtgtttccaggctgagctcattttagtgcctggtacggaaggtgcctaacggatggtattcgaataagtgtgcaagagccttctcctccttcataaagtgtgctccatgagtcccacacaccaccttctctaaagcttccttgccctttcatctccctggtccctccttccactctgtagtcagatcctcttgccctagcatgcagtaaacacatgatctacccctcaggggccggagtggctgccctatctgaaacccttcctgcagatgcatggattaagggatgggaaattgggtaatttttttccttaacccattttacagatgaagatactgaggtgcagagaagtggtttgcttaaagtcactaaattgtatcatggcagagctgaaaccagaatctggctctcctgactcgtctcaggctatctcagcctgtagcctccccagtggtgggcaggcaggcaggcaccgagaacaaaaactgtctggtctcaatttggcctgaatcagtgaccaactcacactttctctaggcctcaggctgccctctgaatgagacacaatacttgtgcctctgagaatggtctgcaggtgcagaggacagccctctccagttaaggctgtttgtgcagctgctggctctgacatccttttcctgctccaccacagcccatgacgattgatgaactgtatgag

SEQ ID NO: 1728 - DNA, 1065 bp, Homo sapiens
agccacagggaggtgtgccatcctgcatactcgaacttggataggagatgggctgctgctgctgggatgtgcagcagctttggcctctctcacccacagctggctggtgagcagaacaagaagaggaaatgctctggttcatcaggtcttcacagtggacaagtgccagtgactgacagtaaagatgccccgctccaccccgaccatagtacctgttcacagtaccttcatttaatcagattaattgagagtctactatgggccaaggagttggggattcagagtggaataagaatgagatgggcccagcccagatggaatctacataggcaattatgatggaagtgttgcctgtgatagaggaagggtactcaactcagacttcagagaatggcttctaaaagtaactgatgtataagctgagctctggaggataagagaaactcagaaggtaaagggggaaagggagaagaatgtcccaagcagagggagcaacatgtgcaataacctgaagatggaagactgtcgtaccttcaaagaaaagaaacagattggaatctgttatgctaatggttaggctaaagtagtggtcctggagaaaagtgaagagatgaggctggagatggcaggaacaggcatgcagagccatataagccagtccgataaatctggattgtgtcatcctaggtcaaacaagacccagtgacatgatgacatttatgttttagagagaacactggatgctttgtggagaagtccatcctccacaaaggttggggtggggagtgagactacaggtgttcttaggaggctgctggagaaagaaattaggcaagagatgatgatggcccgaagtggggtagtagatggtaacagagatgtagagaaatgggaaagatttgctaggtaacatgtatagcccttagcacataatgaccattacatgttagcttcctcctattggtacagtagaaagtggaggcctgaagtcctgggttccagtcctgtttgccattactagccagctgtgggctcttcagcaaaccacttttcacccttttagcc

SEQ ID NO: 1729 - DNA, 1036 bp, Homo sapiens
accaggtgatcccttcaatcaatcagtagctgtctgtgttttgattgattctgttccctttgaaacttcttcccctaccagtgataatgcctaaaatgtattgattactttctatgagccaagcactgttctgcttatcaatgctgtagttatctaatattccttcgttagtaggtagcagggctgagatttatgcttagactttcaacccagaggatatggaacttttttgttagtttgttttgtgcacagggaaagaaggaacagagcctgtggaacttaacccctactccatactgcctttttgttaaacttgcagaaattggaagaaaacttcaattttatttatttattcagaaaatatcttctgggtttttgttttgttttgcttttttgagacggagttttgttctgttgcccaggacagagtgcagtggcgtgatctcacttcaagctcacttcaagctccgcctccagggttcaagcaattttcttgcttctgcctccccagtagctgggattacatgtgcccactaccatgctcagctaatttttgtatttttagtagagacggggtttcaccatgttggccaggctggtcttgaactcccaacctcaggtgatccacccgcttctgccttccaaagtactaggattacaggtgtgagccaccgcgcccgccagtaaacattttctgaatgtctggtatatccaggtgaagctgttaagttgcttcttccttttgtttggatattttttttggagggaggagtggtcccactctgtcttccagagtggagggcagtggctaaatcatagcttactgcagctttaaactcctgggttcaagcaattctcctgcctcagcctcccaagtatttgggaccacaagcacatgccactgctcctggctcctgtttcttgcttctgttaaggaaagcttcccggaggaagcacaaatgggtgaacctaaagtctctttgatgttgctagtgggactgaggagcaggaaatggtggctcacgggagcagcaaa

SEQ ID NO: 1730 - DNA, 1036 bp, Homo sapiens
catcaacggcatcgaggacgagagcgtggcgctgaccttgagcttggagggtgaggcccttccgctcccgccccattcctgtgtagcagcgggtccgcctcgcctgggtctcccagggctccttcccagtatctcctccgcacccctggggaccccagctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacggacgcctggccacctactcccagctctaccagggtgagcggccgaacccagcacttcccaagccccgcggagctgtctcaggggcccgagagagggcgccaggcgagctcagtctggctcctgcctatgacgcctcttatccccgacctccgccgtctcccgccagcttggaccgagggtctggactggtgtaacgcgggctggctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctcagcttgagatcagggcagggtctccgggtccctccaaggcaccgcccccccatcagcccgcccgcccgcccaggctccagctcacctctccaaaccctccctgcacttttgcctcgatcccccaactcctcttacccaagctcgatccagcacctctgcggtcccgcaccccaactccgcctcctgggtgtcagccgcccctctccgcccaccctgccctcggtcggtgacccgctgtggtccccaggccaagtgttcttcgtgcccgggcggctgacgctgtctgaagccca

SEQ ID NO: 1731 - DNA, 1029 bp, Homo sapiens
cgtcaggtgctggtctcccaggagtcccagggaattgattccaaagctgggaagaggcagtccctgcggtagagtggagagagagagagagagagcgcatgcatgtgcacatgtggctgaggaagccaccagaatactctgcccttgccccagtcctggccccatcgttctcacctgaactccaccctcctacaattcaggaaacctccccaagaactacccattctgcccgcccagctgggagagccagccacagccctgggtctagcagtgctggctggattgtctgcctctacctccctatcggccctggtgtgggttccctctccctccccagctcccagggcagggacagtcagttgccttcttcctccttcagttatggtttggatccctttcatgaaatctttccaaagaagcgaccaagcaagattccacagggtgcaagggagtaaaggacctgacttttaaggaagctgcctctggcctcggggaaccagatgattgatgatttacatttctggtgcagctatgagctctggcaggcagggtcagggtcacaggcgtgggcctgggaaatgagtggcacttactctgggcccagcactgtgcaagagtttccatatggtgtcctgggtgtgtctgattccaaagctttgcttttaaacacttcagaatggaatttggttgagcctggaagaggattaaggtgtgcttgtccttccatgccaaattcttaaaaacaccttctctctccacacttccccacctctccaaatcctatgcattgtatgtaccctttgaaagaaagcatagaggctgggcgcggtggcttaccatgtaatcccagcactttgggaggccgaagggggtggatcatctgaggtcgggagttcgagaccagcctgaccaacatggaaaaaccctgtctctactaaaaaatacaaaattaactgggcatggtggcacatgcctgtaatcccagctacttgggaggtggaggcaagagaattgcttgatcccaggagg

SEQ ID NO: 1732 - DNA, 1050 bp, Homo sapiens
ggggccaggtgctacctcttttcggaggtggggaggggggtctgggaaggcttcacaaaggtgatgactgaactgggcattaaagaatgagtagaattttgccaaattctgcgagactacattttggcctaggttatatgctaagaagtgatagaaccaaaacttgaactcaggtctcttccattaagctaaataagactttattgtaattacatctttgatttgctgtcactgtatttgcccacattccagacacctatgttcccttagaaataagatatttggatcttatgttacggcatatacacgtccttaaaatttagcaacaaaatatgctaggtttgaataggtaaaacatatgcatgtttttcttcccacgtttcctgatcctatttcaaagcatatgcaaagtctccctgcaaggaagtccaggatgtagccaaaagttccaaacccacatcctaccctgctgttcatctgtcctgagaacttggacaacctcctgaactctaagcctcagtttcctctgctgtaagatgggataacatgactgccctggtaactaacaacagaggcatagaatggctgcttgtcactaggggatgcctgcagttgttcccagagtcctgcatgacacttggctgtccttatgtccatggcaatatgtttcactatttttgcctttataacagtgtggcctctcaaccatagttccccttgtgataagaggcacaccaggctgctggcacaggggggcattctggaaggtcctgttgcaagaaaacagccaagcaggccctcagccacaagcttgtcaatttgtttccatagcaaattcaaacttgttgcaacagagcaactaggttctagttggtgtttactctacaatgcattccattttgaaatgcagtcagtgtaatagtccagattctatcaggctaaatctttttgttaggagagagtcttgtcacaagttcttgaagatgtttcaagaataagtctccagcatcagaacaggtttcctttaactatctaggtcatattttattc

SEQ ID NO: 1733 - DNA, 1022 bp, Homo sapiens
atcaggcctggaggaaaatgatagcaatcttggtttctatttttgaggggagttagaggagaaatcgaatatttgtttagtgcagatcatttgccgttcattggtcctttctttcaattattacagagctctgggaggtaacatactattgttttacagatgagaaacaggtgtccagcatgcacgattttacctggtaacagggcagagtgaagattaagattaaggttcagtctctctgaacctcagatctgtgcctcatattcatcatttagctatggtcaaagctaggtgagttaggatgcttgggtactgtttctagaagaggcagcgagtcttacctgtttctatatgtgacagtggaaaaatacaaggctcctggagtgagggctttggagataaaggagagattaagccttggagcaggaactgcttagaattacttaccggagagaaatttattgcccttgcttttcttcagactcccagctctgcctaggagccatttccattcgttgaacttgctgttccttaaatttcttctctcagatatcctaatgttctctccctcacctcacttggcctaaaaggcctgttttcggtgaggacttccctagcctactatgtatttaaattgcaacctcctatcacctcctcctccccattgctctttgttttatttttctccattgcacttaacatcatctgtcctcccactagtatataaactccatgaaggcagggattaaaaaaaaaattcactgctataaccctagtacttaaaacagtgcctggcacatactgaatactcccatggatattttgtgagtgaaagaactccaatatggatttttcatggaaggagtttccagagtttccctcccaatcttgtttgaaactttcttccttttttttttaaattttttttatttttattttttttgagacggagtctccctctgtagcccaggctgcagtgcagtggcacgatctctgctcactgcaagctccgcctcccgggt

SEQ ID NO: 1734 - DNA, 1617 bp, Homo sapiens
ataagtctgctggaagagttttctatcatttataaagtgtattccaaagcacacagaaatttcagggttatctggattagtatttaccaccactttcagattgtttaccaagatagtagaaaatttgaagctctgagacagatttcactaatttttgtcacttctagtaaccaaataagaattgcctgcagtggatttagctaagttttagccctagctaaagggaagggagagtgtgcttatctgtgtggggcacctgcttaatgtctgaactgtgctgggcacttactttagtttataaagaagaaaacaggagtttagagaacagaagtgatttgcctgaaaacacagtttgtgagtagctgcaattgtatttgaacctggatgagatttgttgtgtttatcggggtgtctatggaaaacatggaagagcctggggcagccagaaagcagaaagcaatacaaatgaggagtgcaaaaatgggagtgaaaacggtatcctagcagcaggtacttgagacttaagagtgaaaaagggttgatgaatgtagcaaatggggataacagtagtaatgattagggtttggagccccggggtgtggtgcttagggggcgtctgttcttgggttcttatttcctccttggcttttagtcctggaagctagtgattgctttttggagagggagtgtctcagagccagagcctgggaagataagagagaggccgccgtggggaatgaggctctgatagattagcagatcccactggacctagcttaatggaaaatgtctgtttccgttcttgctcagcagtctcggggtatgtgtgtcttgtcactcttggcagctggaacagagaggacagtggtggccattgaggctcaggttctcgtgaggccaagaagaaatacaatactttcttattaacagactcaacagtttgtgcctcaaaaccaatgtgtgcctattgtggcccgggacactctcagccctggatgctccggtgtttctagcattgtccttctttcttgatctaatggcacagacccactcagatggccatttgctggtctttagcactctctagaagttgactccacaacctccatttaatatactcttgaggaaaacagtttggcagttcctcaaaaggttaaacaaacagaatgatgatccaccaatttcacttctaggtgaaaagaatcaaaagtggagattcaaacagatacttgtacaccagtgttcatagtagcaatactcccagtagccaaaggtggcaacaacccaagtgttcatccacaaatgaataggtaaaatgtggtatgtgcacacgttaggatattattcaacctgaaaaaggaatgaaattccgatacgtgctacaacatggatagaccttgaagacattatgctaagtaaagtaagccagtcacaaaaggacaaatattttatagttgcgcttatatgaggtatctagaaaagtcaaattcatagagatggaaagtggaatagcagttaccaggggctggggggaggtggggataaagagttactgtttaatgggtgcggagtttctttctttttttgagtcaccttttttttttttttttttttttt

SEQ ID NO: 1735 - DNA, 2157 bp, Homo sapiens
ttaaaattgtctgtcttcttcctgtctcatttttaacctggaaaataagcacttaaatagcacttactgtgtaccaggcactgttctaagtgctttactagcatttaattgatttcatcctcatgatagtgcctaagccatagtgttatcatccctgttttacatatgaggaaactgaggaacttgcccaagatcagacaactagtgtgggcagagctgggattcagactcaggcaatcagacaatatatatattttttttttgagatggagtttcgctcttgttgcccaggctggagtgcaatggtgcaatcttggctcaccgcatcctcctcctcccagttcaagtgattctcctgccttagccttccgagtagctgggtttacaggcatgcgccaccacacccggctaattttgtattttaagtagagatggggtttctccatgttggtcaggctggtctcaaactcccgacctcaggtgatccgcccacctcggcctctccaaagtgctgggattacaggtgtgagccaccgcgcctggccagtctgactgttgagtccaagctcttaactgctgcactcagctccttgtaattgaaaccagaagtcctcaacaagacagtgctagtagatgatttccctgctgtttgcttctgtttcccctcatctcagtaccattatcctggcccccagaagtttcttcccattccttccacacttggtgatttatacattctaacctcatgttgatcatatgtctcagggaaaagcagaagtggtcctgcttttataaagtggctgtcttgcctggcacggtggctcatgcctgtaatcccaacactgggaggcccaggcgggcagatcacctgaagtcaggagtttgagaccagcctggccaacatggtgaaaccctgtctctactaaaaatacgaaaattagccaggcgtggtgacaggtgcctatagtcccagctactcgggaggctgaggcaggagaatcgcttgaacccgtgaggtggaaattgcggtgagctgagatcgtgccactgcactccagccttggcaacagaggaagactcagtcaaaaaaaacataaaaaaatacataaaaataaaataaaataaaataaaaaataaaaaaataaaatagtggctgtcttgtgattcaagtggccttctcctgactcagttaaagttgcttccacctctgagcagttttagaaggacgtagttgtgtggaagttagaaagataactggcaaggctgatgtttgtatttatttatttaatttttttttttttgggggggacggagtctcgctctaccgcccaggctggagtgcagtggtgcgatcttggctcactgcaagctccgcctcctgggttcacgccattctcctgcctcagcctccagagtagctgggactacaggcacccgccaccacacccggctaatttttttgtatttttagtagagatggggtttcaccgtgttagccaggatggtctcgatctcctgacctcgtgatctgcccatctcggcctcccaaagtactgaaattataggcgtgagccaccgcgcccggccctggtgtttgtatttatagtagatgaaaaaggagtcatgcaagatgttggcgtgctgagactgagcaaaggcagtcctgttaccaggatagcttcctggaggaggtagactggctcagaaggcgcccccactgtaagactgaagactgtaaagaacaatcttccaggtggtaggaagaaatgagtagatagaggaattctgagctcttaaggcagagtggggacttaggactgcaaaatgttgtagccatgaccccagatatgtgacaagtcagacacttcaaggtagcctgagggtgtgctccgccctgtacctcagtgtggttcctatgaaccggagcctctgggcgcttccaggctggaccaaatctgtgaacacacacacagcaagaagagcccagtctccacatgagcagttctgtgtggcttgactcaaatgtcttatttactctgggcatttcttggctgagaaggctggagtacactagtactctaagacagtgacacagtgaccttattccattctccttttccaattggcatttcccttagctctacagttaggccaaac

SEQ ID NO: 1736 - DNA, 1071 bp, Homo sapiens
tcgctctgtggaagagggcagtggagctgggttgggatggaagagaagaggaatgatacctcaccttgggagaagcagcccgcagaaaggcctgaagtagcaggagtcaagcccagattaggtggtctgagtggacggaggtaaggaagaaacaagggctggtaagattttaggctagagaacttatctgtaactgttgtttttggtgttgctagtacataaaatctcacttgtcatctttctttcctcctatcccacacctgggctcaccagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggtgggtaggaggcacagagggcaggcgagggaatgttggaacatggtggtcaaggagagctttgagctagtgatacagcctctgtggtgtcactttggctaaattaaccttctctatttattaggccacagaacatacctttattctgaaccatattaatctaaattgcccaagtcttaaagtgtgacagggtgaaccacataaatgacatctttattctgaaaacaatct

SEQ ID NO: 1737 - DNA, 1321 bp, Homo sapiens
tctagggtctgcagcaacatctgggccactcgcctctaaggggaatcatgagattcctgaactcaaaatctggtaaacgaacctgctttgttcccagctttgtaagtttcattgtatcctaatagtggttattttaaatcagagatctataacctccccacccggtttagactgtttccctgtatccacaggaccaaactagaatgaggagcaggaatggcatgacgtataccttctcgtccctgctcgcatcgtagctcattggggtcttatgagcaggaggagcagggctgagggcatggtagaggtaagaggtgagagtctctcttaggaagtagctgagggagcaaggtatagattgaagcaggagagactgtctttgtttcttgttaccctttcctaaaaaatatccatctgtctggatagtgtagatgagaaaagctgtagggactgttcttgagttgtaggtcggtccttgggatctatgcctttaactggtctgtttgaggaagctgtagtatagctatctcaccattgcctctttgatgacaattttctgtttctggacagaccttaccttcccctctccaactgtgccctcagttggtgtgtttttctttcctgtttggctgcaggattattacagtggtggctactatcctgcacaggacccggccctggtccccccccaggaaattgccccagatgcctccttcatcgatgacgaagcagtaagttaagaaagcacaagtgaccatctttgaccgctgggcaccacatttcaaatctgaagccaaaggaaattaaaaaaacacacacacacaaaagacaaaactgtatcaggattaggttggcaacatgtaatggagaaactctaaataatagtggcttatataaaggaagttagtttttttcttcatggaagaaggatatgggtaggcaggccaggggtgctttggaagctccacagagtcagggatctagtccccttcttttttttttttttttttttttttttttggtagagacggggtcttgcttgttgtccaggctgcacttgaactcctgggctcaagcattccttctgccttggtctcccaaagtggtgggattacaggtatgatttaccatgcctggcttcagtctctttctgatcatcgctttgccatccctaggctgtggcctttattcttatggtccatgatagttaaagctacagccatcacattggcattggagatgcagcagggtagagaaagaaagaggaggaacacttcccctcgctttctaggagacttcctgaaagttcctaagagcacgt

SEQ ID NO: 1738 - DNA, 1079 bp, Homo sapiens
cccttctttctaggactcaagcatctggccttccagcctctgtgggccaggtgttcagtgccccggcttctctatttctggtgcctgtgctcccctgttctcatggatgcaggcgtctgactgactcttgcaccctccaaatgcctacctgcaggcagcgttcggaggtagacgatgggactctgggctccttgatgagggctgtcctcctcagtggttagcgtgatggcccgcacaaacactgcgtactgtgtccaaggcttgagggaggctagggtcacccctggctcctgggtgcggcttaggggcagctccacatccagcaggttccagctctgggttccacaagcatctggacccacgtgctctgtggcgttctggaatgggctgaacacccatccccagagctgaggggtcattcaaccccaccctcaagttctggcacccccgctctgaatcaccccaggactgtcattgtccttccagtatgcatgagggcaaagccatgactccagccacctgttagaccttggcaagggggggcggaggaggggagggactgtgatatctgtgtcagtgaaatttgtaatgatatagctcctcatccttagcagggaatatcaagttctagtttcaatgaatattgaaaaaatcttgcattgaataaataaaacaagaaagtgtgtgtgaaagagtcccctctcctagaaacagcaagcaataaggttatcctaattcccctaagtctaattgcctggaacgaggaacaggagactgctcccttcccagtgtcttcacttaggcccttgaattgactttggaggtttatgagcctcccaaactatagcaaagttttgtgcatgtgtgtttttctagagagagtgttcctagcttcaacagcttctcaaacatgtccatgaccctaaaaggccaagacccactgccacagggaaattaaggggccagaggcaactagtgctggctgcctgaaggccagtttcggggcagggcttggggaagcatcactggctttaggggtagaagagggctccctgggggagatgacagtgggcccccca

SEQ ID NO: 1739 - DNA, 1050 bp, Homo sapiens
ggagagaacatagtagagagagaaggcatttcaaaggagcagaaacccaaggctaggcaggctggcagaatgaagcctctgagagaagttgaagttttcatctctactcctgagtcatccagaaggacatttcatcgagacagtgggactcctgggttttaatccaaaaccttgaggaattgacttgctcctctttgtctcagtcctccccaccactccccactctccctggaaatctaccagcttgacactgtgggatgggatgggggactcccagaggtcccacactccccttgatgcctgaccctcccacacacacacactcgtggctggctgtgctgccagcgccagaaccctccagcattcacccccggggcagctacattgtggttgatgttggatcccagactgacgtgcctatcacacagcacacatctgggaagtctcccttcaccaggcagtgggcgaagtgagaatgcaaactcattttaatgtcagtttgagccaaatataattagaaaggaaaatctctgactttgaaaaaaaaaaaaaatctaatgcatttcaaagccaagttgaaatgacttctggattatctgcaccgctgccactctccatttatgcagaaaatcgagaggggagcctgtaaagtctgtgcctgagggatttagtttgcacacattgcctttggtttcatgccagggtcatgttttaagactggcctttttcaacacaacccggttcctggaattgggaagcacctagagtgacctcctcaccagggggcctgtggcagagtcagcctctttctcagaggggctgcttctgtgtgatcatgaccaagtcacttacttggagcctcagttttctcatctataaaatgcaaatgattacgtctatcttctagggttgttgtgaggattgaatgagaggacctatattaaggaacagtatctgaaatacaataagtactcaataaattatagttgttattaatattgcacagtccttgctttttacagtttagtccaaggcagatcttgaaaaaac

SEQ ID NO: 1740 - DNA, 1002 bp, Homo sapiens
gaagttgctttaggagcaagaactgtcttgctgaaataaatgatggctgtgcagggagcacattggaaggggtcttggggtggacagaatttccttttgctctaagggtgaaaccagtcaggtctctctctttctgagctctcctcccagagcacctggtcaggatatcccagtcatcacctccgggaagatgatgttccctggatagcccatacattttctcacctccatacctagctaacactgctgcatcagtcccaatgaccccacttcccatcctttactctctgagatctggatttgccttcaagatgcaccccccatgccactttcttaaggtagtcttctcaactccccccaaagaatgaactattatttttggggggcttccaaagcaaattgctttgaaattccaaaagatcatacattctgttttaatcatagtgggttgttaagctcctgcactagactataatgctacttgtggatagggactatgatttgtttatatctgtaacttccgtctcttgcctcttttccccagcatagagcagaatgactgccatacagtaaatcaaaaaaaaaaaaaaaaaaaaaagccgttgagtgaatatcccagttatttgagtgtggattatccacttggtagatccctataattaatgtttaactcaaagtctagtttctcttccagctcagctcctggtactatcacgtaatatgtgctcagagaatgcaaacagtttttaaatattatcttcagtacgacataattaggtgctgctaaaaattcattatcatgctttccaaagccaaaaagaaataacttttgtattatccactccactgctcttcctcagtggtgtggataactgagacataaacgttttcatcataattgatgatgggaccaccttacagggccgctggatttattgggtgccaggaggaagaagcagtggcccatatcttctgtaattctttcttctccagttgctaagc

SEQ ID NO: 1741 - DNA, 1034 bp, Homo sapiens
tacttaccatccgtcagtttcttttatcttttggaaggaaacctgtttagaacagcccccttgggactagggccccaggcagcgagtgtagtagagaagtgaggtccagatgctgtatgctgatgtaaagttgcgactgccctcatggagcctgacagcaaggactgcagagttttttccccatctctggcatctttcctccatcagcagagggtccagggtatcaggataatgacaagaccttgccctgaacagtagaagggtaaatacaaagaaaggagagaaatcaagggggagacaattcatatataatgagcacctattctgcacaagacactgctagatattctacttactgttgacctatttattttaattctcatggagccctgttaaataagaattactcaccctatgttctggatgaggtgttaaggctcagagaagtgaaggtggagctgggattcaaacccaggcctgtctgaccccaaatcctagtattttttttaccagtccatgatctgtcggggctttaaagaaccactttgatggagacaggccatgcccctgctatgtggagaccatgtggttaataacagtgattggatgtttgggtgattttagccacagtctatgtcctagtagcagtagtgtcaataatttgggaggaacatacctttgccccttagaaaggcattttactaccccaaagtcccagaaacctacagagccctacagaactacacagagccagggggaactggtatttccaggggtggatttatgcattgacagagtttaccatcatccttcaattctcaacaaatgcagagaaccagagtgtggacagatacttttcctaaaccaacagtcaaaacccagggatactggggattactaaaagtgttgtagtttgtttgtgttttgatatagaagggaccttgggccttgacattacaatgcaagtagactacggtgcaaatggcgccccctggagcacagaattagaatacagaatttccatttatttattc

SEQ ID NO: 1742 - DNA, 1278 bp, Homo sapiens
ggccccctagaggctccatgtgcaaaaggtgaggaagacagtgtgttaactggagccgatacactgcaacctcaaattcctagatccccgccagagtggtcaggtctgaatgtacgtgttagggagggaaaaagaaactcaagggacagaaaagaccctgactccctgtgctctactttgcagaccctcctacagtgaccctgtccattgagccacagacggtgcaggagggtgagcgtgttgtctttacctgccaggccacagccaaccccgagatcttgggctacaggtgagggggtcagaggctgggagcgctctggggagtgataaggaagagttcggggttagaggctgtactggggaggccaggtgtcatggatgtagttgagagggtctgaggcctgatcccacctctgtgttgcctcctcccctaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactgtgagtagctgggagggcagggacggggacagagagcaggggcccccaaagggccttggacagagtcggggactgctccatgaatggggaggtagcagggcaggaggaagattgattggagttaaccccatgagcttgagaccctaacgagtggcttctttctccctcacagttgctccccggattgtagttgaccccaaacccacaaccacagacattggctctgatgtgacccttacctgtgtctgggttgggaatccccccctcactctcacctggaccaaaaaggactcaaatatggtaagactcttactgcctgttcttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccttgttagccaggatggtctcgatctcctgacctcgtgatccgcccgcctcggcctcccaaagtgctgggattacaggcgtgagccaccgcgcccggccttactgcgtgttctgaatgctgggaggaaggggtgcggccacagatgggagtagatggggggctgc

SEQ ID NO: 1743 - DNA, 1038 bp, Homo sapiens
tgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaagaaaacaaaaaacaatgaaaacctcatttgggaagaaaagctgtagggattcccccacccaaatacaagtcccagtggaaaggaaaggtagtacctattcttctccatggggttcctaacaccctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcc

SEQ ID NO: 1744 - DNA, 1067 bp, Homo sapiens
gctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctgtaaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctcctgttgaattttctccacccagaccccaaaaataaatggatccatgatgataattaagagaagagaaaaaaagatattatttttgttaggacaaaccattgtaggtttttagcaatgtgtatctgtgtgtccctcacaccttttcctattctacttttttttcctttttttaaaaatattatgtactatatttttagtctcaaacacac

SEQ ID NO: 1745 - DNA, 1048 bp, Homo sapiens
gaccactgggagttagggaaagtggtacgtgtgtctgggccccaggctgtcagagcgattagctttaattgctcttccctttgtggttaaatactccattggggaaattgccagtgatgccctaggctgcaggcttccctggttgcctacttcctcaattccgtgcccatcatgtgtggatgtattatcatgcatgaagagggtcacagaatcacagagcgcctcactctctcacacagatcctcacgcacaatgtcatgatggatatcttcaccagctggtaggcagccaaccactgaatctccaagccactccgaccaaacttactctgtcttttgtagcagggatgctcaccccttcctaattgcagctccgaatattcagatggggacagtgaagcacagatctcaggagtcctaagtattcatggctaccactaagttggataggtgagtaggaaatgctagaaggggtgaaagcctatagaaaggaggaaaagagagactgaaagatgaagtagaaaggaaatgcatgacaaagagtgagagagatggagagagacagaaatagaagcagggagtgccacaccagaagagtggaaacagagatgggctggggagagtcctaggccccattcccctcctcgccatcagccggccctcctctgctctgcctgatccagtgccagctatctcctgatgccccatcttgggtctggctctttctagaccaagggctgaaggctaatccttgtccccatgcccaaaggtaatccattttgcttcttggactgaagtgaacattttagggcccagatgtcctgcctctcgtcacttccaggctgaccctggagcctcagaaccctcaatttccttgttacaggagtaaagacaaccccctcctcccccacaaagctggataaaaagcttaaagaagaaattaattgagaatgatattaaaggaaataaactacaggactgcttgaatttggggcccagttataatttaaaataggaaagctggacccctactctctcccttccaaccc

SEQ ID NO: 1746 - DNA, 1035 bp, Homo sapiens
cagacctgatcctaagacctgctaatcacctcctgctcccagctaccctaaatataaatgttcattggaacagttatacaactgatctcatgatacatggcagagttctctgaaaatcatcttagccatcccccatatctccagcccaaatgatgtagaagagtctctcctttgtttaaagatctgagctcattcagcttttctaccttgtctgtcaggaaagtctttaattttcactaaccacctcaccctcactcctacctccctgttctccacaccttctgcaatatgggatcctgattgtctctcacccctttcttctgatgctgaaaatgagatactgagtccctgcataaggagcatttgagggaggaaaggggcagagccctggctaaatgtagccaaggctcatgccggctttcctggcagatattaccagagtatttacgacactgctgagaacattaatgtgagctatcccgaatggctgagccctgaagaggacctgaactttgtaacagacactgccaaggtagcactgagccaggctgggtgggagcctggggcacacagtgaagatgctagcatttgaggataggagaggtgggccattcagccccctcctcacctaccacaggccctggcagatgtggccacggtgctgggacgtgctctgtatgagcttgcaggaggaaccaacttcagcgacacagttcaggctgatccccaaacggtaagcagatgggccctagctccttctttctatttacacagcaagctgtccctatcctcccttgccctagtgtcccaaaccttggaattccacatgactgttgatgccggtgagaatgcctcatgccccagagagctcttgggtgggcctcatctgcatcttatgagccagctactgtctcccaactccagtctatctggccagtctggttcctgccccatgactgggtctccactgataattctttccctgggctcccttcaagtcacagggttttctctctttactgttccaatcctagg

SEQ ID NO: 1747 - DNA, 1032 bp, Homo sapiens
tcttaaatgccatcctagcttctccctttccctattcatattattaagtgaatttagtcaaccctgaagaatcttacttggtgcctactctgccgggttccatcttggtctgtcgggagttccctgagggaggagcagagtgcctcaggacttgaccacgcacctggcctccgccccatctcccacatgaactccaggcttcaagggcaagaggtagcccttaccttgttcctatttgaggctggcatcccctgtagtagaacaaagatcaccaactccatttctgtggcattccaacctgtctctaattgtcttggaaatggcctgagacttgggaaggaaaccagtgatgtccctacccctttatcttctgccctgaccagggtcatccaatctcctgtactgccaccaccatttttggcacatagaggactctttcctttccccattaccttgcttttaaccaggagcaaactttttcctttgtttacctgagataaaaggatcttttcaaagggaatttactgagaaatgtaggggaagcaagagaataaaggaagaaatgatagacatacacagatccacacctatatacccagagtcccatctgaaatgactcaggttcctgggttctgcatagaaggcctcactttctttctttgtcctgtcacttcaggctggtcctgctcttaggccagggggcttttattttggtttttggacttgaagtgcagataattgcattaattgctcttttcagcttctaacatattgtcattatagagtttttcatggttctttattctgtttcttcttttcctccagttcccactttcactccagcgccacattttaggcatcctgttgagtgtgtttgacttccttaaaagctatatgtatccttgtgcaaagttagtgttagtgtagtgatctttgttggtgttggtgtgtgtgtctgtatgtatgcttttttttttttttttattgagatggagtcttgctctgtcccccaggctggagtgcagtggcatg

SEQ ID NO: 1748 - DNA, 2051 bp, Homo sapiens
tccaagttcttaaaacatttctcttcagtggcccaacagggtttctctggggcacatggacatgactccagagagccacagtgccaaactcctccagggcagcaactggccctcctgtccctcaccccagccacaacaaaccctgggttctagggcagggatactcctgccacacagcccgagttagaaatctccttgctaggagcatttgcttccacatatatttagagcaaagaaggatcccatccttttcccagaaatctccacctaatgtttttggtttgtatggtcacgtgaccataggcaaccacgtggaaaccctctgtgaccacttttccagggacttaggggaaggtacctttcttccaatgtgtcttcctaggcagcccctgaggaggagggctgaatagatccctgaggttttggagagacccccatcactgactcctgctccctaaccctaccctcactttcgtccccgctcttcccagtgaaggatggtatgtagactcctgtacagacatagtggcttgcagaccctgacccagcccctgtggtcttagacaaatgtttttatttttgtcaccagccacccctgtcctgccgccttctctcgactccagagacctgttgcctcatctcttttggggaagagccggcagctcctcctcatcccctgccttaagtccagttctttgcctcaggggtctcgtttccttggccttccagggtccccaccccttttctccctgcctgattctctgagctctgggctccgtctgtattgggttgaggggcaaggattactgccttttgtaggtacttcacccctcaccccattttagcttccatagtctttgcaccaaatccaaattcttgataatttagatctcattttgagcaaaatttgctggccctctaataaatattttcaatataaatctgagcctttgactcagacatttttgccaaggagagtagaattaggaagtacccatatacatccagccaggatccacatggaggacctttctgatggctgcaatgactaggccattcctctgagtaactcacagtgtccttttgtaggcccttcttttccctgaaagactggttggtacttaccttgcagagcacatcctgggataagatccccagtgtctcccctgggaggctccccctctgtgtagcaccagccctgggaatgatggagcctagtgatcggggtttctcctgctgtcctttctgcaaaagttcacttgtttacccaccgcatgctagagaggagctcattggccaatgcttaccttgtccccaaaggggtgggttgtggagctcacttaggcagggcctctggctggggccagggttatgagataggcctgtatgaaatatgtcctgttctgggggtctgtctcttttcttctcttcaaaaactttgtgtcagagagtcccttctgagtcacataaatacctcactatcctggaaaacagggcctggatggtgactggggtcattgcctttgtggacaggatggagtgtggtgtggtctgaggagcaggttggggtgggggagagggaaaggatttgggatcttagttgctgccctaggttaggggctggggagtgtttattttaagatcctgccatgtttttaatcactgtgatttttttttcattcccctttcctaaaaaaaattttttgcctccaactctctaagcactaagggctgtgcctgagaatggtagcattttggtcttttgcttcagaactgtggtatctttgtcttttttcattattattattattattattattattattactattgttttttaaaatgtcaggatgaattgtcagacatatggccatgtgtttgtcctctgcttctcccctgtgggaagttgtctccatgctgtgaactgctgtggggtgtgcagctgactcagtccctctgagcagtttccccactgtgtctgtcccatcatgcgctggatctgctcattctcctgctgtgggggtatgcccacctcttacccccttgacacc

SEQ ID NO: 1749 - DNA, 1026 bp, Homo sapiens
cttccatctcagaagagtgaggattgccctctttggcacagtcaacctccagggacgctacacctgaaccttcagagagggtgtcctcttctaaatagtaccctccagccctctggtctccctcagcctctccatccccactctcccgttccttgctgacctcccctgctcctccttcagttgctgcttctgggcttctgctgtcttcaccatctccttggtcttttcttgcttcatggtaccccttctccctctgtcctttgtcctcatcctctctgactccctcagcctcttgtttctgtacaacttcccatttctcctcagcaacttgatcttcctgggccccttgctctaggtcccttccagcttctacctgggcttcctctctttgttcatcctcttctctctcaatttctttttccttctcatctgtatactcatctcctcctggttcctccacacctttagcctccatactgtcagccttcttctgacctttggacttctcttccttggcctctgtctcttccctactcccttctctcaatctgacttttgtctcttggcttcccccagcctcccctctatcctcactggcctttccagcctccaccttggtctctggacttccctctgcctcttccctgatgtctagcctgcctccaggctcagcctgcttgtcctccccaacttcccagcatgcctgctcttccccaccctgtcccagagcctgccttccacatcctgctgcctctccctccagactccctgaacccttccagattgggggtttaggtcccagaaggggacttaggtcatcataggcactcaggaaaacttcctccccattttcctcctcaacttcaggcctggggccagcggagtccagggaacagcagctgggggccaagacaaactgtgcctcatccagagacaggtcatccaggggtggctccacagagaactcctccacctgtaggcacagcattgtgactcaggaccaggaggccctgtccacccttgact

SEQ ID NO: 1750 - DNA, 2085 bp, Homo sapiens
gcgcctgtagtcccagctactctggaggctgacacaggagaattgcttgaacctggcaggcagacattgcagtgagccgagatggtgctgctgcactccagcctgggtgcagagtgagactctgtctcaaaaaaaaaaaaaaaaggtaatcttcttgagggtaaaagttcatttagtgcgagtaagcattaggtataccatttcctgactggttggccattcattggatacatttggaggacagtatatcatagtagttaagatgtttggatcctggagctaaacaggctgggttaaaatcctggttctgccacttactagttttatgatcctggaaaagtcatttaagctccatggcctcagtttatccaatgaaatggggataacgatagtacctattactcataacagttgttgtaagaattaaatcaattaaagtgcctaaggtagtgcctggcacataataaagctatataagtgttatgtattattaaaaagatattctatgcacactgactatgaaccatgaaaaaaaaaaaggtattctaggagacatagagtgagattcatgatgtctgtcatcagaaagtttagatcttccttttccccatctaagagtcctcttcctggttatagtggagattaggaaattaacaaagtatggaatggtgagttagaaaatctatagggagaggctaactccttgctatcttttgggggatcccaagggaataaccatgtggctctgaactatttcttacttctcagatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggtgtggggggtgaacaggagccttttggcgggatctggggttgctttagcctggggctttgccagtttgctgcccttaaaacgtgaggggaggaaggtgttgagaggagtaacccgttgagattactcttggttgggtggatggagggaagtggcaggggatgcttgagtcattaggatttggtttatttagcagcagtgctttgaagctggagctatactcagcttttctctggctgactttttggcaggcccctttgccattacttgagtgcctcagtttccctgctcttacgttagactagtgcgtcaaagccagtgtccctaggggcagggaaagagaaaagacattagctcgctaagtttaacagctgattcttgtatcttccagctgtctacgtttgttttcaaaacattcaatgagtcacagcaactcagagagggtttatgacagtttgccatttttaggagaactgtataacccaaatgatgaaggtcagatttgaaggagttggatctctaataggaatctgaagtttttttcttactgtcatgaagaaaggtcctgataacaggatggtaggattaggatttagatccagcccagtgtcggggtgaacagtgactagaatgtgattccccaagagagcctcggcgatgacagtttctggtcctggagtctatgggttaacccctgtagcattagcccccgtcacagtgacatcagaataagaacaggctgtcccagctagtagcgtcttagctccaccctcttcctggaagctgaagctggttcagcagacagctaggacttggctttttggcattctggaggaaggaccatttctacctgatgctctgtcttccttaaatacctcactctggccgggctcacgcctgtaatcccagcactttgggaggtcgaagcaggtggattacttgaggtcaggagtttgagaccagcctggccaacaaggtgaaaccccatctctactaaaaatacaaaaattagccagacgtggtggtgtgcgcctgtaggagaatcacttgaacctgggaggcagaggttgcagtgagccaagatggtgctactgcactccagcgcctgggcaacagagcaagactgt

SEQ ID NO: 1751 - DNA, 1032 bp, Homo sapiens
tctggtaagaatcaatcccagtaactataactccaatgaattaaacctgaccttggttgaggtttttatgaactcttctttctcctcccaccttgcaagtcttaactaacattgttgccatctcaatctccctaggctggtttggacaagatgtctaagggacacatgttggcagatgtcgttgccatcataggtacgaggcctattgtgtagtagaggtatcctagacaaaggagttcgggacgcccactggggacagaaggagaacacttcctgttcaccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaacttctggtatcttagtgtctcagtatcttagtgtccttcactcggactgtaaacctaagaatgttcattaaccctccattcctgttagattcagtcaggtcttagcaatttttcctgctcgtctccacccccttctctgactcttgtcctttccacttctctattccccatttcctctttcgcctcagttccctccttgcccaaaccttctcagtgcccacataacttggtaaaccactcaaatcaagacctggggtaaagttgggagggaaagggctatagtggggtctgagggaatgttgacgggcagtttcacacagataaatctctgaaccagccgggcgcagtgcctcacgcctgtaatc

SEQ ID NO: 1752 - DNA, 1029 bp, Homo sapiens
gaactcctggcctcaagcaattctcccacctcggcctcccaaagtgctactgtgcctggctgacttttctcttttcagggttgatagaaagtggcaggggaagggtctggttgtatggcatgaagagctggtctggtgaaaagcctcatttctcatgatgagcatttcccatggggtgcctttggtcttgtctgctgggagctgatctctagctggtttaatatacaaagcacccttggtgcctataattccagctactcagaaggctgaggcaggagaatcacttgaacccaggaggtggaggttgcagtgagccaagatcgcaccactgcactctagcctgggggacagagtgagactccgtctcaaaaaaaaaaaaaagattttacatatatatctctatctatctatctatatacacacacacacacatacacacacacacacacacacacacacacacacacatatatatatatatatagagagagagagagagagagagataaccctttaggaaggtaggactctgttcttgtgcttgggagtaaggcaaggatatagccaagacaaacagacgggattgctgtttctatgggtcattgttaatgctccattctgtcagcagttgataatgagggtgggcagcatgagatccccagttccagagacctgagcgtcagctgagaaatagaggcagaaatgggaaggtctctgaagctctacagctccagccactatctaagaattctcactcctcgttcactctgtgttgtctgtgctggattggtgtgtgtgtgttggtggcagctgggtgttggggaggaggaggtcagtaaacttcagggaaactgtggaaattgaaagagaatgactggggaggaattccagcagcctagctgagaaggtgggagcaagtattaagttagccactggtctgctgccgtgggatgaggagggaggaggcccgctgaggcacaaaggaaagcatgggctttagaggcagaaaacctgcatttgagttccagc

SEQ ID NO: 1753 - DNA, 1061 bp, Homo sapiens
gacctaatgcttggaaaggctgacgcatgtgataatttgtagtcagtgacttttcggggtggatatacaatttactgaagtgtttgcctcctgaaagatgaggggaggtcactcaccggaagacgggcaggtccttagtaaacttgatgacttgcagtaccatgaaagtgttgatgtctgcgaagtgtgtgaccagaggcagcacaggggccagggtgggcaagggctggtgatggatgaacagatgagctggaggctgcaatgatcagaacattagctagaggctctggccctagggccctcctttaggcctcgccagccttatcttggaagagttccttgctgagaagcctgctcaggctggggttctggagatctgttctcagtatcagtgcatggcatacacccctctccttcagaccagcatttttgggtgcccttttagttgtattccaacccaaatcctgtcggtgctcaccctaaactgcacaaactgttcaaacatggtgcccatgtggcgggtgtgggcccccaggagtgtccggatcagctcttcttgctccttactcagttgcacaggtgtttgctgtgcccgccgctgggcctgctttgctcgccgcaatgccagggcttctgccgacagtatcactgtgccaggcaagagatcatgacaaagctgttgagaccagcagagcatttctctctgctggtccctgatctggggcccctcagctgccctgcacaacgaaggatgggggcagtggggggaattcctgagactttcttgggcttggctaaagtcctagaggctccaggaggcagggggctcctatacacttccaccaacctgtgaagaactgcagcagaaaactgcactgtgggggagaagggaagggtggcgaggaaagtatgaaagatgtgaggaaaggtgcgagggcttttggggaaacagtgtagagggaggggtcttcatacctagaacatcactttatatgatgttttcaaataatccttcaaaaataatcaaataatcctttcaaataaacctttatctgatgttt

SEQ ID NO: 1754 - DNA, 1632 bp, Homo sapiens
ttgctatccaggaattggttgtttttttttttttggttttggttttttttttgagactgagtctcgctctgtcgcccagggtggagtgcagtggtgtgatcttggctcactgcaacctctgcctcctgggttcaagtgattctcctacctcagccacccgggtagctggcattacaggggtgtgccagtatgcctggctaatttttgtatttttactagaggtggggtttcaccatgtcggccaggcttgtctcaacctcctgacctcaagtgacccacccaccttggcctcccatagtgctgggattacaggcatgagctaccacgccggcccttaggaattgagttttgaaggatgagtttaacaggctctgagggaggctctattcagagaacagcatgagcaaaggcatgtggtcaaaagatggtttgctgtagctggacataatgtaatgttcagtgtggcagaattacagtggattgaaaggaatttgtgggaggttaggtccagagagttggccacgttgtgaagtgcgttgtttgcccacagtttggatcttatactgtaagcagcgggaaattgttaaagacttttaggcaggagaatgatgaaaccatgttattttatttatttttcagtaaattagtgttggtgttattgaatgatatgtaagagattggtgcgagggagatcagttcaggagctcttgttacagtcctagtgagaaacgaagaggatatagactatagcaatggattggaatgaattttcctagctgttaatgataggattgggtgatgccatcatatggggggggtggtgaaagaaaagaaatcaaggatgacttaggttatagtttggtagttgggtggtaataatcattaaccagaacttttgtatacaaattattattcatcatgccattcaaagttatatatctattttattgttgctgttacctagacatttatgaaactttttggtataccatcagatcaagtttagaaactcattatattacagtcatataatgtatgactataataagataaattatagtcacatcttgttttggactaaaaatggtattcagtttgatcacatagacttggctttgaataactttttttttccagaaatcaaatttattttcagtggatgagtatttttgtcaccactgagggttttaaaaagaatgtgatgcaaattctaaagacctcggggagaccagtgataatatgttacatatatatgtggtgtattgtagtttagacaatgctttcctgtatgttttcttgtgcagtcccctcagcaaccaataaggtaggtattatcaatcccattttataactgaaaacgctgaagctcaatgactcactcaagttatacaacttattctaagacttcagtcttgatttttttttttttttttgagatggagtcccgctctgtcaccaggctggagtgcagtggcccaatcccagctcactgcaacctctgcctcgcgggttcaagcgattctcctgcctcagcctcccgagtagctgggatcacaggcgtgcgccactacgcccagctaatttttgtacttttaatagagacggggtttcatcatgttggccaggatggtc

SEQ ID NO: 1755 - DNA, 1029 bp, Homo sapiens
atttctctcttctgctgttaaggacctttatgattacactgggcccgtcctaataatctaggatagtctatgttgttttgtttttgagacagggtctcgctgtgttgcccaggctgaaatggcacaagttttctacaagtttttaataaaacttgtggggcatgatcatggcttactgcagccttgacttcccaggcttaagtgatcctcccaggtcagcctcccaagtacctgggactataggcatgtaccaccatggctgactaatttttaaatattttctagaaatggagtttggccatgttgctcaagctggctttgagctcctgggctcaagctgtcctcccacttcggcctcccaaagttctgggattacggctcactccctctttatcttaaggttgtcttattagcaaccttaatttcatctgcaaccttaattcccctttgccgtaaaaggtaacatattcataggttctagagattagaacatgaacatctttaaggagactattattctgcctactacaacttcttaatacttggctgtgcatttcctcaattgcaagacagtctccaaagtacaaccatcacaatgttactatctaaaccgtaggtcccattcaaattttgccacttgtcccattaatgtcctttataggcctaagattgaacctagaattatatattacatttagttgtcatgtctctttttcctgcagtatgggagagatttttagtctttccttatttgttatgaccttgacgtttttagaatgttccttaatttgggtttgtttggtgttttatgatttatgcatttttggcaggaatacccctgcggtaatgctatacttctgtcagtacattgtatcaggaggcatgtgctaatgatttatcccattactggtgatgttaacttttgtcactgtttaagatgtgtctgctagatttctctactgtaaagttactgaataaggatgttgtattaattaatacatattttggcgggagatactttgaaactct

SEQ ID NO: 1756 - DNA, 1011 bp, Homo sapiens
ccatatccatattgctgcctgtttggggatggcctgagagtaagggtgatttttatagatgaacatttacaattgattcagtcaaatggaacactaactttgaatcccagttaagtgaaatgttttctcaacccccaaaattccattattttcattagtagtacaaaaaattgtactcagttatattttgaatttgtcaaaaatgttatggaaaaatgtttttctttaattatgcaagtagctacagaatatttttgactttgccacttggcctgcaaagcctaaaatttttacactccgcccttttacagaaaaaaaattgccaacttctggtttacaccctacaaatttaaccaagagatacctttggatcgcccctgggctctctctatccctgaggaggtaaaatattatctcactccactctcagctatctgttcaaagatcagaatcctatgagaggggacagtccaaagatagaatctgaaaaacaaaagtaaacgttaaagaaatggagaatgggaacttacctggttggcactgtagttagtggccatgatcttgtgctgtttacactcgttgcttggcaactgcagaaggccgacctcctgggactaccaatgagcagaggctgcctttctcttctgcttattattattcacttccttggctcacactgcccccatttgttttctctggaacttagattcatttttattttacagacgggaaagactgagtaaatgtgagaaaattagctgaatagccactactttttttctggcataacctacccctgcttaagaacttccacgggcctttgattggggtttttaaccactttaacaaaccatgtaaccctgagagctatgcttgttggacaacatggtgtaatgtaccacaggctgtagagccagatactggggtttgaatccttattcaacatgggaacataggagctatatgacattaaacaactgtcttgtcttcactaaatttctatcaactcat

SEQ ID NO: 1757 - DNA, 1086 bp, Homo sapiens
gcaggaggcaatagggcaaaggatttcttcctttgtgttgtagatgggctggtgatgatgggaagataaggaatgttataaaatgagtcttcagtagaggagtctagtctcaggcaagaaaattggatattaaatttgtaatctggaaaggaagtagaggaattaactacagttttgaaactagtttttatggcttccagatttcaccttttaaccttggtgctatatagtttctcaaagaggcacatttgttttgattagctacatagaaaatgaagcagaattattagtaaactattagaatgaataaaatagttcaataagattgctggctacaaagtcaacattaaaaaatcagaaatttccaccacatcagcagtagtcacctagaaaatatgagaaaataacatatcattcatgatagaacaaaatcataacatgtctaagaacaagacacagaataaatgcacataacctttgtattgagaaacacttaaaattattcaagggcaagttgagaactaattaagtgaagagatttaccttatttataaatgaggtgatttagtattataaagatgtgaatttcctccatgttctcctgcaagacccatgcgatatcaatatatcaacagaatggcttatataacttgacaactgattgtaaaatttatatgaatgcataagtccatggataatcaacggaattttgacaaaagaaaataaggagactcattgtaactgataactgggggaggggggaagtgtttgctcgagtccacgatgccagctccagacacctcccatggaggagtccagtgagctgccactggatgccaagtccaaggtcaccaactagcttgtagattttcttttcttttcttttttttgagatggagttttgctctttgttgcctgggctggagtgcagtggcactgtagcaggaccagctgcagacaaaactcctcagacaccggattaaagaaggaagtggtttatttggccgggagcgtcggccgacttgcgtcttaagagacgaactccccggaaaagaaattcttggcctttttaaaggcttaaaactt

SEQ ID NO: 1758 - DNA, 1050 bp, Homo sapiens
attacaggtgtgagccaccagcctggcctctagttattttttacataatgttcagcatacaataaaaattaggagacatgtgaagagaaaggaaaatgtgaccaatggtcaagagaaaaaagaaaacagtagaagcagaaacaaatataagccaattgtttaagttcacaggcaagaactttaaaataatcacaattttatttttaaaaaatagaggaaaagatggaaagtagatgagaagaatttcaacagagaattggaatagagacaaaaacttctagaacagaaccctctgaatgggtttaacagcaaattggacacagcaggagacaagattagtgaattcaaagacagatcaataggctgggcactgtgactcacacctgtaatcccagcactttgggaggctgaggcgagtgaatcagctgaggtcaggagtttgagaccaacctgaccaacatggtgaaaccctgtctctactaaaatacaaaattagccgggcgtggtggtgggtgcctgtaatcccagctactctggaggctcaggcagaagaatcgcttgaacccgggaggcgcaggttgcagtgagccgagatcacaccattgcactccagcctgggcaatgagtgagactctggcctcaatacagaaagaaagagaagggagggagggaggtaggaaggaaggaagggaggaaggaaccaacccatattgaagcacacacacgagttgagcctgagaccttggtcaagaaccaaacctaacaatactctggctaaagagtgaggggactgtgggcatgggggaatgcctccccacagattcccatccacgacccttggcctgatgaccacagcatctcagtaatgcttctgtagtccagtatcatttcttctttctgaaatacatacatacatacatacatatatatatatatatatttatttatttatttgtttattttttgaggcagagtcttgctctgtcacccaggctggggtgcagtggcatgatctcagctaactgcaacctctgcctcccgggttcaagt

SEQ ID NO: 1759 - DNA, 1005 bp, Homo sapiens
ttccctggcgactcttcgagcgcccctctgcttctgtagaggggtcgagccatgtcaaggtagaccctgtgtcggcccgtctccctcggatcctccgcaccaatcactgttgctgaatccgacacccggcggatccagtgcggagtctcgaacagctgcggagctgggagctacgggacatgaggagtgcgggggggaagagaagacggcggaggaaaatcccccggcggtgctcaactgcggctttctctctcggctgtgagccggctccgccctccggcttccagagcaagtggcttctgcgttcaccgccccccgccgtttgtggggcggggccgattcataagaatcggttctcaccaatggagggcttagcatgtttaacctcaggatcataaacaaaagacactgctagaacggtcgggaaagtcatacgctttgcttatcttatatatagatttctaaaattccaaaccggggacgcgttggtggtgtagtggtgagcacagctgcctttcaagcagttaacgcgggttcgattcccgggtaacgaaacgtttttgtctttccttctacgaaaaacttttctgagccggagcctccagcgcgctgtgtattcgttttacgcctcaacgaaactgcagcaatacctcactttccgtactcgcttcctgtctttcccctggcctctttctaaacccaggctttttttgaagggattaaattctgatggttctttcctcccttccttcctttgtaaacttccaactcttgaggaatctttgggatcatttcaatcctgggatgagtcttagcttcagaaaggggctcttgtgtcttcacttgcgaggttcattcgctagcctctacaaatcatcacttaagcccctaattattcccggccgaggtcctaggctaaggtcccgggccaagctttctaattagtcccaggccaaggtcccaggccaacctaaatcacgcattctccaaaacagccggcaaact

SEQ ID NO: 1760 - DNA, 1031 bp, Homo sapiens
atgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttctgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgtctccattgtccttcactgctattctcctttcctcctccctaaaaatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcttcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctg

SEQ ID NO: 1761 - DNA, 1056 bp, Homo sapiens
ttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataat

SEQ ID NO: 1762 - DNA, 1049 bp, Homo sapiens
gtgtgaaaactattataacactgagtccccgagaatatcttagattttcttttcttgattagtacatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattct

SEQ ID NO: 1763 - DNA, 1031 bp, Homo sapiens
tctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacagggattacaggcacctgccaccacacccggctaatttttgtatttttagtagagacagggtttcaccatgttggccaggctggtctcgaacttctgacctcaggttatccacctgcctcggccccccaaag

SEQ ID NO: 1764 - DNA, 1050 bp, Homo sapiens
gcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcgtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtccca

SEQ ID NO: 1765 - DNA, 1016 bp, Homo sapiens
ctattcctatcaaactatcaatgacatttttcacacaattaggaaaaactattctaaagttcacatggaactgaaaaagagcctaaatagccaaagcagccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggc

SEQ ID NO: 1766 - DNA, 1059 bp, Homo sapiens
aatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagagttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttatttattttctttctctccctggaggtatttttatctcttttgttttccagtgcttagaacagtg

SEQ ID NO: 1767 - DNA, 1050 bp, Homo sapiens
tctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtccttgactaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacatgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataaga

SEQ ID NO: 1768 - DNA, 1050 bp, Homo sapiens
tgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctgtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacatataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtac

SEQ ID NO: 1769 - DNA, 1073 bp, Homo sapiens
ggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtggaacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaacc

SEQ ID NO: 1770 - DNA, 1033 bp, Homo sapiens
tagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaaagattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttgactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctg

SEQ ID NO: 1771 - DNA, 1095 bp, Homo sapiens
atctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcatatgtctgaaacaagagaaagatggctttcaatgtatggtcattttttattaacaattttgaccagtttctttgctagatt

SEQ ID NO: 1772 - DNA, 1036 bp, Homo sapiens
atagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagttctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggat

SEQ ID NO: 1773 - DNA, 1030 bp, Homo sapiens
aggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgcaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgct

SEQ ID NO: 1774 - DNA, 1028 bp, Homo sapiens
gagttactgaaaacagtagttaatatcaaagtcataagtcatttataatcagccttagaatgcctacagatgtatatacatttttcaaaacacttatactctgccttttctgaagccaagcttctcttggcttattcttacttttagtacttgtgtgctggaaattagaaacctcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatataacagattgttctttgttaattttaggatcacctgctgttaccagctaccacccataacaagaccacaagaccaaaaatgtcaattgtgttac

SEQ ID NO: 1775 - DNA, 1022 bp, Homo sapiens
ataaacacagtcatgttgatggatggatggtttaataaacatctgctgagtgtctgagctgagttctgcaggcatgccctgggcctgtcctgaacctggctgggaagtggacacttggcagattctgggacattttagggaccatcacctttcttttgactttacacttgttgaagctctgtcttgagtaagtttggtgattcagacaagatctctcagctagtttaggattgagcagagaggatgcaagtgttgacttctgtcctgttaatggtccttccaaaccatggtccagttgttgaagagtgggtgagggtggaaaccaggtatcgctgtccattccagctctaattccagcaccaggcagccacatgtcatcttctactccttacagtgctgctgggaacatgttccagttgctagaaagagggatggggtgtaacgggtggagcagctggctttaagtccactcacactccactatgggttctgcagggattttgtgtcatgaatgtgagtctgacctaaatgtcttttttcatagcccagtgtgggcaattggcaacagttataggagctgtggcatcatatcttctacaaatttcttagtgaggattgatcagtgacttacagatggagtgctatggtctgaatgtttgtgtcctccccgaatttttgtgttgaggccctaatgcccagtgtgatgctatttggaggtggggcctttgggaggcaactaggtcatgatagcgtggtcctcatgagtgggatcagtgcccttataaggtgagacagagagatgatctctcttgctgccctgtgaggatatagcaggaaggtctgtctgcaaaccaggaagaaactaaatcacctggcaccttgatctcagacttctcagtcttcagaactgggaggaataaacttctattgtctaacccaccaagtctatggcattatttttgttatagcaaccccaactaaggcactgggtgtgtgtatactctgtggcattagaatatgaa

SEQ ID NO: 1776 - DNA, 1071 bp, Homo sapiens
gtcttagaagttactgtgcacgttatgaagagaacttcacttgcctgcccccactcccaacagctgcatccttttaacaagtacagtttccttagagacgtttctctgcaatattctttgatgttgctacatagatctgtagctttttgggggggctggagggtactcatatatttcatctgttttggaacaggagacagcctttgttccattgtccgaatcaaaatcaaattcatttcatttcttaaatttcttgagctctcatgaagcttcttgcagatatgtataccctagcactagggagtaagaatggagttaaaagtgcccctgtggacagcattaatcaatttactaggacgtaatctaataatcagaaaatgctggcttcagtttcctggggacaggagctcattttatgcattttgttctgtttgcataggctgtctctccagatattgcaggtttccatacattggtcctgtctttatcagattaatgtcaggtggtagcagctagattcatctgtggatttacttgctgctgcttaatggattgcggcctgtgtctgacactttagtctgactgcttggtaagtctttttttaaactggtgaattcttgccagacaatttgccattagtgtttctttctctagacagggatgcatgaattcaggtaccctagctatcatcctctttgtttaaaaggaagggagggagacatagggaagtcaagagacacattatgagccctggcagacataactcaggactcccaggacttcctgctacccctcagctgggactgctgacctcactcctccttgtctttcagacatgccactgagcacattggtgaacaaatgtatcattgtgctccctgaaataaaaaggggggctggtgctctgaaagcaccttgtcaggctgtagctaaagtgccttttagttctcctttctgctaagatcccaactggaacgagttggggctgtacccttccagctctttcaggaaggcacggtacaggaaaaggtgcctagcccaggttgtgtgtgtgttgtatgcacacatatg

SEQ ID NO: 1777 - DNA, 1029 bp, Homo sapiens
ttaaacacaattccccttccccctcttgccagcccttgggaactacctttctactctctgtttctgtgattttgactacttcatatgaatgaaatcatatagtatttgtcctttttttgactggcttatttcgcttagcataatgtcatcaaggttcatccatgttgcagtatgtgacaggatttccttcctttttaaggctgcttaatattccatagtgtatatataccacattaaaacaatccattcatttaactatgaacattttggttgcttctatgtcttggctgttgtgaatagtgctgcaatgaacataggtatgtaaatatctttttgagatcttgcttagaaatttttgggatatatacccagaaatgtgatcgctgggtatggtagtcccatttttaatttttttgaagaacctccatactgttttccataatgactatcattttgcattactatcatatcttccttgtttattgtttaccagagattagaagctaagtgttagaacgaagaccaaactgcaggcctctgattccagatctggtactttccccctctctgtgccaactccttggtattaggtttttccatatattactctctgatctctacaatgacccagacaagaaggaagcttaagggacactccccagaactacaggatggttgtcctgctcgctctttgtttaccaaggatccaaaggtctgagaagttgccagctggaaaaggaaggggaaagtgagagaagagggaatatggctcctttttaaattgaaacatgtttttattttcttttagctgtatagcttagaacaattcacaaagttttcagggaagttctccttgagctggggattggtctgacactggcgccgcttgcttggaggttgctggttgaaggtgcagggtggctggtaatgctgaaaccaggttgctggcattgcactgtcagtccaactgtgtgaataggtgagtccagcagccagatgtttggtatgatttgcattagtaaatatgaa

SEQ ID NO: 1778 - DNA, 1048 bp, Homo sapiens
tggcccatagtatatacccagtggacacctgtacctcctctccacatccctgttgcatggtgactgggcccagaaggcagctagaattggcaactcaagcccttttggtcaggatcctttgctgggtggaagctcctcgcctactaatgcgggtgccctgtggctgaatctggtgaatccatcaggtccaggttgaaaactactgagcagagccctgctgcctctgggtattctgttcaccacccagcccttttgcatttaatgaatgtaaaaaataatggggcagctgctgttccttactctctcttcctgctgcactaagtctctgcctccctggagaggcatttaaccgcacgaaggtttatggtggaaatgacaaattgcttcttcacaacgagctcaccctgctttctaaccagttggaatcacccttgttcatgtaatattagcaatttacctgtctccttaaccactaaccatcctgagaggatttggcattctttgcagctgttaatcctctcatcacctgagggcttattaaataggtggagtgtacatctagcctttctcctacagtgaacagtcattcatgatcttttcctttttactcagcctctctcctcagctgcctgagcccaggataaggcagggtcctcccctctagaggccacagcggagagagctgggctctggaccggggagtccccggtttgactccttgcttggtcaggacttcctcaacataatcgcctggccctggtgccagggtggttgtggggctgagggaggtgcctgtgcagcccatttccctgtggaggtcagttgcccctttcctttcccttcatcaggctcaggccatccttggggcagccctgctatctgagggggtctctcccgagccgctaagacatagtcctcattcatattgggtgttgttgacaatcatcccatcctctgctgcttcattttgtgacttgtggacccaagtgggtctttgtttatcctgatccaggagagctgggaagggagacagtttgaattgctccgg

SEQ ID NO: 1779 - DNA, 1040 bp, Homo sapiens
agccccaaggttggggcttcagccagtgagatgcttgatggtattagatgggaagatgctgagttgctcagtgggagaaacttccccaggccttactcagcctacccactatcttttacccatcaccagtaagacctctctgtaaagcaaaccagaagtccaagttcagatgaacccatgacgggttgtggggagagggacaagaggagacccaagcacccaccagtaaatggcaactaaagaggaaacttgttgagcctatactggagaagaacacatcttaaattttcacattttgtgggtggtagggtagctgtagcagtagaaacatacattatgagcatcttggctttgtctgaattttgagaaatggcagtcacagagactcttctatatgcatatcatcccttgacacaaaagaatggctatcccagtctggagtgggggatgtgggcctgtgaatgggtgtgccccaagtccacatgatggctttgctattgaaaccctctagatggccatgactctgtgttgccaaattacttaacattgcaaactagtggcctacaggaataatcttgatgaggcgggtggtttaagtggaatgtcagcaggtggtcattggagattattgtcatatatcactattttctgtgacccagccaactctttggtatatgtatgtgctttcccttctgtcaggtgaggaaaggttttttttgttgttgtttgtttttgtttgtttgtttgtttgttttcatctcaaggttttgcatagattaaccaatggatggtcatgaatcatttaaatatgaatcatttaaataactatgctgatgttgagactgagccttgagattctgctattcaggcagcaaacttctctgcctgctagttgagtgttattcttaaccaaacacaagttcacccttgctcaataggaggttttttttttgtgatggggtctcagtctgtcacccaggctggagtgtagtggcgcaatcttggctcattgcaacctttgcttcccaggctcaagtgat

SEQ ID NO: 1780 - DNA, 1023 bp, Homo sapiens
ctggcagtacagtgcaatttccatgcaaatgtatttcaaagtgaaattgcaagtcttgcaaaagatgtaggattataggtagtcaataaaaggattgctggagaactgctcaaacaacttaacagacaaaagaggactgggcagggttagacccactcataattggtgagaaaaacaatcagtatgctgacaagaaactgacttcaaaggagaaggatttgaatatctttgaatattaagacacacctttgagaaaatgaaagctcttaaataatttctgcaaaaattatgctctgtatagtaatgtcatgaaagtcagagatgtagtaaaggatgtcatgttattatgtagtgatgttggaaaaaaattacaacaataaatcaataactcagtctagcctaagaattaatgcaaaattcaatatgatctaaatatttcacattttaaataaggttttacattttagataagcttatttgcataatttttacttcattttgaaagattaattctgtcagctcttattttttcactattgtgaagttctggttcttatttttaagggcttttctagtaccagctgccccctggataacagttatcaagggccttttgaattagggggtgatgttgacatgaactgctcactggagtggatgcttcctgatggccaggaatgaggggattgatttgggcacttcctttgtaggatggagcccaaaatgcccaatttatttcattcatggcttcacaagccatcagtatctcagatgctcaaagatttttgttcagtactctccttgtatcagacaggaaacatggtagaccactgagtatggtctgagttgatttcaagtgtatgcaacatcttttctggggatgacctaagaaggccagctttatgaaggactctggagaattcctggatagagttgaaaaaagtcccacttgacatttgcattgggcttgtatttttcacagtgcttctatttacattgttattttaatcctcagagctgtac

SEQ ID NO: 1781 - DNA, 1076 bp, Homo sapiens
aaagtagcaaagttttttattctcttgtttctgagtttgtagatttgactctatgggttagtcggatctgtgagaggatgggaagaccctataatctagttcaggagttggcaagctacatctgcaagtcaaatctgtgtcttcccttcctgtgtttataaataaagttttatttgacacacagccacacacatttgtctctggctgccttggcagagttgagtagctgtgatagagacagtctgtcctgaaaagcctaaatatttgctatccagccttgtgctgaaatagtttgtcaacctctgaagttaggtaagccttgttatcataagataaggggattgtgagtttttgtatcacaggaatttttttgttaatatacaagtaggcattcttgatgatcatttgcaaattaagtaggaaaggagagtgaaaatcacctattgcaaaggggccatgcagtgtggctggcacatgatattgttaccagacaagccagaagaccttgtagtgtgaccatgggcaattcattttacctcattgagcctcgatctctttgagtgtaaaatggagataaggtgacttgtttctcaaaacgtggttgcttggatccaatgaaataaagccacgagggcatcctataaatggtaagagggctgtataaatagaaggaattaaccagcacccatttgtgctgttgcagctgctgcagatacgtgccttgtaaaattaccctattatttagagaccgagaaatatttggatagtggtaatgtgctgctctgagaaaagcagtcgccagtgggatttttatcacataattagagggtttgttaaatgtgctagtgaaaagaagctgtttgctgctgccttgttttaacatggaccagggatcctgagccttctccctgaggagattctataccagcatccttgctccagtctcttttgtggtgctggcttctggccagcagaaattctgggaagttctagacgtagtgccagaggcacagtggccttagaaacccttgtaaaatcaccgtctacccacgcgacacctccgctttagacagcta

SEQ ID NO: 1782 - DNA, 1050 bp, Homo sapiens
ccagttgttctagccctgtttgttgaaaagactgttctttctccactatagtgcctttgctaaacatcagttatccgtctctgtgaggtttatttctggactctttattctgtcctatttgtctaattgtctgtcttgacactagtaccacactgtcttgattaccatagtttaataattcttgaaatcaggtagtaatagtcttctttcttttttaaaaaagtttttttattcaattagtattagtatcgtatgtctttttccatccattcacttttaggaagaaatattagagggaatggggaatgccaaatacattttaaatgttaaatgaatttttctttggcctcaaaactcacacagtaggctctctgattgttgatagtcttgtggatgtctttctagtctatcaaaatttagcaacttgtgtttaaaaacaaagaaataaactttagtccctgtgttttcggtgtcctgggtactttttttcatgtattaaattgtgatgttttggtctgtgtacatgtgaatttttatatctgtgtgtgtgtgtgtgtgtgtgtgtgtgtgtatgaggacttttttctaaaatatatatggtccattttatcatgaacaaggttatttattatgataatatggtaacatttacaaatgagcttttcatgggtacagttatttttctgccctgaagggaccactctggtttgattcactagctctgctgaagaatacatacaattgtttgtggctttatgaaacgctggcttactgaagtgttcattttagacgaatgaatttttaattttttattaagtcaaattttttatttaaatcttttgcattattcacatagaataacagaatcatatattttttaattgtggtgaaataaatatatataacataaattttgccattttaaccattttttaagcatacaaatcagtggcattaattacattggtagtcctgtgcacccatcaccactgtttccaaaacttttttatcactccaaacagaaactctgtgcccgttaagtagtaactt

SEQ ID NO: 1783 - DNA, 1040 bp, Homo sapiens
catgatcaaaccatgattaactgaggagtcctctgtatttggcttaacatttctgcctgtcaaattcttattaatctttcaacgtttattgtaaataacacatccaccaggaatgctttcctgatttcatccctacccccacagtggggatctaattaaggtttgtcctttggaccctaaggtgctatacagcccttaagtttatccttttattgtagtttatctatcatagtttttagtaggaactgtatcttatctatctttggggctccttaaccacttgtctcacacacaatagggctcaatacgtatttattccatgtaattgacttattaaacttttgcacaattcccagaaattaattacactcattctgtagacttttattcgggactgagtggatgaatgaatgaacgaacgaatgaatgaaccaacccacctatataaaaaaagtgtgttgagcactgaacacagcccatatgtgaaggtatttgagaacagtggcaaaaaatgttaacattagaacatcagaacatatattctaatagaagataacaagcagcacacaaataatactaaaaagacagcatcgcagttgagaacactgagaaacaagaagtcgaatgactttgttcagctttgctcaggaagagagcccagcacctcttgatgttgtgggtttaaccactaagcaaagctgcctttgaaaatgcacaccctccttcctctggttggccgaggatgccagtcctgtccagctactgctgtgcagttagctctttgctttagggcctgattatcttttctcgtggattatcttggcctttgactgtcttacatgtccatgtgaagagacccccaaacaggctttgtgtgagcaacatggctgtttatttcacctgggtgcaggcagactgagtcccaaaagagagtcagcaaagggtggtgggattatcattagttcttagaggttttgggataggcagtggagttaagagcaatgttttaggggcagggggtggatctcacaaagtacatt

SEQ ID NO: 1784 - DNA, 1009 bp, Homo sapiens
ctaaagttagggaaagagtctgttttttatactttaggttgagttgggaagtcaaaatgcaggaatcatgggtctcagaactcatctagtctgaatcactctctttgtggatgagaaaatcaatactgagaaaggagaattaactgtccacagtcacccagttggttctgacagcactgggattgtaactcagacttcttttctctggggtactaagtttcatggactagcagagtagaaggaaaaacacagctatctgttggaaactttaagatgcagtatgtcctgtcaatgtagaaaatcacacctgctttgaaactaaactttccttatactgagcaatattctgatgtccaaggcatcacctcaaccaaattatataatcaaagccacaaaataatgtgttggacaaaaacctaacccatctaccatttcagagccttagtactgtagatcctactgtatgtagaagtccaaatataaatgtattttcatgctttggcattgtaaattccatagattaagatcatttgatagatataagctgaatcttttactaagattccccccaacccaaaaaaatacattaaagaaacatgacattcagttctgtttttgttgagattctgtggcagttaaggtcaagacaaggacattatcttgtattgctgtgatagataagaattataaatctgtgagctgtcccacagctgacctcatggacttcagttctctaaaattcagaaccacttgtcagtcaaatttgagtacccaaaagagatgggggagagggggagtggaggaggggacaggggaatagtaaactagagagctggtagaccattaaagaaccttacttgaaagatgtgtgcccccattattctcttttctcctcttattattgtcattgtcatcatcatcttcatctggtattttgtacttatactctctacttgcttatctggtgactcttaatcctctttgtaagttgtaaagtaaagagagagct

SEQ ID NO: 1785 - DNA, 1026 bp, Homo sapiens
atttctaacttctgtagttctataagccctcaatatggatagtattttaatatccccaactttcaagcctcattaaaagtcaggaaggaggccgggcgcagtgtctcaagtctgttaatcctagcactttgggaggctgagatgagcagatcacttgagcccaggagttcaagactagcctggccaacatggcaaatccctgccatgttgcctgtattttctactaaaaatacaaaaattagccaggcgtggtggtacacgcctatagtcccagctacttggaaggctgaggcaggagaattgcttcaactcaggaggcggaagttgcagtgagccaagattgtgccaccgcactccagcttgggctacagagctaggctgcctcaaaaaaaaaaaagtcaggaaggagacaataaatgtgaaaaaatgaagtatgggcaagaaaaagagcagataaaaaaaatattgtttatgttaatttttaacatgggaaacccaagaaaataaactgagaactattagaaataataagagaattcagctagaaagtcaaagttcaataacacatacagctatatttgtgattttcatatattccaagaacagctggttagaagtcatagtggaggaaaaaaatccattaaaataacaattaaaaaaaaagatacttatgaataatcacaataaaaatgtgtttgttacctacgaaaaaatcttaaacaaatggaaaggcatgccatattcttggatgggaaagctcaacatcataaaaatgttaattctctctttgtttatctataaatttaacatgacaatacagatttcttttctttttttcttttattattatactttaagttttagggtacatgtgcacattgtgcaggttagttacatatgtatacatgtgccgtgctggtgcgctgcacccactaactcatcatctagcattaggtatatctcccaaagctatccctcccccctccccccaccccacaacagtccccagagtgtgatgttcccctt

SEQ ID NO: 1786 - DNA, 1098 bp, Homo sapiens
tacctgccttatactcagaggcatattttcctccacattcccccctcagaagatctaccgtcaaagaagcctttaaaactgcagagattcttccccatgcaaataggaaagggcatccagccccttcttcccagggtggggcaaggactgaccacatagggaccaagcagaggccagaatcctagagcagtgcttctcacagctgagctgcatcagagtcacctggagggctggttaggacatagaccgccagccccagacccatagtttctgattcagtaggtctgaggagggcctgagagttcccaggggttgctggtactgccagctgggcacctttgagaacctctatcttagatgattttcccaaacttcaagtattgtctttatttttaaaagagagaaaggggagggtgtgtgcctggtgttgctaggcaaccattagccaaaggtgatgagagccgggttctgggaaggacagcaggctgtgcggggtgacctcagactggacagaaggctgtgactaactttattggcatctctctagagacataagtaggcttcaccgccaatttgcctaaggtgttcagcaggactattgaaggcctggcagctgccggaggagagcctgtctcccagccgggccttctgctccttgctccagagggctttgagcttgcggtagtacaccttgcagctgaagccctccctgaagcccctcttgatgtggctcttgaggaagtccagggtggggtacatgcggcagcaggccacgcacttgtagccattctgctgtgctgggtgccacctggaagccattaggatgtcctgggatgtgatggagtccaggccatgcctggatttcttggtggcttctcgagggcaagtgttctctggggaggaagaggacgaacagatgttctcagccatgtcctcagaaaggcagttgtcccacttgccctcatcctgctgcacctctgggaagtcataggcctccagctggctctctttgtctgcacacacgaagtagctgtagggggagaaccagggccggtagatagtgcagttccgcctcagcttctctccgtgctgggtatc

SEQ ID NO: 1787 - DNA, 1434 bp, Homo sapiens
tatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacatgcccttagaaggaagaactattattttttattttggccctttcaggagttgattataaattggtttgttttcaagtcagaattcaagtgggcagaacccgtattgtgaagacctaaactttcctaaatgttcatatgggtagcagattttgtggtgattagaaacatcaggtccttaaatacgatgaacatgggatacaaaggaattctttataagggcaagtatcctaagttagcacatttacttttctctcccctccgcccccaaaagaaaaatccttacaaataaactgcaggtaggcttctaagcctagtcctgcagtatgctgctaacatcttgatgccaatcttcacagcattctttgattgtcatcttattgctgatacattcatacatatatttagtgcttgacactgtagaattttgttacagaagatggttactagattttaagggagctgagggaataattgatgagccttgaattaaccatgcatttaattagattttttgttgttgttgttgttgttttgagatgatgtcttgctctgttgcccaggctggagtgcagtggctcaatctcggctcactgcaacctctgcctcgcaggtttgagcgattctcctgtctcagcctccccagtagctgggtttacaggcgcttgccaccacacctggctagatgttttatattaaagccagagaattgaaaaagaaatgcctcctgtgattgaaattattttatagctcttagcccgttctaccaaagatcacattagcagattacccctccctcctgtgatattatctttcttaaacctgaaccaaatatcaaaagatacaagtttcatgattaggatgaaatatatacatagggattttggtttattgaagttattgaaagacctagaaattttctttttgagagaaagggtaaagaggtgagggttcatgtcacttaacccctacccttttgg

SEQ ID NO: 1788 - DNA, 1045 bp, Homo sapiens
ccattcttaatcacagaagaacatggatattttagtttttggagtacccagaattgtaaagattttgtttcattttgttttaggatagcttctctgcctaatactataggatatgtcatgttcgttattgtagccacctccctcagatgtttttcactatttttaaattatataatgaccagtagattcacagtagcatgtacttgacaagtgccatggatatttaagaagaaggtaaataattttaatattttttgctgtaattttataggagcagtggactgtaagagaaatatctataaatcagagagtatttaggaaactttgtattttataggtggtcattaaagtgatcttcaggatataagatagtttacacaaactttattctcctgataggaaatttttattcattttcctaccactcagcacttttgttctgccttgtactgcttatgaggattaatgttttaaatttgctttatttgtgcttttcagagagttgtcataattgtggcagttgtgtttgtggcactgtaaatgctgaaattcatgggaaacttaccaaatgactgcttgagtgttatttcccattaaattgggtagctgtcacaataaccagaagaaatcttgtggcccttttgaagaaagccatgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctg

SEQ ID NO: 1789 - DNA, 1050 bp, Homo sapiens
ttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaatatcttaaataatttaacattcctttataacttcttaacagtgtcaaaactggggtagaagggattttattttttcccaaaagggttccatctttgctatctgttgatcagccttagaaaatctaagtatgatcaataaattttaatggttgatggcatcctgtgtcagctggagtagttggttgtgaatattaaaacctagtactattttccctcagtaacatgtaattgctacattttttataagaaggtatggttagaaaaaaatgtgaaagatcacttaaaccaaagccagttacaaggagtaatctctcctgttggtttaccttcacctcagaactacaagaatattacaatacatagtgaatagttgtctgtaacatttctaccagttgtttcagtagcatattggtcttggcatttcttggcactgtggttctgctg

SEQ ID NO: 1790 - DNA, 1086 bp, Homo sapiens
cccgccatgagttttgatgggaaaattattttggaagagaagaacaaagtttctatggctccaggtttgtaatcatccttatttaatggtgactagaaaggataacaacataaatcatcaaatgttgattttctttttaacatggtgattttgatatttaaacattaatatatatgtgttttttgcagcttggaaatgatttaaaaagatgaaaatgcccgttggtgtaatggatacacttttatgcttgttgtgggtgtctgctctatggagcaatttgaggagcattcagggtattctttctctataacaagtattttattttttattttttacaatttttgagacagagtctcactctgttgcccaggctggagtacagtggcgcaatctcggctcactgcaacctctgcctactgggttcaagtgattctcctgcctcagcctcctgagtagctgggattacaggcacgcgccaccatgcccagctaagtttttgtatttttttgtagagaagggctttcgccatgttggctaggctggtctcaaactcctgacctcaaatgatgtacctgccttggcctcccaaagtgctggaattacagccgtgagccaccgcgcccagccatatagcaaatattttatgtatactgcaatgttcatggctacattgtttattatagtgaaaacttggaaaccatatgctatttaataaatgagaggctaaattatagtttaaaaatagcattaattcttaaatagcattaaaataattggtggcattaaattctaaacattatttcagcaagttaagtaagagaatgcaaaatgaaaaactgcatacagtctatgattagggccactgctttgcacaattccaggtagtgcatacacatcatggtttgttaatgggacccactagaattggacagtgtattgcctgtgtagccacattcagtgaccctgagtacaacctcagtctataaaaatagacctactgacagatttatgtttatgagaatctgtacttggaggaaaggctgaaaagaaattaatagtattaacagtggtgctctctagatgtag

SEQ ID NO: 1791 - DNA, 1041 bp, Homo sapiens
agtggtgactggaaaataaacctgtgtgcgttaaaaaaaaaaaagagagagaataaggggaatctatcccaaattccctgcctagtaagatacccactgtaggtagagtacatgaagtaagagatggtgatgggttggtagataagaattgtaaataggcccatgattgatttaaataatttgctgcataatgttccccttcagtttaatctacttcctcggtagaaagtttcttttcattaagaactgtgttcctttcagggtggcaaacagtgaaccacacaacaggcttacttatccagcagtcctgcctcactgagctggactcagtgcctatatctctaattgctgtgtaaatgaagttctcaatagtggctttagttttctggatgagactgttactgactgtatttattttaagaaatcagttgttgaagaaaagtcttaactttattaatataatttcatgtctacttaggatagacttgtcaaattggggacagagttttaaacatattttgaagcatgctgaattgataattagactggacaaacaaaacaataccttcaaatagatagggatttttgagacagggtcttactctgttgcccaggctcgagtggagtgcagtggtgcaatcacgtttcactgtagcctcaacctccccagactcaggtgatcctctttcctcagtctccctagtagctgagactccagcatgccaccacgcctggctaatttttttattttttaaatagaagccagggtttcaccttgttgcctaggttgacaaatattttttattgtttgtttcttcggttggatatttatcttatctgaaccttgattttatattagtgcattgcatatagttcttttataattttcttctaaacacttaagtcagtgatgtgtgggattagtgtggtggcataccaaaatcacttgtgaggtttttaaaaattacatattcttaattttccctctgattttagtataccctcttttctcagctccccatcagcccagagccattgata

SEQ ID NO: 1792 - DNA, 1031 bp, Homo sapiens
aaagagtgaagaaattacttgacacctgcatgaaaattagcgggtagtgctacaaaggataaaataagagctattttatcccaccatagttttaaatgaaggacattctcactatcgatttcacttagcttttagacattcaagatgacttgtctactttttaaaaagttaatatgcattactttagaatatcaactccagttccaaaatatttcccattctatgccatttgtagctgtgttactgtttcatccatagtaacttaatgcgttttttaatgtacatatatacagttttaaggcatttgtaatgaatacagttttaatgcacacgtacacagttttagtggagactgttatttgatttttttttaaatataaagagatgattgggggaaagctattcatttactatttaaatatgaactgaaacttaaatgctcttcactttgaaaatcttagtattggttgttgacacatttgctcctgaatgttgtaagattttctggcattttaaatctggaacgtgattatatcttttctcctcctgcttcttagtgtttatgaacctcagttgcagcaccatgtggctcaaaagaagattccttatgtggatacccaaggacagttaattaagccagacaaacccaatggaataaagatggaaaaatttgtctttgacatcttccagtttgcaaagtatgctttgaatagtaccaataaggttaaataaatgtcttaaaatgctgcttttcactctcttaggcatgaaactgttttcaggaaacatttgatagcacatatctcacatggcattttgattgtgagtatgtagtctagattcattatagttctctggaataaaaccaggagtgtgatctgagttgcctatgagtacaactttttttttttttaaatcaactagtttctggctcctataaagtttttttcatatgtatattaaatatatatattatatatatattttatatatataatttatatatttatataatatatattatatataat

SEQ ID NO: 1793 - DNA, 1444 bp, Homo sapiens
cgaattcctgacctcaagtgatctgcccaccttggcctctcaaagtgctgagattataggcatgagccaccacacccggccacattaattaaattaattaattaatgtatttatttattttcgagacagagtctcgctctgtcaccccggctagagtgcaatggtgcaatctcggctcactgcaacctctgcctcttgggttctagcgattctcctgcctcagcctccggagtagctggctttacaggtacgcgccaccacacccggctaattttgtatttttattagagacagggtttcaccatgttagccaggctggtctcaaactcctgacctcaggtgatccacccaccgcggcctcccaaagtgctgggattacaggtgtgagccactgcacccagccacatttattttttatatgaataaatggatggagacaatcactatgaaatgcagtggtcaagagaagattggggcttgagccaaatcttggaggatgagtatggtttttatgggaccatagttgagaatgacttggaataatccaaagagtgtgactgatctggtttgagtggagagtctcaggataagtaaggtgaagtaggatagagagtgctttgaatgctagagaaaggttgacctgtagctaaactcagaagccctctgatttttattgactccagcaaagtttgagactacgtacttggggaaagcacagaaagagctatggtttgacaagagactaatatttttgtgccctgtgtcttattggtaagattcttgaagtggcaaataacaaagaggtctaatgactgcaaactcattgactatttattgacttttgtgttagataacttagaaattcagaattgctgtaaatgttaggttgtgacctagatgaaacaaatagggactttgaccttgccttcgcttgagtgcattctgccttagctctttaaaaagggacttttggtaacagagaagtactttgaaacatattgaataaattagctcagctaatctaggacatttgggttgtacagaaaaaacatgtactgggaaataatttaactgtctgatagaactttctgcagtgaaggaaatgttgcatatctttgttgtccagttttgtagtcattggccattcatggcttctgaacactcgaagtgtgattattatgactgagaaactgaattttaaattttaaattagttttaaaaattttaattaaatttaagtagccctgtgcagctattggcttctgtattggatagtacagctttagaatgtttgtcaacattaatagtaccaaggtagtggtgaagattaaaatgcaatatgaaggcttcagagcacctagcattgggcttggcatatagtatatacctagtaagtagtcacctttttatcaaattgaaacttggaaatggttaaaaatgagat

SEQ ID NO: 1794 - DNA, 1027 bp, Homo sapiens
ggcacgagaattgcttgaaactgggaggtgggggttgcagtgagcataggggtgagactactccgtctcaaaaaaaaaaagttaactctgtgagagatgattataggaaaaatgtttatcttattaactgtagaaatgatcagagtaattttctttttatatttttgttttatgcttttacaagtcagtcattaagtctactctaaaatgtctattaaatagattttgacttttatattctgcatctcaaccttttttggcatttgtgctttaaatcatcattatagcaagtccagcactgcatgacaagtgcaaattttctaattgtgtttcatttcaatcctctttttagggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctggagtgtcatttgtacttgaagaaattatttcattgagaaaatatgaaacttgggagaaactttaagataatgcataaaaacaaattgatgcttcagtgaggttgcagagt

SEQ ID NO: 1795 - DNA, 1031 bp, Homo sapiens
aaagaagttgagggtggagagtcttgttaggagggccaggataagagcaggtgggcggtgaaggaggctgcggcagaaccatgccaagcagaatggagtggaggggacttgactacacaagaggctggtgactcagctttctgcctagtattagtcctagagaagtctccctgctctgggaagaccggtgtctagcctcatgtggcttcggaacaaaagccagtgattgcatccaagggaagataatgagaaacacacaggccgtgaaaatcaggaaagcaccactaatctttttgttgcaaaactttacttttcaaagtcctggggaagggtgcagaagcctcagcacgtggacttgagccctgtactcggaaatgcaaaatggaaaccccctaatagatcacagaactgaaaatatccaagagtctgagaggctgggggaggacaggagtgagaaaaggaagggggctggagtactgatcagaagataggagaaagcaacagtgcaaaatgcggggaagggctgagtagacattcaatttaatctggacttttattttgctacaaactaattttatgaagactttttttgcccaaatattaaatatttattaattaaagatattaaaacaggaaaaactgctttcattcaataaaaactctagtaattcttcctaactccagaattgtatgtatatgttttacctattaaataatcagaaatagaaacaaattagacaagatacgtgaataaccttaaaaattttccataatatttgacttaggaactttagttttatgaatgtactctaaggaataccctgaaaaggacaaaatctatacacaaagattatacacaaatttattatagaattatgtactaaaaaaccctaaatgaccagccttgagtatatggttaaatatataagttataagcctttgggttttgagagttttagataacacaagaaggtatttatgatattatattaaatcaagataaaagtcacaatgtaatataaagatataca

SEQ ID NO: 1796 - DNA, 1031 bp, Homo sapiens
gagccattgcgcccagccagtaccacattttcagtctcagtcatgatcataattatttcatggagactaagttatgagtacatcctgatatgtgatcgatcagttggtgctgggattacaggtgtgaaccattgcacttggccagtaccacattttcaatctcaatcatgatcataattatttcatggagactaatttgtaagtacatcctgatgtgtgatcagttgcactgccttacgttaaggtaactcctttgacatttgaattcattttttacatctttcttcacataatgaattcattaagtagataaggcaagtagtgagtgacatttaacaagtgaagaaactgagacacagaaataagggtaatatgcctgggaaggtcatccaatcttatattagttgggtgggtccaagaccccagggcttctccctgcttcctaaggggtattttttttccctaggccagtaaagatttgttcacaccttcacagtaattggcatgtaatagacatttgatcaatagttggtatatgaaggaatagagtcctcagatgtataactcccctgaaagtgaacacaaaattgcatgtaggtgcacaatgcatttttctgagcagagagggctttttatttatttatttgtttttaaattgtaagaggaatttatgatgaaaaaagtccaagaaccctgcactagtctatgctgccctagggctatctggaataattaattttcaaatattgaggcacttaagagacaaagaactaccttgtttccttggacagtagaatgaaatgggtagaaacaaggaaggctttcttgatgaagatgtttgctgaataaaaatacttcacattttatgtgaattgataatcatttgcatttgcctgttccaaatgcacaagttacaaagtgaaagctagttttcttcactccagctcttctcagtgtggccttagtcctttgtaaatgtggtttctctctccagtactgctgagctattagagttttctaccgcatcttaa

SEQ ID NO: 1797 - DNA, 1045 bp, Homo sapiens
ttaaaaatctttattaagcacctactgtgaacctagcattaataatgatgaaaactctgcatttatactaggatatgtattaaggtttttaatttaatgatagtgagttaatatattttgatcttggttgaagatttttctcattttgtctaatcaatgtgtaatgtcgattttgtggtttattgcatttagatgccagtgaactctgaagtcatgtatccacatttaatggaaggcttcttaccattcagcaatttagttactcatctgtgagtaaagagtgattttattgtcttcgtctacattcgtatttatattacattaagttttcttaatgacatggttttctttggtaaggaatacctactatgttccttttcatttcatcccatatacattcattcaaactttcaaaattgtagactgtcatcaaacagaactgcctccaactgtgccactttctcagcatattttcaattgaacttctaagatactgtaagtcgaaaattgtttaccgtctttgtgaagaggtttgagttcttaaaagagtcttagtgtcaccaagtttatgtactatttattagaatctgtaactatactttagtattgcatgactacatgattaatatacagaaaaaatagatttcagtgctatagggttatacattatagtagaattctggcttcgtccactgaccttaagaaatatatccagaaatctctttctgaaaataagatgtttatatcctatagcttagcatttaatgtgcaaaatacttttcaatagtctttttgtacttcatcttcaagggactcatttttgcctatctgccgggtgaatgactttgagactgctgatattctatgtccaagtaagtgagaatttaaaacagttttaatgtctggcttcgatctaccatttcacctttccatcagtaaatgtaaaaaaaaaaaaaaaggaaaaaaacaacttcaaggaaattgcctttaaaaagtatatcccatttttaagtatgaatttttaatatcttgttgaatttctttt

SEQ ID NO: 1798 - DNA, 1045 bp, Homo sapiens
tttctcatttcaagatcttcaattatacttataaagccactttgcaaataagataacatgcacaaattccaaggagtaggacctgaacatctttgggtgctattattcagcccaccacatggtctacccttgtaaaagttccatgagtgctgttgttgatgagtggagtgttttaaacatgttaattggatccagttggttaatagcgttgttcaagcctactgggtccttacagacttttttcctggttgttctttgaactgttgatagagagatgttaaaatcttcagctatgattgtgagtttgtctgttttgtctgttcttttaatttttgttttatgtaccttgaagctctagttttagaagtgtacacatttagaattgctatatcctcttgatgacatagtctttgttctgaaatatacttgattttatattaacatagctacttcaggtttcttttcattagtattaccatgccatatcatccttgtaacttgtgcctttggattcaaaacgggtttcttgtagacagcatatggttgggtcttgctttttaaattcaacatcactatctcggtcttttaatcggagtcttagaccatttacatttaatgttattattgatatgattgggcttaaatccacctttatactatttgttttctctttgtcctgttctttagtcctgttttctccatttcctgccttattttggtctattaaaataaattttattttatataatactatatatgaaaaagatattctaccttgtctgttattggcttatcagctatatgtctttttaaaatggtatttgctccaagtttcagtatacatgtatatatctttaacataccattgtctatcttcaaatatattataccttacaataatatacttttattttctccactactggtctttgtgctattgtgtcataaattttacttttacagatatcataaacaccttaatcgatattagatttgtgtgaaacagttatcttttaaaggattttctattttgacatttaaaaaa

SEQ ID NO: 1799 - DNA, 1033 bp, Homo sapiens
tttttggtttttttttgtttgtttttctgttctttcttccctccccctacacccctgcccgccatttacgtttgttcactttcttggatatggttattgtttttatacaatttggaaaatattcaactattctgtaaaagtctttttgtccctttttgtaggattccaattacacattagttatgctgtttgatattgtctctcagctcacagatattgtattcatttttttctctctggactttattttagataacttctattatgtcttcaacttcatgaatcctttttattttaggtctgaactactgttattcccatcagtgtaatttttatttcaggtatttttcaactctaaaagcttaattcagatcttttttaaaaaatctttgcttttatttcttcatattgctgattcttttctctatcccctttatttatttataaaggttgttttcacattcttatctactaaatctaccatgtatgttatttgtgttatgttttaatatgtttctgttgattgattgtattttcttattatggatcatgtcctttttcttggcatgtctggttatttttagcagatgccagacattgtgaattttaccttgttggttaactgagaacctgaggggattcctctacagatttccagaactctttctctttacagcttcctcatcttaatactcagttccataaatcctagttgctttggcttctgcaaactctaaactctgtcttcttgacccagcaagatgtacaagttttatttgtgttctctttctctggagtacagcctgtaaactcttcagtcatggactggtgcagtaatggaattcacctcatttgtttctcttggagattgctgtcctatattgccttttatccagcatctaaaatttgttgcttcatgtatttttgtttttctagttttttaatatgggagggtaattctggtttctgttatttcttcatgaccaaaagtggtttacctttttttttaaagttattaatacaaagataattt

SEQ ID NO: 1800 - DNA, 1025 bp, Homo sapiens
tatattttttgcccattaaaaggtttatgtttttatgtagtaaaatttatagatacggcctttatggtttttggctttaattgtgtacatagaaaggacggtcctattcgtcagattattttttaatactatattttctcattgtacttttatagtttccttattgttttaaaatgtatactttagatccttgagaaacttactctggtgttatatttcccttatttttctatctttttttttgctgggaaatgctttcatctgagtagtacttactatggctcaattttattgtttatttatttctgtctcatttaaatccaagttaaaacaagcactttgtacttattaagtttagaccttttataaagaggagaaaagtgatgaaagttaacactattgtaaggaaaataacctctaatcttgtagagcattaaaagagtagataatgtggtggtttgcagaactctaagaatgaaataacaaaatatacagaaattacaggaatgcattatatctaacattcagttttggcgtctgagttagctgatcaaaaagtaagaatcttttcttttaagttaaaaatatttagacaaattacacaacacagtaatacattcctgttatgaaatattctctctttacatacacacacccacacatacatatatatatatgtatgtatatagagagaggggagtatacacacatatagagagagacagagaagggtacgaaatgtgaaaggccttctctcagcccattttaccttgaggtaatactattcccttcctttttccaacatcatatgcatacacatatagaggcacataatcatgtgtcactgttttgttgttctgtttttatagaaatgtatttatgtgttatatgttgatctgtgaattggttctttcacttaatatatctggaaaatctttcctgtcaatacatagagtcatagagggtccccaaacaatgtaaatacaacttatcaacaaatatctgagaagaaaattcataggaat

SEQ ID NO: 1801 - DNA, 1051 bp, Homo sapiens
ccttttaaatgataatcagggtcaaatgcagagagtatagttatccacagtaatgtagttattttccatgtttaacatggaaagctctaaagtaaaatttttccttgataattataaatatgtttgttcttattgtattagaatcctaaccattgtctcatgtcgctcctttgttccttaagtagcaaactttttgatgtgtttgtacaacttacagaatgaatttttaattaaagcagacatagacatgcacatttgtgtgtgtgcataagaatttaggctttaaaatattaataaatatgaataaacttggaattcttataactcatttgtagtttaggttgttgcatggaataattattattctgtttcattttctacttaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttactatcatggctgttgttttgtttattgacatagagttgtggcattattgagtccggactgtgccctcagcattgtggttgagatctcatttgatccttacttaagcaattctaggtagatatttttattactacatagataaagtaattataaaggtcctaaaagatcagatagctgaagcaaaatttgaactgtactgtctatgatactgaagtctacaatgtttcagtgtaccacagttt

SEQ ID NO: 1802 - DNA, 1029 bp, Homo sapiens
atcatttcacaatgtatatgtatgtcaaaacatcatgttgtacgtcttcaatacatttgctgaaacatttttatcgaggtaaaatatacttataaaattttaccatcttaaccatttatttatatcaattgaggcggctctcgtggaggcagctagcgcgaggctggggagcgctgagccgtgcgtcgtgccctgctgctgcccagactagcgaacaatacagtcaggatggctaaaggtgaccccaagaaaccaaagggcaagatgtctgcttatgccttctttgtgcagacaagtagagaagaacataagaagaaaaacccagaggtccctgtcaattttgtggaattttccaagaagtgctctgagaggtggaagacatgtccgggaaacagaaatctaaatttgatgaaatggcaaaggcagataaagtgcgctatgatcgggaaatgaaggattatggaccagctaagggaggcaagaagaagaaggatcccaatgctcccaaaaggccaccgtctggattcttcctgttctgttcagaattccaccccaaaatcaaatccacaaaccccggcatctctattggagacgtggcaaaaaacctgagtgagatgtggaataatttaaatgacagtgaaaagcagccttacatcactaaggctgcaaagctgaaggagaagtatgagaaggatgttgctgactataagtcgaaaggaaagtttgatggtgcaaaggtcctgctaaagttgcccggaaaaaggtggaagaggaagaggaagagaaggaggaagaagaggaggaggaggaggatgaggagaaggaggaataaagaaactgtttatcgtctccttgtgaatacttagagcaggggagcgccgtaattgacacatctcttatttgagaagtgtctgttgccctcattaggtttaattacaaaatttgatcacggtcacattgtagtctctcaaagtgctctagaaattgtcagtggtttacatgaagtggccacgggtgtctggagcaccc

SEQ ID NO: 1803 - DNA, 1343 bp, Homo sapiens
caggcattcaccagctaaattttgtgttttactagagacgaggtttcgccctgttggccaggctggtctcaaactcctgatctcaagtgatccgcctgcctcggcctcccagtgctggtttacagccgtaagccaccatgcctggccctgtttcccttgctattctcttaaagtgagaattagctatatctggccaaaagtctgggacagattggaagaagagggggaaaagagaatgggtaagaacagaggaaaagtttttaagctactttaaaaacttttaaactacaaactggacaacaaccgcttgaaaagctagaattgcatattaaggatggtgttttcttagcgtcagcaactggaggcattgtgtaatcatagttaaaaacatttcattttctctctgaagatacataagcctatccattcaacttgcaaagttccaaagcaggaaaagtagcacaagtgagtttagggcaacctgaccttttctttttctttctttttttaaattatactttaagttctggaacacgtgtgtggaacgtgcaggtttgttacataggtatacacatgccatggtggtttgctctacccatcaacccgtcatctacattaggtgtttctcttaatgctctccgtccccttgtcccccaccccctgacaggccccagtgtgtgatgttcccctccctgtgtccatgtgctctcattgtccaactcccatttatgagtgagaacatgcggtgtttgattttctgttcctgtgttaatttgccgagagtgatggtttccagcttcatccatgtccctgcaaagaacatgaactcatcctttttatggctccatagtattccatggtgtatatgtgccacattttctttatgcagtctatcattgatgggcattttggttggttccaagtctttgctattgtgaatagtgctgcaataaacatatgtgtgcatgtgtctttatagtagaatgatttataatcctttgtgtatatacgcagtgatgggattgctgggtcaaatggtatttctggttctagattcttgaggaattgccacactgtcttccacaatggttgaataatttgcactgtcaccaacagtgtaaaagaattcctatttctccatatcctctccagcatctgttgtttcctgactttttaaggatcgccattctaactggtgagagatgctatctcattgtggttttgatttgcatttctctaatgaccagtgatgatgagctttttttcatatatgtttgttggccacataaatgtcttcttttgagaagtgtctgttcatatccttcacccactgtttgatagaa

SEQ ID NO: 1804 - DNA, 1034 bp, Homo sapiens
agtctggccctcaccttggaatggtggagttacttgttcaacgtttgcctcagctgaaatactgaaataatttctgtttcccacctgtcagtggggcgtttgcaaacttacagtgaggatatttagaaagatgtttgagtttccctaagaaagtgtggtcagtaagtatgagaaaaagtttatatatttgtcttgctttgagacaggttgaatctgccagtaggtcagaggaatacatttacctagtagcctgtgctggtagggcagagagagtcagtcgtttttcctgagggcgttaggtgatttgagacctcaagtgttgtcactgtaagagaatcctccttataattaccattgttaatagaattgaaactttgcatttgtcttttatccctaacaaagaaagactcccagagagtctaatgatgagccctgcctacatccattctgaaaggcactctatggatatgagggtgtagacgttaattcctttctgtagaatttgcatgcagaggctctagggccaatgcaccctgcttacattaataaatatttaaaaacaaagagcgggtaacacaagcacatctttcctttgtgcatcctccttactagggtgcctgtaatacctaacatcttgggaaggaaatgtctgggtgggtgcgggtgggtggtgatgctgcgcgcagcaccaagtataaaggcccaagaagtaaccacatcgtgtgaggaataaattaaagcagcttcatccggaggccaattaaggaagaatgggaaaaaagaaaaaacaaaacccagcaacaataaaacccaagagatgagagagcatgttcgttcagaccacgtagaaaagagaaattgaagtcgtctggaaggagtttaaggggatgcatcacaaaataaaacttttggaaccaagaaacagtggagaagcccggtggcgagccacatggccttgtgctaagacgagatgcccttttcagaaaggataatgatgatgctgggagctggaccgtcgtagattgtcgcctgag

SEQ ID NO: 1805 - DNA, 1033 bp, Homo sapiens
taatttttgtatttttagtaaagacgggatttcaccatattggccaggctggtctcaaactcctgaccttgtgatccgcctgcctcggcctcccaaagtggtgggattacaggcatgagccaccgcacccagcccccttttgtgattagtgggtgttttcagttttgaggagggaagatctaccttccaaattgcagtggtggcccagagaacagcctggtatgcaggaccagggtgaaggtgaagctgttcatatcaccccaggtctttgaaggggaagaaaaagttcaaggcatttcatgttaaaacttactgtttagaaaacaatactgttgatattaaaaatataataatagcatcattattaccaagaagaccttaataaagaaaattttacaaaagaaaatcataaatctactaatttacctttaatcatactatcctagttcaacgtctattttcagttttcttgtgtttacattttcttgtgttactttccttatggctgtgtaaattttccatgtcttggggatgattgtgtactcagggaacatatttatccacagaacctgttatgtatcttatttatttgtttattgcttatttcatttcaaaaaggcatgcaagaagcttaccaaaagatgtgagagataccaagagatttactaaataaatgaggaaattagaagaaaaaaattcaggtagggcaataaaataacatgcaagggaatgttagtatgtaaaatggtatccataagatcctttcttattgtgaacttctcaggccttttgctagtaaggaagtagctactgtctctttgggtcaaactagtctaggaccttgttcagtccatatcctagaaaggttggctacagatttgattctgtgcttcctagtagcaaaagcaaaaaagggaaataggatccgtttcaaattgccaaacatttagaattggaaactaatcagttatttaaggagaagcagatttttttcctggtactggaccccatgcaaaatttctttcataatttc

SEQ ID NO: 1806 - DNA, 1082 bp, Homo sapiens
ctcttagatctcttagatctattggatcactccagttaagtgctcagagagaaaggtttctggtttggatcagcatgttactgaatggggagaagttcttgaatagctctctgttttctgagttaagattttgtgttttggtgtgtgaagagtaagaggggtatcatggagtagatgggggtgaggtagaatgggaggtgtgcaagagaggacacctgaggaccgtgtgaaggcaagtgataatcagactaggaagctggctggacacaaccttccagtgggagaggcggaggtgagggggcagctgcttctttaactaatcaagggctcaggttccagtaccttccttttatccccatccacagtttggcctgtctcttctcatctgcaaaatctcctcttttctttttccccctcttttaaaagctaaactaattttctgtctgttcatgttgaccttttgtccagttttcctcccatcagatgaaccaaaatactagaaaaggactcttccatctactactactgctagtaataataatagtaataaaataaataaaaccaggaagctaaaaatggaaattaactaattaatttgacatcaatgaaagaggttgtagaactggaggcaagggaaagaatggaatggacatctttctgggcacactcctcactccttccccaaccccttccaatgtgagtatgtgtaatttaaacctcttcctggggaagagtgaaagaagaattttacccacctttttccattcccctcctcccttagtgaaaattcctagtcatggtctgtgatatctcaaacttggctgtcactttttggggtcattccctggggatacccttcccccaatcccagggcagttctaatgtttctgagtaaggagtagtgagaaactcagttttccctgcaaacttccctcctcatcagccccactcagtgttgagtttagcatttgctttagtggctttgctatttatagacttgtctggggaggttggggttgggggacagtgtcaggcaaggaatctcactgtagtctttgaggggggtagtcaggcattgagaa

SEQ ID NO: 1807 - DNA, 1035 bp, Homo sapiens
ggggaagagagtatgggatgatcagtaaggagagggggcggggagagggaagagtcttctcttgaccagaaaatgatacctgtggtgtcttttcctgaaactgaaaacattaaagcgttctgatcccagagaaaacaaattctctgggatataagggttcaccttttggaggtggattacacttttcaggacaccagagaaccatagagcaaattacttcttccagagtgctaaatgatcccctggtgccctggaaagagaccgtttacctccaaaaggtgagttgtttattgccagagagtagaatattggctgtaatgcctgctcatccatccttctccatccctgcgaggtatttagggtggaggagatattatccacctgtcaccatggggaaggagactgacaaatacttttctgattcctgttcctaagattgaattgctggggaggaaggtgaagtgacttttccaaggtcttatagtgatccagtgattgaagttgaattagatttctgttcctgttgtggtgctcttgtttgtcagagaaaaataaatatcttaatgctcacacggagcctcccgtaaaaaggctgataagaaaggccaggtgcggtggctcatgtctttcatcccaacattttgggaggctgaggtgagacatggcttgagcctaggatttcaagaccagcctgggcaacatagtgagatcctgtttctacaaatagtaataataataagacatccaggtgtggtggcacatgcctctagtcccagctactcgggaggctgaggtgggaagattgctgagcctgggaggtcaaggctgcagtgagccgtgatcgtgctgctgtgctccagcctgggcaacagagcgagaccctgtgttgaaaaaaaaaaaagctgggggtcagggagcagatagaagaaataccttggccagcgcaactggaaagggaggagccaaaaggggaacactttcttgattgtcccagcctcattaggagctaccacagggctctcctgcatgctcctt

SEQ ID NO: 1808 - DNA, 1046 bp, Homo sapiens
ttcattctctcccaatagatctcatgtctaacactactctaactttgctcccctctgagaccagcatgaactccagttctttctaaattgtgtaattctttttttttaaaattaattaattattaattttaagttctgggatacatgatgtgcaggtataattctttcttaatagattctgagcttgaccttccagtcgtcttctactgctcagccacacccccctccatttttgtttcttttctctttcttcgggcaaatctgcaattgtgggcgcatatttaccttgttattttttacagtattcccatgtgaacattttgccagcggcctcttcttaattttagtcctttctggggaagggttaatagttcaaacccattgtttttcttttgagggttgagacttgttataaaagctgcctggagtgggactgtccctcaggaggggaggggcacaggcctggcatggggataactgggaatggggtttggacacaggatgcctggcgactgtagggacacttgtctcatttcttgctctgttatataatataaatgcttagggaagcttagattcaatgggttgtgcccttccaaaagcctactgctggagtgaaaactggaaatacatctttgcatatgtgttctttcattttatttttcctactggtttgctaagcaaagagctggctttgtacaaaccccctctccccgctttttttttcttcttttcttaaaaagcttctgtgctcttttgaaacaagccaacaaaagttgaagccagtgtgtgtgcaactcagacctcatgagcaattcttttccaaaccaaattttaattcacagctgccagtttaggggcaatgctaagacccaaatcgtcctggcatctgaagcacctgtcctaatgttgagtactttaaatatggtgttcccatttcctaaatctcaatttagtctgtttggtcttacaattgtgagtataattatgggaaaatttaaatgggatacttgagtcaggactgtgttaaaaaatccaagatgtat

SEQ ID NO: 1809 - DNA, 1051 bp, Homo sapiens
tttctgccctcaaaggtacttgtggaatgtttgccgttaaacggttgtaaattaagggctgagtgtatgaagcgttaatgaaggctgccattggaaccagtccacgtcccgtcccggctggcaggtttgctgtccaagaagtctcttgctggaggcctgagttcctgagtgtcgggtttcagctctcctttcttcttttttcgtcttttcttctgcagctattttttcccctaccttccttataatccgtcccttcccttccttcttccatacccactccacccctacccctttggctttttctgaaagtaaccatgaggaacagagtcagaatgaggctagggaagcagcatttttttttttcttttcctgtagaaagcagggccaaaagggtgcattttatttttttctgcttttccttttatctctttgtgtttgcttcatttctttctctttaagtcaaggttgaaattgatgtttgcaaaagacaggaattttgaataactgcctgagttaaacagaatatggagaaactttgactctgtcccatgtattaaaaattaaaattagggcaaaataatgcggatttgtcctggaggacctggccagatgtagctagaggactttcacagtgctggtataattatacctggatatgggataatcttcactttaagcaactccattatgtgaaaatacagatccacagatacatatacaaataaacacttccaaaagaaatccttgtataattcaatgtaatatgtgtttttaagctacaatatgtaagccatcaaagtactgcattatttttagataacagacttttcagtttgtttaaggtgtgattacctttaccaaacatcatttctactcaaatagaatgcttacaataaactgtatggaggatacctacataagtcatgtcctgagtttatactatttcctagagacatctcttttatacatttcaagttttaagtttagtctgatgttttatacttttcagtttagtacctgaattgtatctatctatgaaataataacagat

SEQ ID NO: 1810 - DNA, 1513 bp, Homo sapiens
tggggggacttctatgtgaccaagtttgtcttctaggctagcgtttagccacctctcgtagctctggtttctctggctctgctcgagcagtgctgctggacttggtggcgggaatagaaagggaaactggctatggcttccttttacttcctgcctcttcctccttccctcaccccatgatatctgtacctaaaaaatgtcagaaaagtcccatttttgtatttacattttttttttgtgaatgaaaagagacaaaagattctagactggaaaggtgcctggcactcagctggagcactgccctaggcggaggaagagatgcagaatatgatggggctcccacctctgttcccgtcttcctggtccctctccccttctggaggtgactgagttgctggtgtctcatgagatgtgataaagcatcctggttaagagcactggagatagtatccagcttggctttccatcctgttatgaattggcagattaaccttggacaagtgatttgaactctgcctcagttcttaatctgttgagtatgaagaaaaatagacctacctcccagggttattgggcagtttaaatgagttaatgtatacaaagtatttacatcagtgtgtggcacccagggatcactgtatgagaatttcctgaacaacaacaacaaaaaaacccttctagaaatatttttacaaattatgaatgtattttcctaattttgaaaatacaactagtagaataccatgaatactgttctgcaccttgcttttatttatttatgtatttagcttgtttcttagcaatgtcaagccttatgttccaatttgtgagctatagtgttttgttaccatccctgtaagacaaagcatctaaagtaatcacctaggtatgcatacggaaaacctttctggactgtcagggaaagcattttatcccaactgccctgaacttgtcactcttctctgagcaggtcacaccccttgctgactcagcctttgtactgtgttctctgccttgaattcattctctcttctccacgctacctggcaaactgtttttcctccttcaggaatcagctgaagtatcaggattgccgtaaagctattcctaactttctccaggctctcctgtgagcccccctagcattgtgtgtctgtctgtgagccagccttggcacacagtgttgcggttatgatctgtgtatatgtgcacgtgggggcccagagctctcccacgctgaacaccagcaattagtacagtgtctgttacatagtcatgctccatgtttttaacaaataaacaataagtactttttggtgacaacatcagtttccttgtcttccttctcttctggtgagagtgtcttgaggtagaaacgaagaaatctgactccaccctagcacctgaccaaactcttagtcccactccaaagcatgctctaagctggactttacctgggggctgcaggtagattgccccttcagctactctgtcttctcctggaacctacagt

SEQ ID NO: 1811 - DNA, 1024 bp, Homo sapiens
cagaatcactcgggaggcaaagtacaattccgttcttccttatgttgggaccttcggtgattgggtcctccttgtgtgtggaagtacatgaaagaaggatagacaaaattagagcatgttttcgagaccatttggttcagcctctctgattttacaaatgaggagagtgatgcaaagtgtggttaagtgactataccgaggacacagacctactttatgacagaggcttgggagccagattttaggatgccggtagttctaaagtatctagctgtgctgccgtctgaatttctggttcactccatcaggtcagcccatagacacctcctttttcttaggtcggacctatcttattcgtttcctcttttgttctctgcagctgccacccccactcctacctcccctattctctatgttgacatgtgacttggggcacttgcaacgtccctacctaaaattgatgtttgccacctggctgctgactggtgcgctatgctgcttcactctgcctgtttcaaccctgtgaaatatggaagcagatcataaaaaaatggactcccacacattttgcagatctaaattgggccttaatataatgtacttggttatgacaaacaggttttctagggcatgaccggcagcttaggctggcttccctggtcatgtcagttgaattctttttttctttttttgagttgggagtctcactctgccgcccaggctatagtgcagtggcatgatcttggcttaccacagcctccacctcctgggttcaagcgattctcttgcctcagcctcctgagtagctgggactacaggagcctgtcaccacgcctggctaattttttgtgtttttaatagagtcagggtttcaccatgttgaccaggctggtcttgaactcctgacctcaggtgatctgcccacttcggcctcccaaagtgctgagattacaggtgtgattcactgtgcctggcctcagttgaactctttaagattattcaactctttccttaattcttaggt

SEQ ID NO: 1812 - DNA, 1050 bp, Homo sapiens
caacatttctgtaaaaagtggctgtagccatagtggagacctcatctggcaaatgtggacaggtggtgaggctgtacctccaaatttcttaattctttttccaacaagaaggttggcttgccaattctttgatcaaaggtaggagtttctgtaatctgttctcttaaccacatttgggatgcttgtatatatgactacatatatttatatattttttatgggcaatattttgactgtttctcttttgaaagacagtgcgaatgagtatgccaaaaatcacagatgatatgagaaatgctatcaataaaagcattttttcagaaaggtgaataaagtaaccccaagataacgtaaaatttttcctaatgttattttgcaaagtcattagaaaacctaatgcttgtgaccaatggggtgatgctcgtgggacagtacgtggctgacgttgtggttttcactgggcaaaataattcagatctacgagtcttttggcatgggcatagacagaaagattgcataatttgttcttggatgacgtgaaaaagaaccctgaatatatttttcgtttctatgcttccaaagtctgagtgggatgttttacatggatgggtaagatgggattttaggagacagataatgctctgttttagatcttcacttggtctttccaacttgtaggggtggtgtggtgatcacctatttgactagtggttatgctgttttcatatttaagctgcctgtagcaattcgtgatttgctatcagtacatctgtcaatctgtaatattacactcaatatcattcttcttttacccaaatatttggtaaaagagaaagctaacatgcactaggttcctaccaagcagataagatgagataatctatgtaaagtacatagtataaccctgaaagggattattagtcccacttgacagatgtggaaaatgagccctagagagattaaataaaatagaaccttctatgactaagtgactaaattcaggtctctgatttcaaagcccatactctttcctctgagttgcattgcccc

SEQ ID NO: 1813 - DNA, 1050 bp, Homo sapiens
aggcatcttatttcagcttggaacaaggtgcatgagcccagcttgtttgttgcatgtgggaagtgtatatttttagttgccttgtagagtggctttccacctcatttatgaaattggctttttatttttatccttttctctttttccctttcaccagagttggaacgtgaagcacagtttctacttgctgacgtagtatttcctcttgatttttagtggggttggggtgttttatgagtactaaggtcacattgaactttggacacctagtcaccttgttgctggctgcagagaagagcttgagaaggagacagaaatcttctcgtcttctcatcatggctttgacaaatgcccagggagactgcaactttcttctcaacttggctgtaacactggagcccttggccacttagaaggcctgagtttttttatattttccaccaagctgctgattctaaactgtggtggggtttctttcatggccagaatggggagaaaccgtgggctgagttggggatgtgtggtttgtgtgtgtttatgtgtgatcactgaagtgtaggatatggtaggaggatggcttaggacttccattttggtttcttattacacagcaataaagtaaatggggcttagtataactttgcacttatagaaatgtagctcaatttaagaaacaaaactccgccaacaggagtgctcagtatcttcagcttgggaaactgacctcgttaattttaatgaggggaaaaattctccagctggggctgagaagaaaatgaaataccaatgaggttatcactttggatgatctcactgaattcagactatacttggaacgatgcttggagaattttctaaaatcctatggagagatttagaagaaaatgcatatgcccttgatagtattgacagactgctttccctgataggcagagccgaactctatatagtgcctcctaaaggggtcatttgaaaagttaacatattaaaaagttggaccaaagtaaaactgagagaaaaaatggattaacgtgattcttatgtgggtct

SEQ ID NO: 1814 - DNA, 1540 bp, Homo sapiens
aagtgccacataaatattggtctaatacatatataattatgtaactctagccaggtagctggattaaatatgggtaacagcaaaagcacttctgtcctgataaaagtctcagttacatttaaatacttaatataatcagctctttttcaagtaaacaataattcaggaggcaaatgttcagtacatctcatagaaattttttgtcttaatttgtttgcctgtacaatctgcattcttcttattaatttaatccatattttgaagtcagaaaagaattcatctcatttgagttagtttagatcaacatactgatattgctgaatagtttcacttccctgaaactaaacatatctattcctttcgtcttagacaaattatgaggggaaacctgtctgaaatttggctaacacatggtgtgcatttgatgccactggaggatttgctttgtcaatttaagattgagtgatggctatagaggaaagtgacggaaaaaaaaaaccttcttaatgtgaaatagaaagtataaaggacaataaaatgctaaaatgtacaggaaattcttgtaatatgactaataatgtatgagacttgtagagatcagttctgctacaggtattcttatgttatataaatgatattataatatcctattacatatattatattatcatactataccaagaatagataatatttttcatcaactggtgattcaagtgtgagtttatacatgggttgactgtggattgtatatatgataccaagcctgtgtaaaataaaacaaaaacccccttcaaactcccatatggagtatttgactaaagcaataatattaagataacatactctattccaaataaggatataatttgctgtttgataaagcaaaacaaaacaatggagtgtattggtactgttttccacagagtgggaagataagaacacatgtagagatgataaaatgtcattggctccaagagacaagcttccgaaatccatggtggttgaagaacatcaaagaggagcaattatttcagtcattagggcagttccacctgttctaattgaacatttttaggatgtagaagatgcatcatacattggtatctattcagaaggtggggacatctgctgtctgtcatgtatctgggagatgtttatctcaacaggaggcaataataatatggtaaaccaaacctaatattatcatgatgcattaaaactgggttaattgaagcaataaaatcaaagtaacagtaaatgcttatacaacatgttaagtaatatttacttcaatcttagaaatgaaatgataattttacattctagcagatgtatttcttgatacctgttctgagaggacagaaacaaggctcaaaattcatgcaagaggctaataacaacttagttgatagtaaaatatggagcattggatgtagagtgcattaaccttcttgtttaatctgagttgacctataagtgggcatattgttttttggggaatcgggagttttctcaagtagaaagaagccccactttt

SEQ ID NO: 1815 - DNA, 1024 bp, Homo sapiens
ccaccgcgcccggccttactgcttgacattttacaaaacgccatcatttgcaccatttacaattttgaaggtgctgtgggatccttaagaaaagtataagaactgatctctgccttaggggaacttctagtgttcagaagaaaagactaaaatatgtaaaccacagatgataatgttcaatgaagttgataattatgtggcatgggttaaaagtataatgatatttcagagacaaaagcagtggtttggggttcatgaaaattaaggttggcttcattgagaggaggtagggatggggtgaagaaatggggcaggaacagatacatagaaatcttagtgtgtgcagggtggggacacatggtgtagtaagaggggatagtagccagcactaaggaagcacggaagtactttggcaagggaagagggtgacaatgaggggattggcttggccgtgatgcagatttgaggttacagtagtgatggaataggatggcattagtagggtcagattatggagaggaggcaaagggaattttaagtaggtaattcacatatattttgttaaaaaccctatccatttagtattattggctccattttaaagaaaatgtatgggtagtatgcacacccaggtctgtctaaaaccaacctcttttcaattcaacatggtaccttaactcaagaaaggatggtaggcttgatgtgattggtagtggggaatcattgtgggttcttgaacagaggagatatagtgaaagggggtgatccaatggaattgtttactgcgcatgtatccatatgtttatataggatgaggatgtcctttggtggaacagatagaggaacaaaagacgcaaagctgaaggccatatgatggactcagctcctgagctctgcattccttttctgtgtacccaggagccgccagccctgtttgtatccacacaaggctctctgtgtatcacagccagcatagaaggcataatcctcctcgggtctgtgtctctataatttatgatgcttt

SEQ ID NO: 1816 - DNA, 1067 bp, Homo sapiens
cattccaagctccaggggagacctgtgtggaggtgcaagaaggaggagctctaaggttattttaatttagatttatctgagactccagaaaaatcacgtacgtggtgtggaaattatcctcacataggcagagggagaaaacactaaattcatattctacatgtatcttcttgtatcaagaccagtgttttcagaaatgagtttgccaataaatataaaaaccatccatcggttttcttcccaatactcattcttcccctaaacgttacataggtttttatactcttaattaaccacatccaataatttgtttcctaggctgggctagctggatgatgcctttttatctggttaaagaagagtcaccaggcaggaaatgatggtagagagatggaagactacaaaacccttgccaaattctgcactttttgttagtttgtttgcactgcggaaggatgaagacagtgagacagttactgagaccatcggctgctgtggacatcacagtgggagcagtctactgggtgggaggggtgctgtcaggtcttggggaccttagtaggagacaagtaaaattatgatgcagtggaaaggctcctttgaaaacaggtgatgggacacagtgtatgcaatcctgtgggcttttgctgcaagtaggcagacccctttcgtttgacctttttatttataaagtcacaatctgagatcatcagattgtcaacaactacaacaataaatccaaggtcattggatctgaaacccaacacctgtattgaatcttaagaaaaagaagacaggttgtattcatttaagcattgtctaagtaattaggagacaaaatttgctattatcgtatgtttcacagttatgttctaaatttatgcacctgtgagtagcactataggttttcattaatgtttgtgttctcatttgatctttataactaccctgtgaaataggtacttaggacaaacattgatcacccctcattttaaagatggaaaacctgaggctcagaaaaatgaagctcacaaattatgtcttatgactccaaactcctgctggtt

SEQ ID NO: 1817 - DNA, 1071 bp, Homo sapiens
ttttttcctttgtgctcaggtaatagaaaatgaaatttgtatgtatgtttataacatgtacatttatacctgtatatacatattcatatgtatttttaatcatagggaatgaacactagaaagtaaatgaaaaatgagttgaaaaactaagcatttaaaataaatcaattgacttttgatatattaagatattaatttcaaggttaattatagcctcctcttagagatacaactgttcaaagatacatcatcacagctgattgtcaggcctagatgcctgtgaggagagagactcagcttcagtaacctgttgaagccagaacatagaaagtaaatgaaaactcaattgtaaaaacattcattagtttaaaccctagacactggggcctactttagagtggagcgtggaagaggagtgaggactgaaaaactacctatgaggtactatgcttattacctggttgacaaaataattcatacacccatcccccatgacatgtaatttacctgtataacaaacctacacatgcacccctgaacctaaaacaaaagttaaaaaaaaattaaacccttttgtcctcaatgttttgatatttggtcccgggaactcaaatttgcctttgtcttaactggtaaaaatatttacccggaaatgaagaaacattaaatacactaatatgtaaagacttcagagggaacgtttaagaatccaagcaatcaaaatagcacctttaagtatttctgtagtgtatgctgtaagtactctataaaaatgtattaatatgtcttgttaaaatgccatttacatacaatggtaacataattataattacacgtctttcttacagatttattaaaacagatgtgatctaccaataatgttttacatctgatggaaagaattggaatataataatcctacttttctttaatgcattactaattcagacaggcccttctggttgttctgaattggagagagagcagacacttcagttggatttggaatcatccacttttttttgcaggtatttcgaaaaaagcctggttttggtacagctcttccagaac

SEQ ID NO: 1818 - DNA, 1051 bp, Homo sapiens
aactagacaagaagagacgtatcaggaaccagttcctccttgcctccaggtatcagacatgctagatcccagttggtcttaactttttgtctcacttacccctttggttggaatgcaggcattattctgaagctttgtggtaagcgacttggattttctagtgtcgggctcttctcttttttaggaagggagaagcgggtctgggaaattaaagtgcctgtatctcccagggcaccgattgttaagagggttgggacctcagtatgttttttttccattctgccacacctgagatagaaaaaagaaataccacggtccctcgggtagcagtagagggtgagagcaagactcctacctctgaatgccgttagatttagaagttcattttgactgctttacgatacaaagttgagtaataataatggtcttactggtataaataataagcacagagtgtttcatacatatcaaagcaatttcgtacattgtagttctcattctttgagaaacagccttgtggggttgaacagaaggaattacagaattgtgtttgacggtgttgagtgagaaatttttagctgtttttcttattttgttccctgttccctcatttttttcttatcctgagttagtctcttgatttacatctcggcattcaggactcaatgttgccagcctcccgcatctgaagtagctgagagccaggatgctagcagaggatatctgtgtagccaaactaagggcccatgtacttaagtttgtgcagttgactcatcagagcgcccaaaagccaccactcaagacctctgatttcaaatatgattctaattgtatgtttatctggcttcctagcctgtgccagactatatacatgataatctctaacatttactaagtacttactaactgagacactctcctaaatactctcaagcattcactcaggtaatcctcacaaccacactagaacacgaggtaccacaactgcctccattttacatgtgaggacagagcacaggggggttttgaaacaaggtcccaagccagtagt

SEQ ID NO: 1819 - DNA, 1058 bp, Homo sapiens
ttattagtggtactgtgacatatgactgagacccacaaccttttggtctatattaaaaacctactgaaaagtaaataatttgtaaactttaaccacatagacaaagtgcatgaaggggacatggagagaataaaaatctcttacagacatatgtttttccagtgggcagctgctatttaagaacttttaaggtgcacatgagtacacctttgttaaaaggtatagcttgtatagtaattccgttctgggggttgcggagaagagcaggagggagcacagtgtgccttgccctggctggcagtatgagacaattaccacgatgaggttttttttttaatgttctccatatatagattaaaatgtttgttgcctgaactgggcatggagaaggcatcataatgtgcacctgaacattcatgtagggtttagtgaggagaaaataagaggataccctgagctcacattcatgggcatgggctcaagctttttccaaagtcactgagatgtcattgtattgactcagccttatttgcattacctcattctggtagaactgctatgtttatagacatcatttggcatttacccttccacatcagagctttcatattggagttgactcttcattttgagttgaccaaggtgggcttcagtgtgagtgagtgtgtgcacttgtacagatacaccataatctaagaatcaccctacccccatgaacagggtgtcacgcatgtgcttgactgtgtgcttctacagtggcaggtagagtgaatgcagtgcaggaaatatcagcccttttctaaagcactatgaaaatgaaagggggaggtggttgggggatggagaggacagagggggaaatcacttctttgtctaaaagggaaatgccaggaccgtcccttcaggtctgttaagtgtctataggatgaggaggaaaattcttcttctcgttgacattgtgtaggtctgtgtgtatctgcatatgcctatattcattatgactcatcatcttactctcatggtcttttggagatactttgtctattctggagtgcaga

SEQ ID NO: 1820 - DNA, 1008 bp, Homo sapiens
gatactctgagaagtagtcacggtactcatggggcctgctacttcataatgtcagtgacgtggcagacacaggaaggctgcagcacacctaactttgttggtcacttttgtctatctgctactctcaaggctccatttgtctctgttgtgtaactctgagcaagctagtcttctttctaagaaagtggaagctgatcagcagaaggtggccatggacaaaatgggaagcaggaccgctggagaaataggcccagttgcttatttcaggaaatcctctagtcttgttcactcgaaattgtgcaaggacaaagctgggtccattgaaacagaaagcataagaaaacaaaaatagaaaaagggggaaaaacactttaagttgaataaacaactgctgagccaactcatgagttcagcgggggattctcatgtttccaggatattttcagattctgatggcaactcgggaaagaccactgtaaccttgaactttgtcagaggaccgagtttaagaccaccaagacatttcacgcagaccacccactgcaatttcttgcataggtctgctggccagtctcttattaatactgcaaggcaacctaaactatattttgttgggaaagtggaagagcgaaggcaggtgttgaaaagccatgaaaaaaagaattaaaacaaaaatgtgcctcaggctcctttcagctggcagcagaatttccgtcatctttcccttttgaatttgatattattgcaggaacattaccacggactcaattttcacttgacagtgaaataccagaagtcgtctcgggtccggagtgctgtctgcatccagtccctgttaatctgcagaaggaaagcatggagatggggtgggtggccaagctgacacaggcctcttcaggctgctgggaaagggtgctccctgggtgtgaggcccaggagtccctagaattgcatagatgcagcagtgagcagcccacctgggtgtgaatcatagacttgttttgagaa

SEQ ID NO: 1821 - DNA, 1050 bp, Homo sapiens
taacatctgctgacataaacagaagcccctcaaggataccttctgccagtgaccaaaccgggggctcaagtgaagaaatattatcattagacctgcctccaggtctagctaatgtcttattcagtatgaatagcagtggcgtttgggcagggaggtgatgagatgcctattaaggtaacagaggtgtccaatggaacattgcttgtttagccttatgacctctgtccaagggagggcttcctctgtactggaactgtggttgacttagggtttctgcggtttccttcctgaggtatatttacagtgactgtgccttcattgcaacaaattttaggttcatcctcttgagcagggggaaggagcctctctcttcagaagcatgtcaggatatctttggtaggcatcatgttctgtttacttgaaccagtgagaagatggccgagcaagcaaggataagtgtacgtgtctataaaggtttcttctaatcctgcgagtctgtaagcattctagggttcatcggaaactgtctactcccatttctggaatttgcctcttggcatcatcatgcagggggctttttctagtcatgctttgtggtggaaaggtcagctgagcacggaggaacaggggactcactgcttttctcccctttgggcccttgagcaggcatttgactgctgcatatgaacctgggagccatggggtcttaaggctttctacttgattctcagtgtggccagaattctgtttagggcactgctccaaatctcggtgacactccatctgtaaaattgggtggcagtgtagtgtgtgtgtgtgtgtgtgtgtattttcttatacaggactggaagagaatggaggaagaaggataatgacttaaaagcgaaaacaattgaattctttgagctacagtgctgtgtcctgagagtgcagttattttccactgcagtaatgctttcaaaaacatttatctagcttctctcactttctcatttgctgtcattggtgtgaaaaatcgagttaccagaaggttcacccatgttccacagg

SEQ ID NO: 1822 - DNA, 1051 bp, Homo sapiens
cagaaattgaatggtcatctatcaagggtgtgaaagaagatactttggaatatattgtttttaaggttcattttaactttcaacactgaatgctcctcttgaccatctgatcagtatgtgctttgttgtgacagtatcctatcatgtacagcacggaccctgaaaatgggcacatcttcaactgcattcagcgagcccaccagaacacgtgagtgtcggccctgccgggcaccaaagacatctgcagagtgggtgttttctgtctaacacctcagcccttagtgcgctgtatttgctgagtcatagtgatggtgacaatcatgggcacctcattaaaagtattcaaaaattatgtatgtgaacacattgactattaagcaaacttaagagtggttggaatggtgggatttcgggatattcttttcaaaaaatgtcttcatggttgcattacctactacagttttgcagcatgacccatctaaaccgatgttgactctcccaggcctagggagtgaagaggttttgaatgctgtaaggaaacccactctgactcaccaggaccttccacttccatttgttagatgtgaggtccttttactcagcatgttccaagtgacctctaatcccatgcagagcaaaggagggtggatgatagtgaccaggtcttctccctgcggtgaatgtttatttttacccccaagcttctaacttggcaaggaagatgtaaagattcatagtgctggctgggtgaggtgggctcacacctgtaatcccagcactttgggaggccgaggtgggtggatcacttgaggtcaggagttggagacaagcttggtcaacatggcaaaaccccatctctacaaaacttagccaggcatggtggcacgcacctgtaatcccagctactcaggaagctgaggcatgagaattacttgaacccgggaggcggaggttgcagtgagctgagatcatgccactgcattccagcctgggtgacagagacactccgtctcaaaaaaaaaaaaaaaaaaattcataattctacacaggc

SEQ ID NO: 1823 - DNA, 1060 bp, Homo sapiens
gtgacttgagggactggtgttattttcatttgtttcaccctcctgttgacatttaatgttacccaaaatcaactcaaacaaacaaaaaccctgatgcagtaaccttatccctaacagtagcactgctgagtgggaaagacactggggaaggcggccttctcacatgctgtcttctgtgttctctccttgcttattttaaccaaggaagtcaccccagcatgacagccaaagggatggatttttcatctaagtttttattctctcttctcaaggacattgggaacagggagacttttccctcgaagaccatgtattctgggagaagcgctccccttctttctagtggagctacacccccagtgtagcctgcagaaccacctgagcccagccctgccagtgactgacttcacatagaacagcagctgagtcttcagtcaatctcatgctcagaggcccatttgagaaaacggcatttcccctagtcctgactttggggcagttctcttttctggcctgccctgagaccggctggcccacatgtccttctcttgagctctgacacaagttccccaagatgcccagggcaagtggggggattccttctatcccacctgtctaggagaaggccaatactcatctcccaggtccacaagccaagccattcatagaagaatcacagatattttattttcccgctgaaactaacttaattctacctaatttgcgtggggagtagttggccaaatcatcaaattgttaactttttgctaacatattgtgtaatcaaccctaggtgttaaaaaaggtttgcttgtttctttcatgcaaatactaatgtagcccttttttcttagcgtatagcttctggcctgggcttggcctggattgttggacgagttctttatgcttatggctattacacgggaggttagtatatattgacatttgccaaggaaacaactttaaaattttaaatcctatgctggccaggcacagtggcttacacctgtaatcccagcactttgggaggcgaaggcaggcagattgcttgagctcagga

SEQ ID NO: 1824 - DNA, 1050 bp, Homo sapiens
ggctggtttggtccttttgctgcttttctcagagatggcattgtgtgttttccgtcacctcaaactgctgccatgatctggcccttcggaccttcttccctttcccccttactctagctagtccagccagacccactcttggcatggcaggctttcccccagccaaggatgtccgcatttgctgtctgctctgcctgaatctctcctgcttgttcactgagccatgcctagcacgatgtctggtagaatgaagaagaaaccctgggtcctgctgcctccagtagttcctatcctgctgcctttcctcaggctgtatttcttctttgttccttgagtgtctttgaagtatggtttctgatgctcactctgtttgtggtcacctaccagttcactacatagcatttgctttcatgtcatttctttgtcaaatcttgcttttatgaggttctgtgatggagacagattgtctttgggaatttcactgctgaagacctgaccttttttgctagtgggctctgtgatggtgctgttggaactacttaaggtctctaaatcttagacttgtatttcagtattttaaaatcaataaaaaggggttgagagtatacttttatatgtgagtgtgtatgcatgtctgtatgctttcgtgtccattaaaccatttcagtcattaagctgatttgtcatgaaagcattcgatcttttcatcatatatataaaatatataagtataacccatatataattatgacatacaaaataggaataaaaaatgagaaaaaggaaacatttagaaacataatttctttaatggtataaaatcttttgatactaaaatattttttatttgtgactgaagattgaaagacgttttatttttaaaaatcttgtttaatacttggtgagtcttggatgaccttggtggtgttagttttggtggtcattcaagactgaaggttttgttctaagtttagtcttctgaatttttatttaatgattatcatatttgaaaaagttacctctaaaaagatccaagtagaggaaagtcat

SEQ ID NO: 1825 - DNA, 1653 bp, Homo sapiens
gagtgccaggtggggctggcatttaaactcttggcttcagagtccaaaaaacctactctgctctattgagtctcagtgcaagcctgaaagggcacgtatgccttctcctgcagtgcctgcacctagaacggctccctcctcgtagttgacattcagtgtggatgaacacgaggtattccaagtaagaagtaaaaataaaatccttcagcacctgtggtactgtgatataataagaaatatgtgtttggtctctgccccctcattcctggcacagagctcctaaaaccctgtggataggggcactaggagaacctcttgttctaatatgttcctgacacagagcaccctcaaacctttgtaatttcctgggtgataacagagctcctaaatcccttagaatttcccaggtgataggagcatcttttgttctaacaagataactgtggtgggctcctggatagccaggatggtggctggttgctaagggaacgaaccgcgtgattacggtgttagaactttcagccccatgcccctgacctctggggaggtgagagggagaggggggctgaaggtcgagctgatcactaatgacagcattgtgatcaatgatgcgtatgtaacgaagttttcataaaaacccaaaaggacagtgtttgaatgagcatccagatagcagaacaggtgggggttcctggagggtgactgcctcgagagggtgtggaagctttgcacccttcccacatgcctcaccctttgcgtctttttaatctggctgttcctgtgtttcctttataatctttataataaattgttccctttataataaatgggtaaacataagtaagtgtttctttgagctcagtgagccaagctagcaaattaatcgaacctgaggaggggtcatgagaaccctgatttaaaaacctctgtcagaagcacaggtcacaacctgggacctgccattggcatctgaagtatggggcagtcttggggactgagccctcagcctgtgggatctggcgctctctccaggtagatcgtgtcagaattgaattacaggacatccagctggtgtctgctgatgaattgattggttgctggtggggagaaatcgccatacgttttggtgaccagaggtgaaatattctgtgcacggtagagggtaggaaaggcactttggtttttttcctacatcttcttggcgcactcttcctcagaggttagttgctgtaatttgttttcctcataaagcttttccttttcaattacaaatatatatttatgcacagatgtagtacttataaaatgaatgttacctctcttgggaaacagactttttttcttcgcaactctttggagagcatgtcccttgaggtgtgacattattttagctgtgtaacaattaactggatctgagttgttttacatcagctaaatatcagtctccttgagatttgggaaatatttaagtctcatcagcagtattttggggaagggggtgctcctgcagacagcagctgctgttttctgtttgtttgttcattgattgattgattgagacacagtctcgctctgttgcccagactggagtgcagtggcatgatcactgctcactgcagcctcaacttgctggacccaaacaatcctcctgcc

SEQ ID NO: 1826 - DNA, 1103 bp, Homo sapiens
agagtgggggaaggggcagagcataaggataaagggggagttgtggttttgtggatctcaggtgtttaccaatgaactaggtggaggtggtcaggtggtggagagcttctgttctgagaacctgaccgagaggcaaaacattgtctctatgtagtgcttggcacaaccgtgggctccgatctgggaaagagtggactcgggaccacagcagatttctctatggggctgcagtcaatgaaattgtcctgaagcaagcctggtctagggcgttctggcctctaagattgagagggatggtggacagggcagtgggccagaggtgaagtgagatgaggaaggccaagcctttttctcctgaggaagccagtgctagggcactaattatagttttacacaatgccagcttccagcctgcatagagaaacatgaaatttctgcttaaaacagagttcctttttccatttttggctctaaactttttgtgttggaagttaggaaccaattttggagagtgattgtagtgagggaatctggaaaacctgcgaaaatggagaagctcattttaggcaggaaaaatctgtctcttggaatgagtagcagagggttttcttgctcaaggtagttttcttttctgttcttggtgtggtgcctgactccacatttttcacccagctcttaaacaggttttgctgagtagctacaggcaagtcatcttctctgtaaattaggtgtagttaataacacctgttactcagagagtgactggattaacaggtaagagtttggactggagtgacccagaaatggtatgaaatagtgagaagaacttgagatcgctacgtgtcccagagaagacaccttccttagatctaagttgaggagactgaattaaacagcctttgttcatttaaaaaactgtttttatttttatttatttattttgagacagagttttgctcttgttacccaggctggagtgcatgttgtgatcttggctcaccacagcctccacctcctgggttcaagcgattctcctgcctcagcctcccgagaagctgggattacaggcatgcccaaccacgcccggctaattttgtattttt

SEQ ID NO: 1827 - DNA, 1028 bp, Homo sapiens
aatctacccatctgacaaaggtctaatatccagaatttacaaggaacttaaacaaatttacaagaagaaagcaaccccatcaaaaagtggagaaaggatatgaacagacacttctcgaaagaagacatttacgtggccaacaaacatgagaaaaagctcaacaacactgatcatcagagaaacgcaaatcaaaaccacaatgagataccaccacacgccagtcagaatggcgattattaaaaagtcaggagacagtggatgctgacgagactgtggagaaatgggaatgcttatacactgttggtaggaatgtaaattagtgcttatggtttttaaaaggcttccagagcaggggacccatatatttagtcccatagaacacatcccttaacctgcctcttagcatttcatctatccttccttatataagttctttcttctggagttgggacaggaggtgtcttgttatttgggtagaaaggagaaagaatgggtgggtatgtggacaaacggtgcagggaaatagatagcatgggaagtgttgccacagctctatggaaactacttggatattatgattaatggatagtcaaacatctctcaaataaatatcaaagagtgatcttcccttaaaggttattgttcccaagtttatccctctcttggtgccctggctctggtttcttttcttctaagttgcccctttgattacttgtcatgtgaatatcaaggcctgatccttcctctgtgtgagctccaaggggccgccttccagtggagctttgtagaatcatatgtgtcatagagaacaggttttaatgctgggctgctgttaggctttagcgctagtgctgagaggccccacaaagagctgaacctactgatgaggcctctcccaaatctaatcagagatgggggaaaatttgggtgctgggaagagcagatcatctcagtgattttaatgcccacctttatttgcaaagtgaaaggagaaatatatttccctattgcatttcctacccttcact

SEQ ID NO: 1828 - DNA, 1028 bp, Homo sapiens
attttagggggacacaggcatgccaaccttagcagcaacttttcatataatttgtatcctaaaaacagtaaaactcggccgggcgcggtggctcacgcctgtaatcccagcactttgggaggccgaggcgggcggatcacgaggtccggacatcgagaccatcccggctaaaacggtgaaaccccgtctctactaaaaatacaaaaaattagccgggcgtagtggcgggcgcctgtagtcccagctacttgggaagctgaggcaggagaatggcgtgaacccaggaggcggagcttgcagtgagccgagatcccgccaccgcactccagcctgggcgacagagcgagactccgtctcaaaaaaaaaaaaaaaaaaaaaacaaaaaaaaacaacagtaaaactcaatagctctggtttattgactgtttattacatgcctgctaagataggcattccctacctggccattttacagatgaaggaactcaggttaaaggaggttaacaaccttgtccaaggtcagacagcacatctggattcagacatcagcttgtgtgacttaagcttatttttctcttcaccatgccagtcctgcctctagcaaaatacacgcagatttcatgataccacttttaatttcagcaaattatgttatcattttcaattaactgataattagctggcagtccttggaaggtagaaggagttctgatggaagccctcatcgttttttattctttcatgacttccacttgaaggtccttgcttactgaaatggaagccataagtcctctcgtcacccttggtagaagggtgctaaatcatccttgctaaatacttgacggaaaccatcagtcatctcgtttggctctcatcaatctctttgttcatatgcacaggctcttaatctctgttttccctttctttagagtaccgtagtctcagatgataaacttctctgaagctaatttcttcactgctgccctggagtgtctcttcatgctgcattctaaacaagtgaagagcaa

SEQ ID NO: 1829 - DNA, 1041 bp, Homo sapiens
ggatttttggaatggtaaatgagcattgacttcaatttaaagtcaccagttgcattagcctctaacaagagagtcatcctgtcctttgaagctttgaagtcaggcattgacttctctagctgcgaaagtcttagatggcatactattttaatagaaggctgttttttctacattgaaaaaatctttagtgtagctaccttcatcagttattttagctagatcttctggataacttgctacagcttctacatcagcacttgccgcttcatctagcacaatatgttagggatatggtttcttaacttaagcctcatgatccagcctctgttagcttcaaacttttcttgtgtggcttcctcatctttctcagccttcataggattgaagagagttagggccttgctctggattaggctttggttcaagggaatgttatggctggtttgatattctatccagaccaaactttcttcgtatcagtaataaggctgttttgctttcttatcattcatgtgttcactggagtggtacttttaattgccgtcatgaacttttcctttgcattcacatcttggctgactccttggcataagaggcctagcttttgacctgtcttggctttcgacatgccttcctcactaagcttaattatttctatccattgatctacagttagagacatgtgactcttttacttgaacacttagaggccattgtagggtattaattggcctaacttcaatattgttctgtcgcaggaaatcatagggaggcccaagaagagggagagagacagtggaatgccccagtcagtggaacagtcagaacatgtacattaatggattcaatttgccattttatatgggcgtggttggtggcaccccgaaataattacaatagtaatgtcaaagatcactgatcacagatcaccataacatataataaaataatgaaaatgtttgagatattgtgagaattaccaacatgtgacacagagatacaaagtgaacacatgctattggaaaaatggtattaacaaga

SEQ ID NO: 1830 - DNA, 1034 bp, Homo sapiens
atgctttgtgatttgattgtttatagatgttatgctagacccctgttgactccaatagggatgacaccatgtttgagagactgaagaaaagacccggaggtatcaaatgagacatagggtttatttgggggactcacgtacagagccgtccagtggcagcgggcttggcaggaagcatgctgctaccttttgtaaaaaacatgtagctcatatagcattttcatttagcatcctccccctggcagcctcccaaaacaaaggtctccatcccctgcgttaaaagggatagggcagggatttggatgtctttaatagacaaagactgaatctccaggttggccactctcagatttcttagcctggaactccaaaccaacactcttctcattcttaggatatgcttcagttatggctatcaggtgcctctgccataaaacaggaagattttttttttaacgtaagaattccttttcttccatctataggttgttaaaatggaagatttgttttaccgaggacatgaaaggcattgcagttgcttgggcattctagaagagggtgctgtcctttgccctggtgttttcttaggtggctgtggcaggaacactaactcttaaggaaatggatgctttttctttcctggtacataatgtatgaacactagtgtgttgttttcattgtgtagtgtggtttaatagtatgataatgtagttttgtgccgttttatagacgtgaagaaaataaaactaatgggcatgaattgatgaagttttcaactgagttaccaaaaaaaaaaaaaaaaagcttcctaatggactttcctggaaagatttgtctaaatgaaaatttggtggatcttaaagaagagaataatttttattgaacatatagtttgtgctagccactatcttaggcatgtagcttattaacacttatggcccatttgtggaacaggtatggttacctgcagtttaaaacaaggatgccagtgttctaagaggttgagttgcccgagatatcactggtatgttaga

SEQ ID NO: 1831 - DNA, 1028 bp, Homo sapiens
tgtacataaataaaagttgaagaaagtacatcctctgtgatttaaaaaaagaaattcaatatacccattaaaaaagtgacaggtgtattagttttctatggctatagtaacaaattactacaatcttgatgacttaaaatgacagattcattctcttatagtgctggaggctgtaagactgaaatttaggtgtgggcagtgttggcctcttctggaagatctgaaggagacccatgcctccgtcctgtctcccagcttctgctgccatttcttgtatcaccccagtctctactttcacctttatatggctttccctcatgtctccgtgtcttcaccttttctgtttcttagaaggacacatgtcatggggtttagggcccaccctaattcaggatgatctcatctcaagatatttaacttaattacatgtgcaaagaccttttttccaaataaggtcatattttgaggttgggggagttagaatatgatcgtagattttggggggcaacaatgtaactcacttataaatggtccactgacccccccaaaatttgtcctgtgtgcagaatgcattcatctcatcccaattaattattaacactgctttgtgaggaaaaattaagaattttgaaaagtgagaagctatacctctgggataaataaaaagacaaatggcagaagatggatagtcgctaatcttttttttagataaacattttgttttgagatagttgtaggttcacaaacacataagaaataatacagagagatcccatattacaaaagacaccgggatgttgacgttgatacagtgaagatacagaacacttccatcgctactgctgttttgctgtttattacctgccccggatttcccgcccctccactgctccctgtccctaaccgtggtccaccactaatcgttccacaattttatacaaatataaccatactgtatgtaaccttttggaattgcccttttttactcagcacaattctctggagattcgtgcaggttgttgtatcag

SEQ ID NO: 1832 - DNA, 1013 bp, Homo sapiens
ggcagaggatccaactggcacattgtgctctcttgatctattcagttttttaagaacggaggaaagtcagctttcgttttgtgtctcatacccagaaggacttcagttctttctttcagtccataatttctgtaataagcatattatctttgctcagtaaacaggtccctagcaagtgggtgggttttggtgtgtcacccaggacaaggggcccagtttgttgtttttcactatcccaacttgcctcttaacgctcaagtaaaaggggaaagaaatagacccagcctcacttgcacccacaagtcagtaataattagtcttccagcaggtctcctctttgtttctgcttcttggagagggcatcataagcagcagttcaccaaagttagcaacaagcctagatccattcagttttttttgggggtgtgtgtgtgtgtgtgtgtgtgtgtgtgtgtgtgtgtgtgtgtgtgtgatgtcttttgtgtttgtcctgtggggacaaatacaaagtaggatccatagactccatattcaggcttagaataaagactgaaattaatcactattctatatggaataatcttaattcagttgcgagggatacattgccccttgaatctcaagcatagccctgttttgtctttgcttggtggtagctgttaaccaggctctgggtgagcctagaacttggtctcacatgagcagtgtagatacctctctgcctttttgtttaagatgatgtagcaggctgggcgtggtggctcatgcctgtaatcccagcaccatgggaggccgaggcgtgtggatcactttgggtcaggagttcgagaccagcctggccaacatgttgaaaccccgtctctactaaaaatacaaaaaatttgctgggtgtggtggtgcacacctatagtcccagctactcgttaagctgaggcagacgaattgtttgaacctgggaggcagaggttgcagtgagctgagatcacgccactgtactccagcctgggcgacag

SEQ ID NO: 1833 - DNA, 1078 bp, Homo sapiens
tcatagagttgatttgaggattaaatataaccaagtatatgtaaagcttttagaatagttcctgacatatagcatgttctgtgtgttagctattattatcatcactcagttaattttgaaccacttaatttccaagtgctggtgagtctaaagagcagagccaaacatgtaattacataaacccagaagtgaatttttcaaatgtcttttctagtaatagagcttaatgagattggcacttcagggaaaagtcctaggaacttgtttatgttggtgactgttgatcagccagaagatctctcagacgcagtctaacatctgcatctttctaggctggactacctttgcggcaccaacagatggatcaggaattaaaactgggagcttctgttgtggggaatctttcatcttctactgttaatagccttgtgggtttccctctcctgggtactactttctctacggagagcttggtctgtggcacaaacaggtgccgaaagggggaagaaacacctctgggtaaatatctggaggtcggcaggtgacagagcagtggtctggggacactggttcaggtgtatgttcatcaccctaccctttaaaactcacatggaaatgacttggctgataagttacttgtggttcctgtgataattaaggcagcctgttggaccaggacaaaggatttcctcagctttcaagagaacgtttctaccaagagccatatactaaggtgtgctggttatgtgagtgttgacctcagtattagtatcacttctgttgaaagtgacagaaaacctctaaaacagggtttaaagatagtgtacctcattatttcagaatgtttgtgctgctgtaacaaaatacctgacactgtgtgattcatgaagaacagaaatttatttctcacaattccagaggctgggaagttcaacatcaaggtactggcagggttggtgtctggtgagggccgctgtctgcttccaaggatgcaactggttgctgaatcctctagaggggactaatgcagtgtcctctcatggcagaagagcagaagagaatgaatccactccctcaa

SEQ ID NO: 1834 - DNA, 1076 bp, Homo sapiens
gcatgtctagtggaccctggctcctaacagctggattcttttgaacataataaacatttctagaacaggttttcttggtgagcttttagcttccttttaataggcacatcacttgcctgcctttagttctatgaagttcaacataaatgttgactttagtgatgcagtgggacaaaacagtattatatttctcatcagttccctccctgtctcccttcccctgtcattgttttccagaggtaaagtacatttatggagaacatcggggtgaatgccaaagcggcttatgttctaaaatagtgaaaagaattgtgcagttggagttagacctatggtttgagactcagctttgggactgagcaaatcatttcacgtgatcaattttctaagctccagtttcctcattaggaaaaaagaagacaaagtaatacttgttgtaatggaattaaatgagataatgtcttcagaatgccatgtaagtaaagaaattgtgaatcaccttcactgatttgttccatagattttgttttttcctttcttaaaataccttgtattgaccttcacctaactttgtatttggacaacacccaacagtcctagcagacctttaaccctcccgactccaatttcagtaatgtgttagaagtggcagggacagaatatattctggattcattcactaaatatagagatattatacaaaatgaagctgaactcacgctccagtgggcagtgtcagtttgcctgtgagacagcgctatgcagctgcagccactaagtgtctaggcactggagatggacggctagagtgggaatcctggctccattcaacctctctttgcctctatgtttgccatcagtggtgtggatatgataataattcccatcacataagcttgtggtatgcaaatgagatcattttaaagtgctgagcccagtacctagcatatagaaagaaatggggcttttattatagtgataataatttttaattgtggtaaaatacacataacataaaatttaccatcgtaaccgtctttaagtgtacatctcagtggtgttgagtatattcacat

SEQ ID NO: 1835 - DNA, 1071 bp, Homo sapiens
ggtcatgcatatttctgctttattgataaggaagagcagctctagggagctcaggattgacctgtggccactttgttggtttggggtagagccagaccagacagacgtcgggattctgtacttcctcacaaatgctttctcgtctgtatcctctttcccaaaacttttctttattttccctccttcccttccccttctgtcctttcctccctcctttcaattgcctcaggactggcggggaggggatggagttgttgagagaaaactgtgagtttctgtttttaaagttcagagtgttaggttccataaatgccaggccatgagagcattcctggagacgccttcagagaaaaaaagaaatcacatctgtttttgtctgcctttattcttcattcaacagcaggtttttttaattccaaggagaaggatgtctgccgtgtatttctgtttcatggtgaaagctcagaagtggtcaaaggagacctttgtcccggccgtgatcacccttggctctttggtggtggtccgagggctctgtaagaccatattagccaagtctttagcccccgcttgaagtctgtgggggcaaggaacccagaacccagcccagccagatgttctggcccttgttctctgtcccttgctagcccctgcctggcttggcccattatctgctctgtgctttgcaggaaggaggagacagttactgtctatcccgcagacgtggtgctctttgaagggatcctggccttctactcccaggaggtacgagacctgttccagatgaagctttttgtggatacagatgcggacacccggctctcacgcagaggtgcgttctaaaagcctcaggtggccctgttggtggccaccttgagggcgggggagctgggagcctgtgacaggaccccacccgcctgagtctgaagcccatgccttccctgaggcagctgtgtgtcgcatggtccagcccggctgcgtcagtccagccccaggatatcctgctgcccagacacttggtaacatttgagaagggattagtcacttactgtttgggataacgaaaggctt

SEQ ID NO: 1836 - DNA, 1029 bp, Homo sapiens
tctcttccacactggacacaggtggctccctcacttgtttccagaggtcctctttagagctagcacctgtctcccacaagcccccgcccccacccccccaaggaaattgaaggagaacagcacagaatgggatgcagctggggaaaacaatcttggcaatcctgcacagaccctatcagactgcagacagccatccacctattactgtgcctactacagatcctggccacagacctggatgcaaacctcaactccaaaaactagtctatggagttaaaagtcaggatagttcttactgtggggaggagggaagggaaggggttggggaggggcatgagaggggcttcagaatggtaagattctgtttcttgatctgggtggtagttactgggtgtgttctctttgtgatactctctcgagatgtacacttaggatttgcaatcttttctgtaaaatatttcaataaaagacatttattttttaaaaatccaagtttcacttcttattaattgtataatcttggacaagtcacttaagctctccaagcctcagtttcttcatcccacatgatggggccatgataatgcctgcctcacagtgtggtgaggaacacatgagcgaatgcctacaggctctcagtacagggcttagcatattgctcagtaaacactagtgtctgctgtagcttctgttgctcaggatgcactagactactccctgcatgggtctactctgcttccatgactttttgcatctccaggtctctgctcacacactgccctacctgatcttctcctcctggacccccatcaccaaatctcattcagggcacacactgaagactcttttccttaccctgggtttatccttcgctttagcctttgtttatcttgtgtccctgcagcccctggtgaacagtctactggacccttagtttatccctctctttctctctaccatcaggctaggagcacagccctctgtaatgtgtgccttggtattgcagcaagcacctggcaagcccgtgct

SEQ ID NO: 1837 - DNA, 1025 bp, Homo sapiens
gcagtctgtttccagatactctcctgtgtgcttgttatgaactgaattgtgtcccctcaaaattaatgtgttgaaaccctagtctccagtgtgactatgtttggagatagggtgttttttatggaggtaaatatggttaagtgaggtcataaagatgaggctctaattctatagggatttgtgttcttggaagaagaagaagaagtaacacagagctctttttccatgaacgcagagaaaaggttatatgaggacacagagagaaagtatcatatgcaagccagaaagaccagcctcaccagaaaccaaccctgttggtaccttgatcttagattcctagcctccaaaattgtgagaaataaatttctgttgttaaagccacctactctgtggcattttgttatggcagccccagcagactaatacagtgctcctagttccattctgtacttcatgtgttgtagcacttgccatcatacttctttactcttctgatttgaactttggaacatagtagctgctcagttagtaattgttgagtgaatggtgaatgaatgtgacttaaagacacagaatggttctcaggtcagagtaaaatatgatggaaataatgactatatctaaatacagaagggggctggtcagccccagaataacaataaaaagcctatcttaggctgggtgcagtggttcatacctgtaatcccggcactttgggaggctgaggcaggtggatcacttgaaatcaggagtttgagaccagcctggccatgatggcaaaaccctgtctctaccaaaaatacaaaaattcgctgggtgtggtggtacatgcctgtagtcccagctacttaggaggctgaggcacgaaaattgcttgaacgtaggaggcagaggttgcagtgagacaaggttacacaactgcacttcggcctaggtgacagagtgagactctatctcaaaaaaaaaaaaaaaagtaaattttagaacagtgcccatccaagtagcattcagaagagaggtgtttt

SEQ ID NO: 1838 - DNA, 1045 bp, Homo sapiens
ctcattcaggctgagaactccggggcttcctggacaaggcctaatcttgagcagtgagcaattttgcccccacccctggacatttggcaacatctagaaacactaccccctttccccacccctggatatttggcaatatctggaaacacttttgttggtctgacttggtgggggtgcgttggggactgggagatcctcctggcatctagtggatagaagccaggggagctgctagatatctacagtgcacaggatgcccccccaccaccacacacacacacacatacacacacaacaaagaggtaactggcccaaaatgtcagttgtgctgaggttgagaaaccctgctctagagcattagaagaaaagaatctgtttttaaaatatgtattttggttatagagaattatgttagggtgatcagtgaaagcttttcaagcataagaactatgataatatattaggataaaattccatagaattgaaatagaaatacaattttaagtagaaaaaataaaaaatgtgctttgaactgagtcttagtcattatggaatcagccaagggaagggaagggggttgcattccaggcaagaggacagcacaggcaaaagcactgaggagaggagcttgggtgcagagttaggagcagctcctgcagctggaacctgaaactcatggcagggagtggaaggggatcaggtataggaggccaggccaggggccagagccagccaggaggacatgcagtgctacgccagcgagtttgagctttctccttagctctgtggaatgaggccttagcccatctttctaagggaggcctcaggctctctacagccaccatgctaaggcctgagtggcctgctaagaaagcaaagctttggcatcagactttctagctctgtgaccttggacaagttacttaaccactctgtttccttacccataaaagtgaggtagtgatccccatgtccctagtttagcggattcagtgagagaatatatttatatgattgagtgtcctatacagtgcttggcccatag

SEQ ID NO: 1839 - DNA, 1032 bp, Homo sapiens
aagatatattgttacttgtgtatcactaaaaacaaacctgccaaataaactgttctttcttatcacttagaatttctatactgatgagagaatatccctaaatttatttagacagatttttattacatagaactcttgtacttacatgtaaaagaatatataagtgaaataaattggcaaaagtattttttattttgagataattttagacttacagaaaagttgcaaaaataacacaaagtttactattctctgtttccttaattgctaacattttaatacattttctttataattttgtttctaaatatatatacactttttcaaaaccacttgagggtaagttgctatcattatgcctctttatacctaaatacttcaatatgtgtttcctaagaataagaatgtttagtctacggccatagcaccctgaacacacctgatcttgtctgatctcacaagctaagcagggattggcctggttagtacttagatgagagactgcctgggaatactgggtgctgtaggcttttactgtgtgagtgcgtgcgtgtgtgtgtgtgtatagaacatttatattaccatagtgtaatgatcaaaatcaggaatgttgaatataggacacaatactattatctaatccgaagaccatattcatattgtattagttattccactgtgtcttttacagccaaaaaaattctagagtccagtccaagaccacatgttgcacttagttattatatctctttaatctggaacagttcttcagtcttattttcactttcatgatctggacatttttgagtacaggccagttactttatagaatgtttctcacttttagttgatctgtatttcctcatggttaaattgagattatgcatttttggcaggaataccacagaagggattatgtgactgactgctcagtgtgtcatatctggaggtatatgatgtcagtttgtccaattactgatgatgataactttgatcacttgtttaatatagtacctatcaatatttctctat

SEQ ID NO: 1840 - DNA, 1065 bp, Homo sapiens
cagtgataatgtctgtatttttatagtactttaaaatttatagccacattctcattttcattacctcagttagtcctttcaggcaagcgttactatacccattttatagtcgagtaaaataaaacttagattaagtgactttctcaaggtcctgtgtttttataagcattaagtgtgggtaatagcaagacttccagcttagttgttatttaggctgtgtattaaggcactttggggctctattgtggagagctctgaatcctttgtgttggtgtaagagtttggattttatttgctaggcagtaggaagtcactgaattttttttttttaatttttttttgttatggacagtgccatgatcagagcccttaaagtttagcagctaattagatgcaaagagattatcaaggttttgagtttaggttatccagaaaagagcattaccataagcagatgtagggatgttgggaaaaggagccatttggggagtaagtcagtgaattcactttgacatgtcatttgagacatgtttgggtgggtcttattgggttgtagattccttgtgaaaattgaaaattttttagtgaattaaatgtttgataaacattaatactagggttgaaatttatgctcatgccactgtgcgtgtggactgagtattgaatctgaacgttgtaaattctagatatctcattttggctttggcactgtcttctaaggttatttccttcaacaatacgatggtgataataccagtgttagagggatgctgtggggagtatcaaattgatagcagaagcatttttaaagtaactctgtaatagtttttcttacatgagcacaggagtaaaatcaggaattttattacttgtgctgctgtagagaagcagaagctttagcagccgatggattctgtggggcacctgactgtaggttgttcattttttggtgcagccagcatcttaggaggaatggacactcctaatactcttctgaaaactttatacagtggaggtgttgcattgtagcaaatacaacttaccttgatttcagggcattctgtt

SEQ ID NO: 1841 - DNA, 1064 bp, Homo sapiens
gaagctaattacacatgttaaccttgggataattttcatctggagcagcatttatatttttttgtgacccagttggtgaaatagaaaattaggatttaccctgtttacatgttattttgataaaaacataatttaaactatttcagtgttgtcaaatgagttgtgacttaaaattaatatgcaagcaaattatgcaaaaaggtggatttgtttaccactttttaccaaccacttcctttctcccataccaagctgttactaaactagggctgtagctttcagttgaggaaacatgacggttgattattgtttctaataatagctattattagaagtcagctatttcatggcattggtttccagtcattcacacctcatttaatcatgccctgcatcaccttgttgagttgttaatgctgtttatttctcaatttttcttttacactacattgctaagtccccccatcttcctcttcatagtgctttccctaccctctgagtacttgcttcttcatgctctggccaaggagagtggtgttttggcagactgttttatacatgtacacttatatgccaatcatcattagttagaaaggaattggtgaaaatgctcttatgttatgagagacatgttcaacatcacaatagtctgagaagatgaattaacaatttatgagtgttgctggaaagtatgatttcaggcgattagactataggggcaaagccattgccggcttatgctgttggaatcacatcttagtagttacataatgccatcaggaccagtacgagactggtttggtgattgagcccatttcctgggatttgttcctatgtattgcagacagatgtccacgcttaggtgtgcatgctcctgtcatgcatgtacacataatttttaaaaaaggagtcatagtgcatatcctattatatacttgctgtttttcccccattgctctctattctttagttcactcatttaaataagataaacattttaatgaaatcatattctttgcagtaacttggatggagccagaagccataatcctaagtgaattaat

SEQ ID NO: 1842 - DNA, 1145 bp, Homo sapiens
ctagttataataaatacagtgcttatctggtatagatgccactgctttacaagagtaaaagaacatatgtaaaagtgctgtccatgggcagcagttcaaggggtaattttaattcgtaccacaggtatacatacacattgtaaactgctttagtggcttaatggttgtattttgacattgtagtcaaatttgatactcccaccccaaccctcacttttatgctcattctagcaagtgctgggaatgctaaaagcagaatacatagccccttgaagaacaatatacttaaaaagtgatcaccttaatacagacatgaaagtttcctctcagcattaagctagagtttaggtgcttggaatgattgaaattgattttttaggtagaagggccagatggtgttgggacagttggccggccatccatttgaaaaacacaaaaaatgtatgtcgtcagggttatactttacaccgtacacaaaaaagaatggtggagagattaaagattagactgttcaaagaaaaactcagaaaaatactaagacaaaaatacaaataatttttatttagttttggggatggaaaggcttttttttttttctttaagctatgaataggactttatggaaaggcttttttgacatgacacacaactcaaatgccataaaaggaaaagatggatagatttaactatataaaatatttatggttctgccttctgaaagactctacaaataaaattaacataatatatggtagaaaagtattagcctgtatggaacatagagggataatttttcttactatatcaagttctcttagacattagtagtacataacaaataccccagtagtcgaagtgtatgaatagtcaattcatgtagaataagggctgtgaagatatgaaccctgactagaagcctctgctgtaaagacagaaccttctttaagtccgatataaaacaaaaggatgaagaattacaaaatgtatgctttggtagggcagtgaagaaattaaaatattagaaaaaagagtaagagttgaatactggccattgttttagaggtaattgaggaagcgtattttatatactcgtgggtaattttactactttaaaggtggaaaaaatatttaaaataatgaaataa

SEQ ID NO: 1843 - DNA, 1105 bp, Homo sapiens
atctgtccttcattttaaaaaggtgaaatttggaaataacctaaatggaactgttaaatgagctattatatacctatgtactttatggaaggagtaatactgtatttttaaaaatcatcaaaatgaaactgacccagtaatcccatagacagtaaatcgattagtttatacttttagatgctttaggatataaataaattggtaactatgaaccacgtgctatagagtttaatgctaaatgtaattttacaagtaaatcaggttatatatatatgtgtgtgtgtgtgtgtgtgtgtgtgtgtgattgaattttttttttttccttaaagaaacagggtctcactctgtcgcccaggatgaagtgcagaggtgagatcagggctcactgcactctcaaccttctgggcttaagtgatgtaactgcctcagcttctcaagtaactgagaccataggcgtgtgccaccatgcctggataattttgttttattttttgtagagacggttgcccaggctagtctcaaactcctggccttgagtgatccttctgcctcgacctcccaaagttctgtgggattacaagtgtgacctgccacacccagcctgtgatacaatttttatatctccgaattttaaaatgtttggatttgtaaaggattcttctaaaatggcatatattctaatctttacctaaatttcctcgttacccaactttttcctcatccaaagcttctttttgttgttgtttcaaacctgaaaatatccatccccacttgagtttcagttttgagctatatagtacttactaggcttctatcaattggaacattgacctgtttatagtttttttttaaaattctgtctataatacaatgatccagtatacatactattccatactgttaactttggtgtaggaattctgttgttggtcagtaaggtaagtggaatatgtctttatgacttattggaaaagacaaacctagcttggcttttctacgtgttttacatatgtacctttgaaaaggtatgcttaaatattaaacaaaaagtacaagtagaatatttataccatgcaatcaaactgtgcagattttgaatgtttaa

SEQ ID NO: 1844 - DNA, 1119 bp, Homo sapiens
aaaagcattgcaggaaattgatgtgtgattattcttttgagtacagtgccctttaagaactcagtgggtagttatgtttacttgtttaactgcatcacatttattcatgatagacaagacagcaagttagtagatgaacttaatggatgaatttgttttgctttgttataccttgcaagaaagcacaaaacaatcatctaaggctttatcgtctaatttccatcaggtactgtgttacactgatttgcatacattgctggacttatttttaacagccccctgaactttaaatagaaaaggtagctcctatcctggaagaactcacagttcggtagggaaagggaggcaaggagcaggaacagatgagtcaactgaaattataataccctgtgataaatgctgtgaaggatataaatcctgtatgctatggaagtaatggaataggttcacttaacccagtagtttgtggggaggagggagaggaagagtcaagaaagacttctcaaagaagatccccagagctgagggataataggaattaggttgggataaggcggttgaggggagtatgttccttgtagtactgaacaaacacaagagcatctaagagcatttcagtcttttaactacaataataggtaacatttaatatacagtgcttattatgtgccaattgctattccaagtgctttgtattttccatgtattaactcctttaattttcataacaactttattatgtaggtattataattatccccattttacagatgaggaaactgaggtacagaaagagaaaataacttgtctaggatcacatgatgagaaagtagaagaactaggatttaaacccatgttgtctcatttcggagttttggcttttattatgagaaaagttaaactctggattgcaccggagataagtacctggggtgagaaaaccttttcaattaattcttcttactgaaacacatatattattttcttaaaatctgaagcagtggatcctatccatttttttctgcctctgtaagaatgtttggcatcctttatcttctcatctccaagctttccctagtaaccagccctcttaaacttcagcattctcgaacttctccc

SEQ ID NO: 1845 - DNA, 1025 bp, Homo sapiens
taaaataattcagctcactgtattttttgtttcttcgttatatctttttttttttttttaaacagagcctcactgtgtcgcccaggctggagtgcagtggcactatcttggctcactgcaacctctgcctcccaggttcaagcaattctcctgcctcagcctcccgagtagctgggattacaggtgcatgccaccatgcttggctaattttgtatatatatatatatatatagttttagtagagaccgggtttcaccattttggccaggctggtctggaatgcctgacctcaagtaatccacctgcctcggcctcccaaagtgctaggattacaggtgtgagccaccgctgcaagtctcttcttcatatcctgattatttaaatcaaatgtatttcttttctgaggtcttggagttttccccatgttttaaaatgtgtttccttaccttttaacttataacagaatccctttaagacgcttttacaaatgaaggccatgctatttgctattaggattatctgaacagaccaacagagagtatatttgaccaacagtccaggtttcatgtgaagaaggagaagcacgtatgtttgtagttctttgtagtttgtgcctacaaaacagcagtcaccactaaaatacttatttgaaatattttaaagtgctgagattacatgcgtgagccaccgcgcccggcctgaatctgtttttaatgttaattttttatttttctcactgaaggggaaccagcgccctattaaactccattgttggtaatttgagaacacaaaccaattaatatctatattctgaataattatatagttaaggtgcagcttttattatatctggctttttactttgttgcaaactccaaaccaaagaatgttcataactgtcctacagcagtgaaatgaattaaagtaattctggtcattagaaaatctttaaattattttaagaatacgtaactgactgtgataacttcttgtttataacaggttaacatggatgactagtttat

SEQ ID NO: 1846 - DNA, 1516 bp, Homo sapiens
taatacaataatagtcattagacaaatagtaaattttaaaaagaataaaaattaaaaagaacacctaactgggaaagtgggagagaagccatttaaaacaataaactgaaactcttttcctgagtttccttagaagccatttggacaattaatggagagattttaaacattaaatgtatttgtgactaaaacttgccttttcaacaagacacccgaactgccaagacttcacaggggtctcattgtagagaattaaaattcaatgatggttgaaagagaaaaggcataataagattggtcagacttctatatttattcaaagattgagcatgaaaagatttggagctttacagtatttcaaggaagtaggatgtgtaaaaagttgagatgggtggcttattttctgacatgagtagattttgatttaaaacattcaagctgtgccctggggagagggatgtgtaaggagggaaggaatctgatgaaatgaggacctcagagagtttctgtggaaggcttagaactggaagtggtgaattagtgaaccatcaagaaagagaatatttttatagacatttataaatttttatttccacaaacattggaaataatgtaggaataggcaaacaatggtcctcaggtcaaattcgtgttttctgtttttgtatggcccttgagctaagaatgatttctacatttttttgtgggggaaaataaaaagcataatatttcatgacattataattatatgaaattgaaacatcaatattcataaacttttattgggatataaccatacccatttgtttatgcattgtctctgtaatatctatagctgcttttatgctgcaacagcagagttgaatagttgtggcagagaccatgtgtcccataaacactaaaatgtttactttctgactttttacacgacaggtttgctgtccacagaaataaaagaatgtccgcagtatgttagaatgaacagtatacagttttttgtaagactaggaatacttgccattaataaattcattttctgtattcttatatttgcttatcaggaataaatgctttttttggtgaatggttttcattctgaaaaatgtcaaaatagtaaatattaccttttttttttttttttgacaatgcccccttttttggctgggaatgttcttactctggttttgtaagtatgttcccacacattaggatttcaaaaaaaaaaaaaaaccatattcagaactgtattagtcagttcttgcattgctgtaaagaacttcctgagactgggtaatttataaagaaaagaggtttaattggctcacagttccacaggctgtacaagcgtggtgggggaaggcctcaagaaacttagaatcatggcagaaactgaaggggaagcaagcaggtcttttatgaccagagcaggaggaagagagagaagtaggaggggctacacacttttaaacaaccagatcttgtgagaactcactattacaagaacagcaagggggaa

SEQ ID NO: 1847 - DNA, 1080 bp, Homo sapiens
gcttgtgttctgttctcttttagacagtttttttgtgaccccattgtaatgtaaaaacatttaaatatttgccaaattagttgaattataaatctacatttttacatagggagacaaaatataatgaaaaataattatagtaacttggaagagacttcaaaagcagtatccaaaactgcaaattatgttatacagtttaagcacttagttcattttctttgtaataaaacttattccacaaatacgtaattatttacaggattcctacataaataaggaactactaagattgcatgaaggctgggtgcggtggttcatgcctgtaatcccagcagtttggcaggcagaggcgggtggatcacttgagctctggagtttgagactagccagggcaacatggcaaaaccctgtctctacaaaaaatacaaaaatcagcccagtgtggtggtggtggtgtgcgcctatagtcccatgtacttgggaggctgaggtgagaggattgattgaacccaggagtttgagcctgcagtgggcagtgatcgtgccattgcacttcagcctgggcgacagagcaaggccctgtctcaaaaaaaagtgtagcacgaaaaccacatgttctcttttgtgttgagatatgcatatgattatacccttttatcaaaatttagtaaaagcatttcttagcttttgctcaaattacagattctatatgtctgtcctaacttgtcatccatccagctgaagcgtctcaaggtcagaatcatgtctgtttcatctttctgaccccatggagcagagtacagtgcctatgcatagtaatctctcaaaattgtttgttgagtgagtgaatgtgtgaacattttatgaaattatctttaagagtagttactcatgatcagtatactttaaaagatcggcaaaacattgatgactttttaaaaagtaattttggccaggagcaggggctcatgcctgtaatcccaacactgggaagtgaaggggggaggatcacttgaggccaagagttcaaaactaggctagtgaacgtagccagaccacatcgctacaaaagaaaaattt

SEQ ID NO: 1848 - DNA, 1035 bp, Homo sapiens
gtttggatatttgtccccacccagatctcatgtcaaattgtaatccccagtgtcggaggtggggcctggtggaaagtgtttagattatgagggtggatccctcatagcttggtgcggtcttcttgatagtgagttctcatgggatctggttattttaaagtgtatggcaaccccactccccagtctctgtctctcttgctcctgcttttgccatatggcatgcctgctcctgccttcactttctaccatgattgtaagcctcctgagatctccccaaaagcagatgctgctatgttgcctatacagcctgcggaacctgagccaattaaacctcttttcttatgcattacccagcctcaggcatttctttatagcaatgtaagaatggcctaatacatacatatgccctatgagctggcagtctcacttctgtgcatttatcccagagaaataaaaaattatgttcacataaaaatatgtatacagatgtgctttacatattatatatgagtcctgtatcagaaatgtgctttgccaatatttttccccagtgttgacttgtcatcctctttacctcctatgtacgaatgtttacagcaggtttattttaataacctaaaacttagaaacagccaaaaagtccctcaataagtaaatgcctaacaaacagtgggacattgctgagcatggtggctcatgcctgtaatcccggctacttgggagacagaagtggaatgatggcgcttgaccaggagttcaagaccagcttgagcaacatagtgaggacttgtctctaaaaaaaattgttttttgtttgtttgtttgtttgtttgttttttaattagccaggtgtggtgacatgctggtagtcccagctacttgggaggctgaggcgagatgatcgattgagcccaggagttcaaggctgcagtgagctatgattatactacagcactccagtctgggcaacagagagataccccatctctttaaaaaaaaaaaaaaccctgaaattaaaaaacaagcaaactgtgg

SEQ ID NO: 1849 - DNA, 1210 bp, Homo sapiens
acagaagtagatataacaatttgaatttccccattgtaatctgaatctatgacttctgtacgtacttgcactccttttaaatttaaactagacatacctagaagtaatcctaccatcctcactggcaagggttgacagattcctgttggcactttttgtgggggttccccaggcagaaggctcacagcttttgggcagcataaatctactgcagcactaccggctgtggcgggggacaggcattgtacaggggtgagggaatggcctgagccagaaatgccccggtttgggcgctacttgccgagaccaggtcggtcatggagaccctaacccagtggcgctagaggaattaaagacacacagaaatatagagtgcagagtgggaatcagggctgacagccttcagagctgagagccacaaacaaagctttacccacatatttattgacagtaagccagtcataagcattgtttttatagatttagattaaaacgggaaacaaagagatgggctctggctggttatctgcagcaggaacatgtccttaaggcacagatcactcatactattgtttgtggttcaggaacaccttaagcggttttccacactgggtgagccaagtgttccttgccgtcattccggtaaaccaacaaccttcagcatgggcgtcgtagccatcatgagcatgtcacagtgctgcagagattttgtttatggccattttgggggcctgtctatggccagatttgggggcctatcctcaacacgttcttgtcttcccaattcctatgcctgtgcctgaaagcacttagtaaatacttgtggaatccattaatgattgaaatcagtgacttggcaaaacactttaaactagaatgaaagaaagacagttatagaagtaaagaaacagtatggtaagataggatcatgtaggataggctagacagataagtttagtgaaatggtaaaactttaatagagctacacaaagatttaagcttttacaaccaagaaattcaggattggattttgtaatagatttagttttaaagaatgccagattgttagagtgaacagtagatgagctatgtatatagctgtaaaaatgtaatatagcacaggttaaaagagaccagaaacatgtcatttcaaaccgctttctggtggagtagctttctcagtgagccaccacttaaatgacttgatgag

SEQ ID NO: 1850 - DNA, 1062 bp, Homo sapiens
actctttgacatttacttagttaacaattcaaaaaaaggaaagaaaaatacctttttggaatatttttaacacatcattttagaagtagaaattacatctcttactttcagttaatagtaagtattatttaaacagtcttcccattgtgcaattttatttttgtgtgtatgtgaagtaatgttttatttttgtgtgtatgtgagataattttgttaaatgcttttgaagctcttgacagttcagtagaagaatctgagatgattcacttaaaatacctgtgacatagtctttatagatgggaaaattagaatatgaattgtacaaagtcaggctcatgacttgttaagaattatgcttatttctgcggtgcccacatatgtgagaaaactgttactctttttatgaatgttaactgattgatcattttttccactttcctttaaaattcatttaaaggaagcatggagcagtatgtatgctaatggtatattctattacatttgttgtgatctctgttgactttcatgagattttggttgtcattcagaaagctgatttttcactaagttgtacacctgttcctttcaaaccttagtatgctttcagatgatatttaaatttctctggacagtgagaagaaggaagttgtagaactgccctcatttatgaccacaaacatatgaattttaaccctttgaacattagaagaccaaaccaaagttatgacagaactgcctaagcccataagacaagcatcagttacagaaacttttactgtattggaaaagctattacacatcttcttgttggaaatgaaacttataaaagaaagactcctgattttttttctcatctgttatgcatggggataattcgactgtaaagaacatggttgagaattctgtctagtgattgttttgattttctagttagatgtttaagcagatgaaaaaatgtgctctttggtcaaaaacagtatagtttaaatatttgttctctgttaataactaaagttaaatggttcttaacttatttaaccactaaataagttaatgtgggta

SEQ ID NO: 1851 - DNA, 1045 bp, Homo sapiens
caatatagttcttgttaaaccagaatggagcatttgcaaatttcagacacttaaggattattttccttttgaacttacgtttatccagaggccatttttaatattcttactgcttttattattattttaaaatttattacatattttattgtgtagactacattctgccctggccaagctgctcttataagcctgagagtagaaatactaattttgtttggagtacctttatagctaatttttaattagtgggtcattgaaagtggctgaagcatttccagagagcctcaggagctcagtgaaggatcttggtggtttagaagcaaataccaaacacctgtaggaaagatagacctccctctagtgtttgatttaatagatgtcagttacaggatatggcttctacaagattctgatcagtacgtattgagaaacttgccctggctctgcccactggtgcacatggggattttaaaactttaggtcaggggtgggggtcaagggggagaagggcgctataattactgaagctgtgcgaataggaagtgacatctgaattaagattatacttttgttaaatgactgaataagcaattgatctttttgccatgaggtaacccagtaacaaatttagaattttaaaggtagtatccatttttgttcattactaatagaaattgagaacattaaagagagggtttgtttctaaaatgctgttttcagtacagattattagagattgtctataattttctcccttagagagcagcttagttttatttcatgttacttttttcattttttttcctaacagatattaaagaatttttggtataaaagaattttccagccatgttatactttacatcttgcttgaagccaaaaactagactacattattctttcaattagatccattatataacatcctggcatagagcaatggcaatagaagccaggggtcaattttttttttttttttttttttttttttttttttttttttttttttttttttttgaaggaaggaaagggagtaatttaa

SEQ ID NO: 1852 - DNA, 1051 bp, Homo sapiens
atctgatattcaatattttttcatttttattatctatttcccaactagaatgtaagctccacgaaggacattatttttgtctctccactgctgcatctctgacacctggaacagtgcttgctatacagtatatgctcaatacgtattttttgaatgaattaatcagttaatgaataggcctgagaactacttaagagcagtgactgtggtgtattcatttttataacctcagcatctggaatatcaattctcaataaatatttattgaatacagcatttatttttacagcaggatcttttgctatgtgatattcctggttctcatttgttgttgtttttgtttgttcctaaataattatataaaaatagaaaatgcacataagcaaaaataattgtttcattcaaaataggagatgattcagtcatagtcttgtgtatatgggcgtaataattttatctaaagccatttcttataaaggtaaaactgttcattcaagggaagagaaatttctactgaactgtaaacatgaacacatcagttggctaagatttaagaaaacagctgaatatttttatattcatatttcaaagtaatcattgctttggagtagattaaaaataaaggttgtatagggtttcaggtgagttttgattaataagaaaagattacatacacatcaagttagattaagttcccaataagccaatgatactaagtattattgggaggcaaagtcatttcagaacaggtgtactatacttaatgtagtttcccttgccccctgcaagtaggatcatatcagatgagagaataaaaagagtaccttgcctttttacatattcaggattttggtctccgttgagaatgaatcttttttgttcttttgttggaaatgggctatttacaaatattttccagggttccagaaaactcagttctctgcaaccaactttcttactctgatttaattctattttgtcgtctgtgtgattctgatacttagtctgagacctatagtaacaaatgtatttccatgcatttagctaaaga

SEQ ID NO: 1853 - DNA, 1050 bp, Homo sapiens
gactggcagaattaatcagagcatttatgttaattagccttgctgcagtccccaaaacaggtggtgagaaatatgcaaatctatgcagaattttaatgctttgcataaccagttttaattaccgtaaaattttctcttcgtgcccctctctcttgactgcagcattttctctctgagcttgtgtgttagttgatgggagttgctagatttaccgttctgtaaaatattaggtggaaagttctgtggatcaagtgatcattctctgagatggtatatggagaagtttcagactgaccaccaggtgtatgttaaaatattggtttggaaggtctaatgtagaggtgaattgaaaatatattcttccctttaccccctatttctagagttgaggaattgggggctatgaaaaaaatctataaatttgtgggggatgactttatttttaaaaattgtaatagcagctttgctggcattagaattaacaagtttaaaaacttggtatgtgaaactaggaaaatacaaataaaagaaaggaggtaaaccagaactcatgactgaataagctcatgttttaaatgattcctaaaagatggggttttaagtacatttcttttaatcaaccatttgcaatcttttatttcctacccaccccacctcagtctaaatctaatgaagaatcgggggattcgcagcagccaagccagccttcccagcagccttcagtgcaggcagccattccccagacccagcttatgctagctggaggacagataactggggtaagtgttcactgagagaattataacaaactttttctgtgtcagaactgccattggccaatagctgattagaattgttcaccatagctggtagtaacatggctatgcctggcactattgtgtctttaaggaacttcctacactgtaggtagtaagttgctctgaaaaaggaattatctttgtcgtaagttttcaggatatcttttattagaattgtggatgctctggataaattaaaaaccttattaaacccctgtttcaggtgttgctt

SEQ ID NO: 1854 - DNA, 1035 bp, Homo sapiens
gaatggaagggctcgcggtgagctgtgaatgtgaataaagaactgccaaactttatttcagcctatgaacaggaagcaggcaggcaagcgaggctttctgtcatacttttccaaaatgaggggtatctttcctcatgcatgcaagtacctacactagaatccttagcgttccatagtcagattttattttctttcaagagtaggtgactttggttctgttcatttgagaggtctggtagaaggagggaaaggcccactgtgagagctattatgtgaatagcccttgaatcaccctgttctctgaccctatttccatctacctcagtatctgacaaataactctgagctgggactctctgtgaggctccatcagagtgaataatttcctcctctatcatagtcttctcctgtgcccttctggattatggttgatttctccaccatccagttttatcctttttctcatttctgcaaatctgtctaaatctcaaaacctctgatacctgtcaccagagctctttttcccttttgtatctctttactattatttggaataggattttagaaatgaagggaaaaaccatatccttagcactatcttctaagaaaaatcatgtttgattgatgtggtcatcttattttcccataggtacgtttgacacataataggtccttggtaaacattctaaaatagatgcaagtgagcattgccatactcctccagaaagacgagtgttccattgtgtctcaaaaacttgtaaaaattccacagcccttaataatctcaaccaaacatgccccgcccccaattcattttccaaaatatttttcatagtgacaaaattgttgattcctcaggaagatatagcaactataattatatagccaccttaacaacaaaggcccaagatacaggaaacaaaaaggaataaaattcaaagaagaaatagacaattcaacaataacagttgcagacatagtatttatttgagccacgttaaaaaaaaaaaaattcaggccatgtgcagtggctta

SEQ ID NO: 1855 - DNA, 1027 bp, Homo sapiens
tcaggcacttttttctaagacctcacaaataatttcttttttttttttttcttgagatggagtcttgctctgtcgccaggctggagtgcagtggcgcaatcttggctcactgcaacctccgcctcccaggttcaagcgattctcctgccttagcctcccgagtagctggaactacaggcgcgtgccaccacgcccagctaatttttgtatttttattagaggcagggtttcaccatgttggccaggatggtctcaatctcttgacctcttgatctgcccacctcagcctcccaaagtgctgagattacaggtgtgagccaccatacccggcctacaaataataatttcttagatcttaatttttatgcttttatgagattcatagtatcattgtatgttgtttttttttttaccacaatggactttttgagagctaatttttattacagaatagttgtttgaatgtagagaaggcatgtagtcatttttatactatgttgttgttgatactgaattcttagaaaagcatataactttctgtttttcttctccttgttttgatttttctgaggagacccctaaggagatttctgaatgaaaagagctttacagaagtttttcttcttttgctttctttttcttccccagagcagttgtattccataattagagcttctatgattcttttgtttcttgaataggaaacaggcaatggaaaacttctctgtttctttcattgctcatatctcttaaagtagggttcctagctgtgatcctaaaatgtttggttttgtagttaatttccataaaagcactaaactaggttattaaaggacagctttactaggtggtaggttaattattccattgattatagagtttggctgagtaaagccaccattcttccaaaaccatttacaaaaggtcatcttctaatctgtttgtcttttcaggcacttcagacaccacctccaacaacacagcaaccgtgatttccacagcgcctccagcttcctcagcagtcacg

SEQ ID NO: 1856 - DNA, 1003 bp, Homo sapiens
agacatcactaattaattagaatttttttcttaaaatagttttgctaagaggctgaggcaggaggatcacttgaggccatgagttcaagactgcagtgtgctatgatcatgcctgtgaataaccattgcaccccagcgtgggtaacacagtaagaccctgtttctaaaaaaaaaaaaaaaaaattaaagtgttttgtgcataaatgagaattctcagggccaaaaataactattagccaacctaaattaagattaatatttcacaggtaatatctctaacagtgtactagagaatgttaattacagacaaaaccaaaccatggcctagattaccttacattatattgactttctgattgactaaatcatacctgaattggttagctctaaagcttttgttatataataatttttttttgcaatagaatttgtgataaatcactttttcttctgctttattgaatgtttctgtgctgtgttgatactacaaaggcaaaatgtcttccctagggcatgattgacactctgaaaagatactaagtttggaatctcagaaaaacttcaagctgcactgtctcactgttctgtactatttgtatgagcaaggccaaagtcagaggcattcccttcagctatattttatgtaagaaatcaaatgtgtaatgccgttagaaaatccctcaaatctacatgtaggagtgaggttatatggctagagagatttaggaatgttgccagacaacaggttgagatactaaatgagagtctcgattattttaaataaaatgttgatgatgccttctttggggaagcaacagcatcatagaaaatttctcacccattaaagcacatcctagacttagatcacccacctacatcattatgtctaatttcctgctacaatagattcatcattctcctttgcacaagtcatagaaatcaagtatttagcctcaggaagtgagaaattaattataccttttaactttatttggtgatacat

SEQ ID NO: 1857 - DNA, 1050 bp, Homo sapiens
aaaatagaaacttagtcttataaaatatgtatattttttactccaactccaggatatccactaggcttagatgctgccaaaagaaaaagataaatgttaagtgaaagacagctatgtgcaaaagaacataaaatgcaagtttgtgttttcattaagtctaatttatttacttattcaacgtaaatgaacacctactgggcacaaggcactgtttatgtatgggatgcagcagggagcctagatgctagtgagaagtgacagacaggaaacatctactcaaataaataataccaaaggacagattaaattcccaacaatcacaacttttaagaaaatatgattgatctaatatgaaaatttgcagcaaatttttgaaaaatggaacatcttatttgtattataaaatatttttaaaacttataagggatatgttatagggtttctttaaagattggtctttcccactgagttttaaaaacatgatttaattgggaaaaacatagcttttcagaaatattgctgtttcccctctatccagtagatgctggtctacctactaaatatttctcaccatccactttgcatccacactggagctaatatagtacagccacagtcatgtctctactggatgattagagccttctaactggagcctgactgtttttgagttatatcttttatctgagaatttgaattatttgtgtaagacatacatctcatgtgtacctcaaccttggaaagatttttaatcttgctctctaagaccacagatgtcattttaaaagggagagtaaaatggtaagctttggcatataatttattatagattagtctttagccccatcgaagacggtataattattagaagaactagaagcatctcctgaggtctcaagtgtcatatggctctgagacttgacccctaaggctggtgatattaagccttcatgtatcttgaatgatattccttttttccttttccactcttactttgctaagtcgtttgacattagcagtgccctagagtccagacaaaagtctttggaa

SEQ ID NO: 1858 - DNA, 1051 bp, Homo sapiens
caaatagtttttttagagtatgtgcaccttcatggttcacattttgtacctcacctttaggagcctcctgagacttaagtctagttatagatctagaagcaaagagaggcgttgggggtaggtcctgaggagaatcagcagtgtcttgcaatgcagctgcctcaggggaggccattaaagtttcctcaggcacagcaggtttaattgcctcagatgtgggtggatggctgcttccactggcaaaaaagactcataagaatttagggattcaatgtttccagctccataagggagttcccacatttctccattccaatattcaggatccctttccttcccaatcaatgccctcactttagtagcagacaccctgcagacgttgggaattcagtttgtgctgtagttgagtcatttgcagaataagattctggatttgattttcagcaatttcagctctatggctaacagagataaggatatctttcagacataaagttttctgttcagatatgtagtgctcaagctgggaatttgaatccctgagctcatccatttcttttctcactttgtccattgtcattaggagtaaccaacaaatctcattatactcattagtttgacaaaaatgtttaaaggtatagtatatgtggtcacccagaaccttattcttatacgtgtttgattaaaagtacccaatggtgacattttgcatatctccattgccacatcatacccatacttttactactggaaatagtcattagtgtcctttaatccagttagagagccaagtcctgaaaccctagaatcaattcagagaactcatccttaagattctgctcctttagagccactcttaaaaccaaaattagggttctccagagaaacagaaccagcaagatgtgcatgtgtgtgtgtgtgcactctctttttctttatataaatatagatagataacctatctatatcttgctggcatagatagatagataggaattcgctcatatgattgtggaggcttggtaagtccaaaatctgcagggtaggctgg

SEQ ID NO: 1859 - DNA, 1012 bp, Homo sapiens
aaacatcagagcagagagggtgaaaataaggaagcagaacctcccagaacttaagatcttaagagcagggtagtaatcagtcctcaactttgtactgtagacactggatttgatagtgatgtggctcagggccaggatgaggctggggagggaactgggccaagatcaggaaggggttgaggggtggtgttcaataagatcgtaacgtcagtttaacttacagtgaactttataaacgctggggggctagtatattttagcagatcgggttgttagtacattctctccctgtgctgagatagattgttctcacaagattgcccagggaatatgggataagcccagtagatgtttattgaatgacctcaatggctctggccatcaagctatcatagcctaaaacacccctttcttcacagtaggaatataactgacaggtgcattggattagttacattacctcttcactgggcagtgatgcagtgtgctgacaatgacactttagatatgaggatatggcctagaaacattgattggcctttttctggatcttaaagagatttcctggatggagagcctgtcatttagagtagattatctctacagagaaccaatatcatccattgagtactgagatttcttgtgtttttttgtttgtttgtttgtttgtttgttttgagacagagtcttgctctcgctcaggctggagtgcagtggcgcaatctcggctcgctgcaagctccgcctcctgggttcacgccattctcctgcctcagcctcttgagttgctgggactacaggcgcctgccactgtgcccggctaattttttgtatttttttagagacgaggttccaccgtgttagctaggatggtctcaatctcctgacctcgtgatccgcccgcctcggcctcccaaagtgctaggattataggagtgagccaccgcgcctggccaagatttcttgttttaaaattcattacctttttttgatttaactaaataatcaggtc

SEQ ID NO: 1860 - DNA, 1034 bp, Homo sapiens
gtggctcgcgcctgtaatcccagctactcaggaggctgaggcaggagaatcgcttgaacctaggaggcagaggttgcagtgagccgagatggcaccattgcactccagcctgggcgacaggacgagactccatctcaaaaaaaaaaaaaaaagaaaagaaattaaatgtatgcaatacttagtttttaaaaatatccctcacatatctaaagtcaatttgcaggtttatacatgtaaaaataatttcatttgttagtagtattgtttttgaaagatttagagatgagtcactcatggaaatttttctatttttccagtattggaggcagaatgaaactaacaaaaatcctttggggaaaaaattattccaataaattttccagtaattattccaaatgtctcttcttttcctcccttttttgtgtatctttacaactcaaccaaaaagtccactgttactatatcaagcctgcttaagaatcctccgtgatgcccacttcctacaggatcaagttccagctcatctgaattcagactaccttttcatcttaaaacttttcctctattccagccaaattcatcttcataattcatctttaaacatcatctcatgtttttctgtctctgcaaaatgccctttcaatctattttgagtcttctcagtataccagataaaattcaagtgcatctttcataaaatattccctgacctcttcatttttcaaattttgactttaattagctacatatagtctatttgctacttcagggggatggtttagtaggaacttaccttagggaagataaggtggcataaataacaataagatacagaccaggcagtgctgactccctgcttggagggccattttcccatgccctgcactgtgccataccctgcacactgtaggacacaaagtttgttgtacacattcttgtgtatatttccatgtacagtatctaatgagactcatcccactcagaacttaggacttattatatattcaataaatgaattgttcagttgatactgt

SEQ ID NO: 1861 - DNA, 1028 bp, Homo sapiens
tgagctaacccaacagctattatgatttgtccatgaatatgtcacatgtttgtattggaaacatgttgagcatactatctggatgaaattggattgtgaagttacatagagtttttatgcacatctgaatatttgtgctcttcatgtaaaatgccattgtgtatgtgtgtgtgtgcattagttttcttttttcatatatgtattatgttatcaatatttaagatcctgactgattatgtattagaataattaaaccattttggttcagagcatgtagcctcccatttcacagaaggaacagtttgcagaatgcatggtatgctttggtcttagtaatgacactttaaatgtgattctccccaaactcctaagttttaaaagtatatatcaaaaggctttaagctgtactgatgacacatctcattggaaaatccctacgctgtaccccagctttcttacttcctggcattcactttccctgattcatttatgagatagtgcttgttgttaaagactactgtcaccgtgaaaaggttcagcctgtgtgacctggcattccctaatttctcattcatgacttcctgagtttttggggggatttgattgtggtattggtagggaataaaaatatggagagaacaagataagccaagacttgcctggatatatatctgtaatttaaaacatacattcagaagaggtttgcctttgattataacaaaagtgaattgccattaagctaataaaaggtaccatagagcttgttcccttaaacctttatcccaaaggagggttgatggcagggggaaaagacaaacagcaaaaggataaatgtgtattgtaactagaattccaatatgatttttgtaaactgggttgaagaggttgtaccatatttgtttctgtgcctcccccagtgatgagttcattgacttagaagaatgagtgagtgtcaggtatagaaaatagtttaaaaacatgtgatcattttgacacccattgttatgttgtcttttgtttttatatat

SEQ ID NO: 1862 - DNA, 1046 bp, Homo sapiens
tcaggaggctgaggcaagaaaatcacttgaacctgggaggcagaggttgcagtgagctgagatcatgccactgtactccagcctgggcaacagagcgagactctgtctcaaaaaagaaaaaaagaaaaaaaagaaagtgaacagagcttcagtgagccaccggacaatatcaagcaatctaattagaatccgagaagaaaaagggagagaaaaaaatatgtaaagaaatagtgaaatttttagtaaatttaatgaaaaacataaacacacagaaagcaatagcgaaaattgctgggcgcagtgactcaacgcctgtaatcctagcactttgggaggctgaggtgggtggatcacctgaggtcaggagttcgaaaccagcctggccaacgtggcaaaaccccatctctcctaaaaatacaaagattagttgggcatggtggcaggcgcctgtaatcccagctacttgggaggccaagacaggagaattgcttaaaccacagaagcggacattgcagtgagccaagatcgcgccactgcactccagcctgggcaacagagtgagactccatctcaaaaaaaaaaaaattgactctttacagcaaaaataatgacagcattttatgaggctataacatgtggaagtaaaatgtatgacaacagtagtacaaaggatggggtggaaggatggaagaatactgttgtaaggtccttatattatccatgaaattataatttgaaggtagactgtggtaagttaaagatatatgctgcaaattctagagcaaacactgaaaaaaataaaagagatagatacagctaacaagctctatctccgaatggcaatactgataagaacaaaattctgacatatgctacaacatggaaaatggtaaatgcggatggtaataatatcaacgttggcatcagaacaagaaatagaaccagagatagagggactttttatgatgataaagcgatctacttacaaagaagacataatcctaaatgtttatacttgtaatagtagagcttgaaaataagtaaaa

SEQ ID NO: 1863 - DNA, 1026 bp, Homo sapiens
ttatatgtgtattatactttctctatgctctaagtctcttaacctctcttgcagatctttcattgtattgtctttctgccattttctgcataatttcttcatctgccttcattcactaattccttagctgtgactagtctactgtttagccccttttaaaagtttttaaacttcaatttcatattacaggtttattttctagaaattttatttggttcttttttaaatatacctggttaattttgatagttccttataacttcatattttcaactatcttatttaagcatgttaaatattcttattttatacctcaaaactgataattccagtgtctgtagtctttattgatctgactacggtttttgtttctatatttcttgctaatggtggctattttctcatctcatgggtgttttataatttgaagactgtacttacgttcttggcactttgtacaaattgattgagtcttcatttaaaatatatttactcatgagaagatttgtatttcttctgcctgtgtcttggatactaccaacccagtgagaagaaatgcacaggaggtaaaaaaattttgagaacttgaatggtagactataatggccccacaaagaggtccacattctaatctctggattctttaggatatgttaccttacgtatcaaaaaggacttggcagatgtgattaaattgccttgagatagggagattgtcttgggttatctgggtggctccattgtaaccataaaggtccttagaagagggaggcagaagggtaagcatcggggagagactggaagatgctatactgctgactttaaagatgaagaactcatagccaagaaatacaggcagcttccagaagctggaaaaagcaaggagacagattctctcctagaacctgtggaaggcacgcagtcctattgacaccttgatcttagcacagtgaaacacatttcagacttctgacctgtaaaactgtgagataattaatatgtttttaacacctttaaaattgtctt

SEQ ID NO: 1864 - DNA, 1086 bp, Homo sapiens
gggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagag

SEQ ID NO: 1865 - DNA, 1050 bp, Homo sapiens
atcaccttctttataaagcgtcagtcatgcttccagcaagaggcagcatcagtcatggctttataacagcttcatggtgcctcaaagactgttgaggttaatgagagcctagattagacagtttggctgtccttccctaaaacttgttttctcctattcactactccccaccgcacttaaaatctatgagtttttactttttactgggaatggaaagtgtggtgaagatcattcaacacttatgttgtcatttctcccattttctgaatttttttttaaatttccccccttttaaaattgttcgaaagcccacagttatggaaagaattactgtctagatggtctgcagaacgtgtttggggtgagtgggagtgaggggcaatgttactttttctccctgtagtttggagtccattatgagctgctgctttttcttctcatcttgtcatcttctggggatgtttgaaggctgagttccaacagaattcacaaagggaataaaacaggattgagattttgaggtgtgcacaaggtggtaagataaagggcatatgagcttcaaaactaatgctgttgcatacatgaagccttttgttttttgaggagctatttttgttattcttgtaacgctccaccttacatgccacatctgtgtgagtcaacagggatcaggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtt

SEQ ID NO: 1866 - DNA, 1096 bp, Homo sapiens
caaggaaactgaatttcaatactagagtacattgttggttctttctctgcctttgaatagaattattttttaaattacaaagtttcttttaaaagaaagaacttttaaatatattttgtagggaatctcttagaaggtacaatagattcataggaatgtggaacatttggccgggtgcagtggctcatgcctgtaatcccaacaatttgggaggccgaggcaggcggatcacttgaggtcaggagttaaagaccagcctggtcaacatggtgaaaccccatctctactaaaaatacaaaaaattagccgggggcggtggcatgctcctgtagtcccagctactcgggaggctgagcggggagaaggggagaatcacttgaacccaggaggtggaggttgcagtgagctgagatcgtgccattgtactccagcctgggcaacaagcgagactccgtctcaaaaaaaaaaaaaaaaaaaaaaaaaagaatgtggaacattttacaaaatctcgtccatgatcttgccggcccagcagaatcccagatgtttgtctataacgcgtctggatgttcctatctgagaaaaagccttagtcttttacttgtaagctattcctgaagaaggttgcctcagcaggggaaaactttctgaaaagcttgatcaagtacctgggtcccaagaatgtcaagcatctgtggaacacacagttcccagcagccagcaagtcccacactgctcagtgtcctgcagccaaggaagctgaactgagctcatggggttacaggaagatgaaacaacactgcctcactggcaaggagatcacactgctgagtgctgcctgagtccctctgacacaccaggctcttggagaggaggtcgtggtaatcatttaatgctgactaattgaggttgagcaagagagaaaaatacccgagggagatacatgaaataaacttaggaggagagcttgtacttggctggaaataactggccttcttccatatcctctctaaaaaataccataagagaaagtaaaaaatttgtggtttctattgtaaattgtgttgattcaaattaatttcaagcttttagattg

SEQ ID NO: 1867 - DNA, 1064 bp, Homo sapiens
caaaaacactgtgagagaaatgaagaatgcctttgacaggcttattagtagacaggaccccgctgaggaaagaatctctgagttcaagagcatatcaatagaaacctacaaaactgacaagctaagagagcaaagactagaaaagaaaaaccataacagaatatccaaggattgtgggataagtacaaaaggtatactagatgcataatagaaatatcagaaggagaagaaagaggaaagtaacatcagaaatacttgaagcaagaaagactgaaatgttttccaaattaaggtcaaacaccaaaccacagatccaggaagctcgcagaacaccatgtaggatatatgccccaaaaccccaacacataggcatataatttgtaaactacagaaaatcaaagataaaaaattttaggtcaggcacggtggttcacacctgtaatcccagcactttgggaggcagaggtgggcaggtcacttgaggtcaggagttcaagaccagactggccaacatggtgaaaccctgtctttactaaaaatacaaaaattagtcaggcatgttggcgggcacctgtaatcccagctactcaggagtctgtggcaggagaattgcttgaacccaggaggtggaggttgcagtgagtcaagatcacgccactgcactccagcctgggtgacagagtgagactccatttcaaaaaaaagagaaaaacaaaaagttttaaagaagcccaagggacttctataaaggaacaacaacaaaaaaagaattgcctttcacttttcctcagaaaccatgcaagcaagaagacagtgccatgacctgttgacaggaaaaaaatccctagaattctttacccagtgaaattatccttcaaaattgaagacaaaataaagacttctcaaactaaaattgaaggaagttgttgctaatagctctgacttgcaagaaatgttaaagaaattctttagagagaaggaaaatatgtagttcagaaacttagatctacataaagaaagaaagcattgaagaaggagtaagtggaggtaaaataaaaattttc

SEQ ID NO: 1868 - DNA, 1033 bp, Homo sapiens
gaagaggtggcaagtttattagtaagatgtaaacatcatctagggagatcatttcctgaggtcaattttgactgggatgtgtatggggcttggggctggagaggatgagtcagtgaagttggggcagagatactggagcaaagaatgggacttgagcatgttaaagatatgcctatgactggcagtcctgagtaagggaggatgagagagagccagggccacaagctatttcctccctcttgtgttctcagtggagcacatctgctgtgacagcccaagggctccagaatggcctccctactctgcaatcaagctctgcatgtgaattcccacgcgagcctgttgctcatccacattaaacaaacatcccttttgcacttgcctgaaatatcaacaaacatcaggactccgtcaaaataatccataaagggtcgctctggggagaaatgtccatagacaatgaggtctggtaaatgagctgctattctgactatgggccagtcctggaattcttcttttggagtgttcatgttcaagacaaatgttcaggattttatggtgacaggaagcagtctccaaataggtcttctaaaaagaaaattgaaatagaggaaatctgatatattcatttgctcattttcctattgctctttctccatttgttttgttctaacctgcggcctgcttatagtggtgaaaatgccagagttgttgagccacacttcaaaagggccaatttctatacagaggaagaaccctcccaccctgaacagctgttgcataagtgagctccattacaaagaggctggggtgaaagagggtagctgaacggctcaactcatttgcaggaaggggtaggccctcgcagggcaagtccagttgtagtgggctgttaagctctattcactcaggccagacttctttttcttctgtcctcatgtttccttttaccctctctctaccttggtcttttacttttttctctctttaaaaaaaaaaaaagtgtagatgtgattcgtgtgtgtgagtgtat

SEQ ID NO: 1869 - DNA, 1006 bp, Homo sapiens
atcctggctattctgaaccctttctatttccataaaaattttagaactagcttgtcaatttctacaaaaagacttgggattttgtgttgaatctatatattatttcagggagaactgacatgtttacaatatgaatcttctcatctgtggttctggtttgtctccgtgtattaagcattctttgattctctcagcagtgatttgtattttttggtgttaggtttatccttaaatatttcatatttgtaatgctattttagatgatatttttatttatttttactttttatttgtacaaatttatgggtacatatgcagttttgttacatgcatagattatgctgcagtcaagtgagggcttttaaggtatccatcacctgaataacgttctttgtcctcattaacgaatttctcatcatcctcccacctcctcattcttccactccattatgtatcattccactctgcatctgtgtgaacacgtttgtttagaacacacttatgagtcagaacatcatacttgtctttgtgtgcctggtttgtttaacctaagataatgacctctagttccatccacgttgctgtatatgtcatgatttcattcattttttttttgagatggagtctcactctgtcgcccaggctgtagtgcagtggtgagatctcggcttactgcaagttccgcctccgaggttcacgccattctcctgcctcagcctcccaagtagttgggactacaggtgcccgccaccacacctgactaactttttttttgtattttcagtagagacagggtttcacagtgttagccaggatggcctcgatcccccgaccttgtgatctgcccgcctcggcctcccaaagtgctgggatcacaggggtgagccaccacgcccagcctgatttcattctttgttatggctgaatagtattccattgtgtatatataccacattttctttacctgttcatccattgatggacacttaggttgattccatatctt

SEQ ID NO: 1870 - DNA, 1031 bp, Homo sapiens
cggtgtttcactgtgttagccaggatggtctcgatctcctgacctcatgatccgcccgcctctgcctcccaaagtgctgggattacaggcgtgagccaccgcacccggcaaatttttgtatttttaagagctttattgagatatgatcagctgtacatatttaaagtgtactatttgatatgtttaacacatgtaaacatacacaaagtcatcaccacattcatgatgataaaatatcaatcatcccctaaaagtttgcccatgtgccctctcattccttacacatcaccctcaaccccagtcaaccaatgatctctattctgtcactataaatcagtttgcattttctagaattttaaataaacggaatcattgactatgtatccttttttcatttggctttttttactttaaattttacttagaataattattttgggattcatgttgttgagtgtatcaataatttattactttttattgctgaggagcatttattgtatggataaatcataatgtttatctctgttcacctgtcagtggacattgggttgtatccagttgaggactattacaaataaagttgccatgaatattcgtgttgcgtctttgtatgaacatatgcttttattcttttttgataaatacctttgagtggaatgaatgggtcatatggtaggtacctgcttaactgttaagaaaccagttgttttccagtatcgttgtaccgtttaacattcccagtgttagtatgtagaaattccagtgggtccatgtcctcaccagcatttggtgtggtcagttttttttttttttaaagacattctaacaggcatctagtagtatcatgttgtggttacatttcctgccccgttaatttttagatattcatctgtattctggaaacttcctgaactctcatattcattcaagtagcttttttttttccttaagattttataggatattctatgtaaataatcaagtcatctgagaattaagttagttttacttcttttctagtctggatt

SEQ ID NO: 1871 - DNA, 1012 bp, Homo sapiens
gttggatatttgggttgtttccattttttggcaattatgaataatgctgctgtgaacatttgtgtacaaatttttgtgtgttgtaagttttcaattatcttggctgtatacctagttgcagaattgctaggtcatatggtaaactgatatctcactttttgaggaggtatcaaaactgttttccaaagagctgtaccattttacatttctgacagcaacatacagggttccagtttcttgacatccttgccaactcttattttctgtttctttaaaaaattattataatcatcctagtggatgtgaagtggtaatttgttgtgattttggtttttatttctctgatgactaatgatgttgagcatctttctatgtgcatatgaaggtatgagtcatttacataccttctttggagaaatgtctatttaaatcctttacctatttttaattggattgtttgtctttttgttgttgagttgtgtttgtatattctgggactcttgtcatgggactcttatcagatatatgatttgcaaatatttcccttcattctatgggttgtctttttgccttcctcatagtgtcctttaatgtacaaaagtttttaattttggtgaagtctaatttctttttgctgtttgcttgggctgttggtgccgtatttaagaaacttgcttaatcactggtcgtgaagatttatacctgttttcttctaagagttgtatagttttagctcttctgtttagatatttgatctattttcagttaatttttatatggtataaagtaggggtccaaggtgtttttttttgttttttttttggtggcgattatctagttgtctcagcaccatttggtgaaaagacttttctttcattgaatggtcttggatctcttgtcaaaaaatcacttgaccataaatagaagagtttatttctgaactcttaattccattacattgatctgtatgtgtttgtttttgccagtgccacacagtcttgattactgtagt

SEQ ID NO: 1872 - DNA, 1548 bp, Homo sapiens
gcctcccgggttcatgccattcttctgcctcagcctcccgagtagctgggactacaggtgcccaccaccacacccggctaattttttgtatttttagtagagatggggtttcatcgtgttagccaggatgtcttgatctcctgaccccgtgatccgccctcctttgcctcccaaaatgctgggattacaggcgtgagccactgtgcctggcctccaggagggtttttaaaattttattttccatatagatgatcttgttatctacaaagaccgttttatttcttttccaatcttcatacttttcctttgcttttccttccttttcttgtcttactgcattagctaggacttaaagtatggtgttgaaacgaagtggtgagagaggacatccttgtcttgtttttgatattctacaggttgagtgtctttaatttgaaaatctgaaaattgaaatgctccaaaatttgaaactttttgagtgccacatgatgctcaaagtattttggatttcagaaatgctgtaaaatttcctctgagaactactttgttgcacctcacagattttaattagtcttgttttgatttcattgaattcagaatcttttaaaatttctcttgagatttcttctttgaccgatgtgttattttgaacttgtgtgtattttgggattttccagttatctttctgttactgattttagtttaattccattgtggtctaagagtagacactgtttgatttttattcttttaaatttgataaagtgtattttaaggcctcaagtgtggtctgtcttggtaaatgtttcatgtgagctttagaggactgtatattctgctgttgttgaatgaagtagtctataaatgtccgttatattcaggtaattgatggttttgagtttaactgtgtccttactgattttctgcctgctaggtctgtctgtttctgatagagggaattgaagtctccaggtatcatactagattcatctgtttctctttatagttctgtcagtttttatctcacatatttcgatgctctgttgttaagcacatacatgttagggattgggaaactatgttgtcttggggaaactgacctctttatcgttatgaaatacccttctttttccctgataatttttcttgctttgaactctggtctgtctgaaattaatgtaactactcctgttttcttttgatttgtattagtatgatatatttttctcaatccatttacttttaatccatatggatctttatatttaaaatggatttcttgtaaacaacatatatttggatcttgttttttgatccactctgacagtctctgtcttaatttttaggctgggtgcggtggctcacccctgtaatcccagcactttgggaggtcgaggtgggcgatcacctgaggtcaggagttcaagaccagcctggccaacgtggcaaaactctgtctctactaaaaatacaaaaattagccacgcatggtggcacatgcctataatcccagttacttgggaggctgaggcaggagaattgcttgaa

SEQ ID NO: 1873 - DNA, 1050 bp, Homo sapiens
ttcaaacccagcaacatagcatcttgagatctctttctttttctctctttttccatcatcttgtctccttctctgactctgactctcctgccttgttttgctcagtaagacccttgtaattatattgggcctctgtggataatttaggataatctccttatggtcaaaatccttaattaatcacatctacaaaatcctttttgcagtataaggtaaagtattcgtaggttctaacaaataggatgtagatatctttgggctactattattctgcttaccacaataatagtaaaccttttaagacaaaagttttccaagtaaatttttaaaaagtataaaacacctactgaaaagtgctggcatcgtgtatttgtgcaacttgattaattttcacaaagtaaaatatatatgtactcagcatctagaacaagaaacagccccccataagtcctttgtaccccctcaaagggtttactgctttctaggctcttaaaagtacaggttagtttgggcctttttacgattttataaaaatgggaatcatactgtgccttctcttttgtgtctggcttttttcacacagaaggtttgtgagattcatttatgttgctgagaatagtaatgatttgttcattattactgatgatttagtactttattttaggaatagataacaatttaatcccagtttattgttggatatttgggttgtttcaagtgtttggctaatataaatagtgctgctgtgaacattctagtgcatgtttttacatgccccatgcaggcgtttatttttagtggaactgctgggttataggagaagcatatgatcagctttaatagatattgatacatagttttccattgcaattgtaccattttatactcccatcagcaatgtgttccgtaactccacatcctcatcaacacttgatattataagtcttttcattttggccattcgggtatggtatagctgtatatctttgtggtggtaatttatatttcctcgatggctgagtttgaatacctttcatatatacagtgttt

SEQ ID NO: 1874 - DNA, 1257 bp, Homo sapiens
tatggtatgtgaattatatttcaatacaaaaatgtttaaaatggatcagatgtggtggctcatgcctgtaatcccaacactttgggaggcagaagtgggaggattgcttgaggccaggagttcaagaccaacctgggcaacatagctagactccatctctaaaaaaatttttaaaacagctggttgtggtggcacatgcaccaactactcaggaagctgtggctggagatcttattagctctggagttggagcttacagtgagctaggatgggaccactgcaatccagtctggagaagagtgtgagaccctgcctggaaaaaaaaaagttaaaaatgtaaacattaaagggagcggtcaagagtgataggtgccataaacatgtcaaataagctctgaaagatgctgtttgagttggcaattgattattgatcatattattgaacactttataattgatcagtgaacttggcaattgatcattcactggtgactggtgagaatgaagttagtggaaagataggaaatcaatggaaagattgactacagtggattgaaggaggagtggtagattgaatatagaattttctcaagaagcttaagtaaagtgatagcaagagaaaggactgtagctgtaaaactgagattttatgaagttgaaatattgttttttttcttaaaaatgataagaacctttagcatgctgtggcaaagagccaagagagagaaaatggatgtaggtatagagaagagagaataattggtcaagcaagatactcaaggagttgaaggaatgaaataaaaagcacagatggagaaattaggcttaaatagaataaatgatacacccttcaagaaaggctggaaggagttagaaagttgtagatgtagatttaatttatagaattcagctgaagaaaatgatgttatttttattttctctgaagtaggaggaaaaattgttaagagggcaagaatgagggcagcaggatggaatagatagcctgaggcaagtcataaagggtcgcaatagattctgtttgggaaccgaagagtaaattgtcaataatgagtaaattgtcaataataaataaaaataatgatggttcccattgttaattaggtatgtgggtaatttaactagactatatttatcatcacaatagaaaactaaggctcaagatggttaaaaatatcttccttttgtcagctggaaggtgatacaggtgggattagaaatcacatatacatgatttca

SEQ ID NO: 1875 - DNA, 1843 bp, Homo sapiens
aacatgctcttattatctcctttctttaaaaattttctcttaattatctcacattccccttcagctattgccttatttctctgctgctttcgtaatgagaatcctcagaagagttgttgatagatgctctctccattttcttgccatccttcatttatttattaaccaacccccatctgcttttcaacccccttttcctctgaaacttttaatcaaagtcactagtgacattcaccagtttaaaggatatttctctgttagtaccttactagatttttcgacccggttgcatttaacataggctgtcactccttcttgaaacactttcctttcttggtatctatgatatcatatttgcctatttactcttattaattctggtgggttttcagtaactgttgttcgtgtttcttgttctatctccttctgaatattataatcaaaccccttagtttgggctctcttctcttctctttacatacactctttctctgggtgattgtgtcagttcctcatagcttttaatatctcctgtaaattcatgactcacaaatatatatatcagcaatctgatcttctaccctgaattccagacccttatgcctgatgtctgactgctattttgacagtatgtttttgttattgttgtacatctttttttttttttttttttttttttttaaagacagtctcactctgtcacccaggctggagtgcagtgcacaatctcaggtcactgcagcctccccctcctgggttcaagcaattctcctgcctcagcctcccaagtagctgggattacaggttcctgccaccacacccagcaaatttttgtatttttagtagagatggggttccccatgttggtcaggctggtcttgaactcctaacctcaagcagtccatccgcctcggcctcccaaaatgctgggattacaggcatgagccactgcacccggcctattgttgtacgtcataaatctacatgttcaaactaaaacttaatgcagcctcctacccttcctgttccgtaattggctccttcttggtccatttgcttatttgaataacctgtgagtttttcttgattccttccttttcctcaagtcccatgccagctcatcagcaagttcttttgttcctgtatctaaactataacctgggtcttttcatctcaccatcatttcttgtctcctaattaatctgcctgtacctactgttgttccattataatgtattctccatgcaggagccagaatgagtattttaacatgttaaatcagattatataactttgctgtttaaatcccttcagaagttcctaattgcatttggaaatacaactacaaaagaaaaaaaaatcaaactcctcactgtggacgtataagaatttatatggcctgcccttccctgtctctctagcctcatctcattcaattttctcagtacttgatgattgttacactctagatgtactactgatttctttcggttatcagagaatttccgtgccaaattctgccctgccctgccctgccctcccccgccccaccccgcctccaccctgcccccaccccctcccctcccccctccctccctcccttcctcccacttgcttgctttctctctctctctttctctctctcttttctttcttttcttccttcttttcttttctccttccttcctttctttctttttcttctttttagacagagtcttgcactgttgcccaggctggagtgcagtggcgtgatctcggctcactgcaagctctgcctcctgggttcacgccattctcctgcctcagcctcccaagtagctgggactacaggcgcctgcca

SEQ ID NO: 1876 - DNA, 1041 bp, Homo sapiens
aaaaggtctttttggcctatacagattattttctatgtaagctcatttctcactttggcccttgatgccaactttgaactctctccctataacaaaattataatggatacaaactatatccattttttaaattctaggtatctgtcataaaattgtgtagaactgtgggtgtgaggttaatactacctcgttgcttatgtaggataagttatttaaacacagtgatattctatattactagattgctttagtaatgatacttggttttatgtctcacttatctggtagccaaattcctggtagctttaactaaagactatagttacgaacccagaggtaagctcaaaagctgtcagtcagaagctcccacttccacttgtacttttcaatgtgggaaaggtatagaatcaatctccaagccttgaatagagcctgatgaaatgaacgcgttacttatttatcaggctttattactagcgatcaaatatagcacagagaaggattagtagaggaagacattctgacatgaagggacatctgaaaaggctggagataggaagactaaaaactaaaaaggctatttagtgttagcgcaaatgttttactatctcacctcagaatttaatgaagtattttaaatatattgtgacaaagtgtgataagtaatcttagttaagtctttaagaatgatttaacacgatattcactttctctatttaaaaaggcagatagctggacgtggtggcacacgcctgtaatcccagctacttgggaggctggggcgggaggatcacttgaacccagaaatttgagaccagcctggtcaatatagcgagaccccgtctcttaaaaaaaaaaaaattaattagctgggtgtggtggtgcatgcctgtagtcccagctaatagggaggctaaggcaggaggattgctagagcacaggagttcaaggatccagtgagctatgattgtaccactgcactccagcctgggtgacagagtgagacccccatctctttaaaaaaaaaaaaaaaaaagaaca

SEQ ID NO: 1877 - DNA, 1044 bp, Homo sapiens
attttaaaaatagttgaaaggttgaattcatgggactttgagactgataagttagaaatgaatgagagtatgataaccaggtgtcttgatagggtgataatgaaccatcagccaagatagagactttaggaggaacagctagctgatttgaggggagaagaaagtatgtgagtttttttttaatgttaagtttgaagtgtctttggatatccacgtggagagatctcatagatggttggatggctatatgatgctggaagtcaccaaagtgatctgaggtagaaataaaggtaaggaatcattagtttatagatagcagttgaaaccatgggagtggatgagattgtctagaaaaagagggtagtgtgagaagagtagagtgcactacaggagcaagtagagaaaaggatctagctaatgagaccaaacaggaatgatgagagaagtacgcagggcagaaagaatgccatatccaaaaccaggagaaaagaagtgcaaggagggacaggttagtaatgccatgtaaatcaatgataccaactcccagaaagtctgataaatcattttttaaatttggcaacgtgattgctttgacattgtagtttgagatatgatgtagtggaagcagaagccagatagtagtggtttgaggagaaaggtttgggggaaaaaggtagagactttgttatgtctcttttcataagcccaattaagaattgaaagagcaaagataatgtcaggtataggtggtggtaggttcaaaactgagcatgtttatagagtaaacagattgtgtgttcaagatgtaagggatagttgatgtccccagatatgctattatttcaaaattttaacctttaccaagattcttgttctcagttttaccatggagaatggaaaaagtagtacatttaataagtttcctatttgaatatatctctgactaatgattatttcagcatattttaaatttgtttttcatacttttaacaaaacacgaatgctttttaaaaattgatagttcagttttatgtttatgtcaca

SEQ ID NO: 1878 - DNA, 1045 bp, Homo sapiens
tcaggaagagaaacggaaatataccaaaatataacaaagtatattttagaaaatatcaaagcactataaataccaccctcttctccatcaggtgcagactgtgattcctccctaaattatagatctgtgagtttgaaagaacagaaggaatttgataacatttcattgcagcaaagtttttgccaaaccgcttttcacagagcccttgtatcttacatctcagtgtttctgaaagagccaaaattagttcttattgatgctcaagcaactgaggaattatgagcattccattaaataagggtaccagtttgtaactatgtcattgcatgttaatactttttgattcccctaatgactaaatatggttctcaatgtgtgtgatttccatctgaatcaaagggagtcatgtacacaaagctagaacttgatgtagtgctactttgaaatataaaagagtatttccacaacacatgccttcaaactttaaatgaaacccataacagatgtgaaaaaagaattatgacaaggacaacctaatataagttttataaattttaggaaatgtcatctttttactggtttcagagactttttcaaatgttttaaacacaattttcagataacaataatgaaaagctgagccccaaaccagggacaggtgaaccagttttaagtttgcactacagcacagaaggaacaactacaagcacaataaaactgaactttacagatgaatggtaagttaatatttttgtaaagatgttcttagccattttgtaggattgtattagattttaatttttaacacttcgtcatctttatgttttgttttgctataaggtattggttttcaaacttgagtgtgcttcagaatcactgggagagcttgttaagatgcatattactggaccccactctcagaattaggtttggagtgggggtctgagaatttgcatttttaaaaactttccagatgatgccggtgctgctcatcctagaatatttcttctgatagaaaatgcaaaagataatactaataataata

SEQ ID NO: 1879 - DNA, 1034 bp, Homo sapiens
ttcttttttccttgagacagggtcttgctgtgtcgcctaggctggattgcagtggcatgatcatggctcactgcagttttgacctcctaggctcaggcgatcctcccacctcagcttcctgagtagctgggaccacagatgtgtgccaccactcctggcttatttttgtgatttttttgtggagatggggtctcactatgttgcccagcctggtttcaaactcctgagctcaagggatcctcctgtcttagcctcccaaactgctgggattataggtgtgaactgctgcactcagcctaggccttttacaaaatatctttcagtaacattttatttttctgtgagcaggttttgcatatattttttataacttaaagacactttttgttgctgttataaatgcattccttttaaaatttaggctaattgtcccctgctgatatttagaaatgcagttaacttgtatatgattatgtatccagctacattccttttctattatttgtattaattggcccgtagatattttgagttttggtttttgttgttgttttaagagttgttttgttacccaggctggaatacatggcatgatcttagctcactgcatcctgtaactactgggctcaagccatcctcccacctcggcctcccaaatagcagggactacaggtgtgtgtgtaccaccatgcccagctaatttttttcatctttttttagagatgggatcttactgtgttgcccaggctggtcttgaactcctgggctcaagcagccctcctgcctcagactcccaagtagctgggattactggggtgagccaccgtgcctggcctagagcatactttttaaatgaacatttatgctttgatacagttctcgtttattcataattattaccacctcatttactaatgcagccttaattttgtccatacatcttgttttaaatgatttgaagctgggcatggtgactcatgcctgtaatcccagcactttgggaagctgaggtgggtggatcacttgaggtcagg

SEQ ID NO: 1880 - DNA, 1058 bp, Homo sapiens
cacctgatgtacctccttagaaacctagactccaaagaacactgtttgacaaccactgcagtagaacataatatatcaagattttaggagtgggtttcttttttcatttttacatgttttagaataacatgcataatcaaagctaataatactgtgttttctttactcttttatttgcctctaaagacatccacacatagtggtgaactgatttttaatgcgttttaaataaaaggcattgaaaaatattaataattgtaattactaaaagtatttctctttgcgattctcttatctgtgtttccagaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaatttgactttttatttaatgccttgctactttgacccacagttttccaatctctcctgtagcatacgatgactatttttctatattttctagatttaacaaccttttccttttttgcttgtgtgggatagaatcacatagaaggacttccttcatttctccttccacggtacagctgacccttgagcaacccaggggttagtggcaccagcccccctcacagttgaagattcatgtgtaactgttgacttcccaaaaatttgaccattaacagcctgtt

SEQ ID NO: 1881 - DNA, 1050 bp, Homo sapiens
agcagagcatccctcttccatatggagaacaaggatctcctccacagccagagacatctgctgctgagaaggttagctttttgtgtagaggaaataactgcagtaggttattactcagtaagctcagtaggttcagctggacttcaacatccagcttgacaaaggcacatatgtatccacattaggaaacgtcgtaaatgatcaagaggatagaatcagagctttagccaaacaaggtcactttatgacttccgaaaagtgcaagggtcttagtttctggttttcagttatgtaccttgctcaagacacctgacttctctgggtttgttccctctctaaagggggtggtcatatttgccctacctatgtcacaggggctgttagggcaagatgaagccataagattgacgaattgttatacaggataactgaaaagacgactctaagcacacagtatgtcattccttccactgtagtaagacagtaacagggatgtgttatagcggggtgttgggaaattgacaggacagaggatactggaggactagtggggtgaaggagtaactgtcaggaaaaacaatagaagaaagtcaaaatggtattcatctgctctagtgcaggatgttgatgggggagagtggggctatgggaactctactttctctcagttttgctgtgaatctaaaactgctctaaaaaaatttttttttaaagtatttgttggccaggcacggtggctcacacctgtaatcccagcactttgggaggccgaggtgggcagatcacgaggtcaggagttcaagagcagctgaccaacatggtgaaaccctgcctctactaaaaatagaaaaattagccgggcatggtggcatgtgcctgtaatcccagctactcaggagactgaggcaggagaatagcttgaaccgggaggcagagattgcagtgagccgagatcacgccattgcactccagcctgggcaacagagcgagactccatctcaaaaaaataaaaaaagtatttgttaaatgaactgggtcccccacccacag

SEQ ID NO: 1882 - DNA, 1051 bp, Homo sapiens
aaatatgatttcattactgagattttagaataattgagttttctgaaaattctcttttggaatatgttataaaattatttattctaatgatattaaactttcattaactgcttatttataacatgaccaaaaaaaaaaaaacatagacaaacccacaagtgaagcaaatccacccccagtgggtttttgtttgtttgtttttgagacagactctactctgtcgctcaggctggagtgcagtggcatgatgtcggcttactgcaacctccccctcccaggttcaagagactctccggcctcggcctcccgagtagctgggactacaggtgtgcaccaccaagcccagctaatttttgtatttttggtagagatggggttttaccatgttggccaggctggtttctcacttccagccttaggtgatccacctgccttggcctcccaaagtgctaggattacaggtgtgaaccatcgttctaggccccccagtggtttttgaataggaataaggtatgttgatatgttgtagtctctaaaactacctctagttcacctaagacactacactgttccttcttcatgtcttctccatgagagaatcttggccttctttcttggcctttcacatgagaatcctatgaccattccagtctggtcattagctcctttctctgtattctcatagcacttcatacatatgtccatttgcattaatgacagatttatgcatctgtcttctaggtgtagaagtaaattccttaagagtaagcacccaagcaaggcatggtggtgcacacctgtaatcccactcctagagaggctaaggcaggagtattgcttgtgcccaggagtttgagattagcctgtgccaaaacagtgaagtcccatctcaaaaaaaaagagttagcagagcatagcggcacgtgcctgtagtcacagctactcaggaagcagaagtggaaggattgcttgagctcaaagaggtcgaggctgcagtgagctgtgattgtgccactgtacttcagcctaggtgatagagtgagaccctgtc

SEQ ID NO: 1883 - DNA, 1033 bp, Homo sapiens
gagacattttgggaaaccatgagtggggctgtaggttcatggtcctttcaagcctatacgacctcagagtgagaggggtggtggcatagttggaatctgtaggttccaagacatttctgtagttctttcaaagtttatcaagggatggtatctgccagaacagtttcagtatagatgtgactcacctatttttgaaaaaaatgtttgctacagtgtaaagaaaggaggattgtggacattttaaagttctgaagaattggttaactcctatttggtagaaatgaatcttgagactgtaagcttaactcccatccctccctttagcaattttggacttttgaataaatatagttacaaattgccttttggaatttactgtgttgacaagtaattgagcttctgtacatgttaagtataagatatggagaaggatgctggtgtttgtgtttatgtgtgtgtgtgtgtgtatgttttttttttttttaaatgacatgcacatttgagtggtagactgtttatattttgatttttcttccagggcagaaattggtacctatatacacacaccttgctttgcttatagactgattttgaatccagtttcagaggttcagcattcatatgggtccagctgaatggtgatattcccttcaacactcatgtgttctgactgtgtttgcttttctaagggctaacttacagtctgcctgacacacagtgcctggttctttagcattatggagcctgttccttgtatatggtttccttctaagtgacagggctgagctaactggaatttaccaagatacctttggacgtactacattttcactcatagagtagttggtagcatttttttcttcttcttttttattctcttttctcttcttttaaaattaataggagcagagcagaaaatttatcccaattaggtagaagttaaattctgtttagaatttataaaatgttaggagttcaactgtgccaggtatgggtggctcacactgtaatgccaagactttgggaggctgag

SEQ ID NO: 1884 - DNA, 3643 bp, Homo sapiens
ttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctgattctgcgcctgactgtggaatgtattttctgacattaggtgcagactctttttctcttgggttttatttcccatccctccctccctctccctgcatatctttctttatgacctcctggcactagatggggaaagaacagagcagcagcagaaaatgctgctgttttttttttggacgagagcccataggagttgaaaaatcctgctgctctcagctatatttttttctccattatttataaatgtttgcttttaaactgattttattttccattctcccctggagttgggccaggggagagtggggtgggaagacagatccctgctgtgcagccagcaggaagtaggcacgcctgcccagtgacctttaaatagtcccagtgtttgcacttagcctgtgctggggacactggggataaactgcaggtggtctcatgtcagcctgatgcctaacctacaaagtgcttttgtgtccacgatcttacctggttcttatggagagccttgtgaggaagcagggattgttataccactgtgcagtcaagggaatcaaggcccacactggtttttggatccacccaaagccacagcttcagcctccttcatgaccccagagtttcctggcctgtttctggttgtgcctcctgtaactgcctgtgactgtttccctcgttttcatcagccaagccatctcctccctggccctccctgcccatctcttttggaagcttcttcctggatctgcaggatgttcactgtcccttgtgttccctttcagctcctccttgttgcctgactacgattagtgccctgtcttgtcagccagcattcctggccctccaggacctccagagtcatcctacaaatgacgtttatctggattgcctttctgttctttgcacagggccaactggtccactagggctcctcctctgtcactgctaaaccaaaggaagtggcctgctggttgtcccctttcttgtggctaattgctgaacctttctttgtcctactgtggctaagaactctgactggtttttttttttttttctttttgagatggagtctcactccgtcgcccaggctggagtgcagtggcgtgatctctgctcactgcaacctccacctcccgggttcaagcaattctcctgcctcagccttccaagtagctgggattacaggtgcccgccaccacgcccgtgctaatttttgtgtttttagtggagacagggtttcaccatgttggccaagctggtctggaactcctgacctcaggtaatccgcccaccttgacctcccaaagtgctgggattacaggtgtgagccactgtgccctgctgatcttttcttctgaggctggggaggtgtgaacaagcctgacggggccagagagaggagctagtcttcccaggttctttctaggctattgatgacatccagtcatctgctcaggtcactaacctgtcctcagccaggaaaggaaattttatgctacccctctggcttttgtgggattctttcacatcccaggtgcctcttggagacagatctcagaagggctgtggtgtcagaagggacatggaggaggtcaggagggctcatggttccttttctttagaactgatacgaggcttggctagtcactgtgagctccagcagctccagcagcctggaataagacacctagaaggctcatccctccatgtccatgtcctttttttttttttagattgaacaaccatgctttgtttaaaaaataatctcagcaaactagggatacaagagaatttcctcaacctgtcgaagggcatctttaaaatatctactgctaacatcctatgtaatgatgaaaggctgaatgttttcccctaagattgagaataagacagagatgtcaactcttaccacttctattcaacgttgtactgaaaattctagccactgcaatcatgttttaattgggagtagggggaaagagggagggaaggagaaaaatgaaaggcctttagattgaaaagaaatgagtaaaactgtctattcacagatattatcatctatgtagaaaaccaaatcaaatccattactaagttactgaaaccagcaagtgagtttcgcaacacagcaggatatataattgatatacacaaatcaattgtgtttctccatgttagaagtaaagaattaggaattgaaaatttaaaaataataccatttacaatagcattaaaatataaaattcttgggaataaacccgacaaactatgtggattatctgtacactgataactaaaaagcattgctaagaaaaattaagacctaagtaaatatcttgttgataggttgagagactcaacattgttgatgttaattctttcccatattaatctatagatataatgcagtccccatccaaagccaagcaggcttttttttttttttttttgtagaaattaaaaactggttttaagattcacatggcatgcagatgatctagaagatccacagtaactctcctgctgtgcagctggttcctaacaggtcatggacctgtccatggcctgtaggttgggaacctctgctacagaggatccagatttaaattcagaagaagcttcatctatttctgtagtttcattttcttgcaataactgctgcatcaaacttgaacttcgcaggattttctgaagctgctcaatttggccatcttgctttttaattgtatttcttaacactagaattttctatttcaagtttttgtacgtggccttgcgtctccttagtacattttatagtcgctgtaagttgattccatttttcttgaaattgaattctcatctgacctaatttcttccttgaatcctacatctcactttctcaatggacgcagtgacgcaatgaagcatccagcaaagcttttgttgttgattgtttaggacgtcaccctgtttttgttgaagttgtctcacaactacttctctttctgctttctctctttcatattgacattgtttttctttcaaatgattaactttattgatcatcctcttgttcttctagcaaaagacggtgctttatgcactcagcttgaagattttgtgctgtagcatcacatttggcttgactatcaat

SEQ ID NO: 1885 - DNA, 1069 bp, Homo sapiens
tccaatgtgccgaatgtgcaatcaagtgtgtgaacctgtgctacagaactagagaaggcaaagaaaatgttgtagctcccagcctttcagccaggcaccagagctcacaggcggagaccaggaatggaagaattaatgttaacaaccaccatttactgagtactacatgctaaggaccatatactcctcttatttaatccttgtagcaatctctgtaaggtaggtaaaattatgaatccacatcttgaagatgagaaattgacactcagagatattaaataatctagccaaggccacagagctaattaagtggtagagctgggatttaaacttaagtcttctgacagtgatgtttcctggttattatgccacattggccagggagagatcatatgcagaaatcatacagttttaatacctttttttctactgccctgccaattttacataggctgcaagggagcccagataaatgaaattctgtgtctaaaaccaaataattcgctggtggccgggccagtaccagaatacttaatcttatcattattccaccatactttgctgcttctcttagcttttctgcagaaacaggaccaatctgcgtcatagctagaaataaagccatggccagaagccctcctgtaaccatgcccttctcagcactgtgtacatgcttgtcaggtggcactccttccttggagtgccagtgaacattcccttcccctctttctctgtctctgcagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcga

SEQ ID NO: 1886 - DNA, 1039 bp, Homo sapiens
ctttaagtttctttaccacattgttcatatgatacttatttttgattaaaaagaaatggtttatttgggccgggtgtggtggctcacacctgtaatcccagcactttgggaggctgggcggatggatcacaaggtcgggagttcaaggccagcctgagcaatatggtgaaccccatctctactaaaaatacaaaaattagctgggcatagtggtgcacacctgtagtcccagctactcaggaggctgaggcaggagaatcgcttgaacccgggaggtggaggttgcagtgagccaagatcgcgccatcgcactccagcctgggtgacagagcgatactccatctcaaaaaaacaaaatcaaaaacaaaaacaccccccaaaaaaccaaaaaccaaaaacaaacaattatataggtatgtgtctttgtacaggatcctagcttctgtgatagattagagccctgaatctcagtgaattcacacagtaagacttcagtttttacttatgtgacattctgacacggcttctggattgaagaaaccatttcgtggctcttccatttttaacacaggctctcaagtttcccttggtggtagtggtggtggatgtcttctctcttttacctcagccagcaggagaaagtacatagacaaagtgtatatggatgattcttctcagcaaacactggaaacaatgcctattgcttcctttcatattccattagaaatccatcacaggccacgagagggggtgggaaatgtctaggcctgtgcccacgaagaagaggaaacgtgtttggtgaccagctgggccgtttctttacagattgtgataatttgcctcttttcccattgttcctttatcaacccttaaagaaagacactttctctttaggagattctgtccccttgaagaagttttggggacaaaaaattctgccacctctccatttcacctgcttttttctatgggagaagaaataacatatagggaacccagtgacaatcagatgcccactggaccaggttaagcagagatt

SEQ ID NO: 1887 - DNA, 1023 bp, Homo sapiens
aggtgactgctttgaggagatggcatgagaagtcggtgacagaccttcttcactgcatggcttgcagggctgtggtagagtcacacacacaacaacacaaggcaaagcacagaaccagccatcagagaggagcaaaggggctcacagagaagacggcaactagtaatgccctgtttataattaccagttgcaaagactgtgaatgaaataatcaatgaatcctcacaatgagactgtggggaatgcagggtggacattattatttctttttcacagagtggaaatcaaggatcagaggtggtctgagatttgcccagagtggtggtgttaagtttttccctagtacaccaatttctcattctttttgaaacagatcttgaagattgagaattcttttttgttgtcttatactgtgagagaagattgacaatcagaaattgacggaaggaatggagacaaagcattcaagaaggagggaacaatattagaaaaatcacagatgttgaacattctaggatctgggaatcaaagcttcgagttcattagggctagaggaaatttagatcatttaatccaagtcctttattttatagatgcagaaacagacccagagagatgaagttaccctgtccacaggctcagggctggttaatgttagagggattagctgggagcaggcctttgctcatatctacttcacagcattcctatagcatcctatgaagtggattctggaattgtctctagtagaggaaattgagccttaggagattaggaaatttaaatttgctgtgctactgaccaggaaatctaggatttaatcctgtgtcttaaatgatccaaagcctgagctcttcattatggtcttctcaagtctttagaaatagttttggaggctgttgctgggactcagggaaagcatcacagtgagacgctaacagcagggttggaactggtgtctacagagttgaaaggcagggcagctcttttctactacattaaagacttagtgtaattttaagg

SEQ ID NO: 1888 - DNA, 1529 bp, Homo sapiens
gataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattgaacctgaaacggagaaacaca

SEQ ID NO: 1889 - DNA, 1657 bp, Homo sapiens
caacacaccacctcaaaatctatttattcactatttatttattcatgattctgtgagtctgcagtttagggtgggatgtcctgagacaactttctctgatccacctggggcactagctcacccatgtgacttcagtgacttcattcacatctggctgttggcagaggcagaagtacttgagaaagccatgtgcatcatccagcaggttcaccctatctcagatacctgatgccagtggtttcagggtttctaagagtagcaaaagtgtgagcaggtcgctgtgtgctagcacttttcaagtttctgcttgccttaattttattattgtcccccgggccacagcaggtcatagcgtttagcccagagtcattgtagaaaagtgtggattcacaaagggcagtcattgtggccatttttataaataatctaccacagactgagtaaaagccttgcatgaataccatggatattaatttgaattcttcctttttagattttctttccttagcaatttgttttgtcattttggattagaattatatctgtagaatatttcagttataatagggtacaacttttattccactgaacatctttagttttatttaggtcatctggtaggtataaacttcagaagttaatattcaatatttataaaaaccattaacaagtgtgacacttaaatagtttaaataattcttttgacacaactgtttccaagttgtgttacgtattttaattcaatcaaatgttgaaattgttcagtagatagttttaattataggagaaactcacccccatgacatttggatgtcttaaaagttctgttatctttctttgcagttattcattctttattggatatctgctctgttatttccagtatggaccatgcatttcatgccaatacttggaagtttataattaagtaagtttgtttgttattttttactttttagaaaatgttttccatattccccaatcttaattattcatgattctttagattgcatttaaaacattttgtgtgaatttaatgttcactgacactgctgtctgataatccagatattctacatgtagctctcaagccaaattggacttctttaccctgtggcctctaaaattaaaaaaaatgttcttcctagttagctagtacttcagaaataatgggccatgggccagactagaacttaaccacttttcttctgctactgttgtttaaccagctatcaagtatcctatttctaggattagataaattgataactataattaaaactgaatataatcttttcattaggtacttttaagttgttcacacttaattccatttgtacagtaattttaactttctgaaactgaagcattttaaagggtcaccagggatagtgcctgtagcattcatcagattcttaggggtgagaggagatgtggttgagatgtaaaaatggttaagaatatctactttatacacatacataaaacattaaaggtcagtgtattttcaggtcttaggtacttttcttgtactaccaggacattaagttgccattcagtggttaagagtgttgcctgggagctgtatcacatgtgcttaaatccattcttgaaatcatttactccttctgagcccttgggctatttggttaatttc

SEQ ID NO: 1890 - DNA, 1035 bp, Homo sapiens
aagttattactggaaaggggtcctgatccagaccccaaaagaggtctggatcttgtgcaagaaagaattcaaggtgaatccatagagtaaaatgaaagcaagtttatgaagaaagtaaaggaataaagaatggctactccataggcagagcagccaaatatgtcacattgcatacctatgctagtatttctatagactgtatttccagaaattgaattgctactcaattaaggtgttttaacatttcaacttttaataataatgtattattttatgctcccaccaatggtaaaagaaagtgcttgttaacttacttccttactagtgcagggatattatcagtctttttaatctttgctaatcaaataaccctcaaacctcccccttcccgaaatatatataattaagttataatttggatatttttcagtagcagtttgttttgtcttttttgtgtaatgtgtttttatgtctttacctgttttcttttatatatcattctttctttgatttgtaagacctttttcttttgaccatccgttaaattgatccccatgtaacaaagaataaggtatttaaatttctttcactttcagatcaactgagaaggatcacctcttttgctatcgtaggttaagatttcttttcttttcagtaatgtagaatttaatttaatacctctgttgtcatttgttatttgtatcgcacctaataattcaaagaggagttatattttctcggaaaaattttatactgtgtttaagaggggttttttttgtttttgtttttagaaaatattgtctcatttgtaagcttagctaattttatattcttttcttatttattatgctttcttatttccctttttggatcaggataatgctgactacagattatttcagaaaacactcaaattgtgtcgtttttttgccaactcccttttgcactacgctaaggtaaggctttattatacgttactttatttaattgtagttctctcagaaaacgaattattatccctattccacagaatag

SEQ ID NO: 1891 - DNA, 1072 bp, Homo sapiens
caggctttctgtaccaacacttcatcaaaatagttcttgttaaggtcatcagtgaccaccacattgctgcatccagtagtcaattatagtccttctgtaacctgtcagtagcacttgatcctcttttttgaacactttgttctgttggtttctagggcatgtctcactcttggttctcttctagtcttactagctgctccttctcagcctccttagcaggtttctcttctaagttaagtgtgtcccagcacttactcctcaggcctgttatctgtctattatcatttagtctcaagactttaagtttatgtctcctttaatgtttaactactagtcaggacatctatactaaattgtcccaaactgaactcttgatttccacccatatcatcctcatacccaacaaaatctgttccttttgtaacttctttatttcagtttaagtggcagttcttcaaattgatcaggccaaaaaaccttgccctattaacatgttctgtcaatgttaccttcagtgcacacacgcacacgtacacgcacttctcatcacctgaactgctaccatctgatctgaccccctattattttcttgcctggattttgcaaaaaactttctatctttgcctcgcgctagtttgttctccacaaagtagccaaagtaaatgataaaatacataaatcagatgatgtgacttctctgctcaacccctcaaaatgactttcatcaatggaacttcttgtctttctttccttgttttatttttcttctttacagcattgaattaacctctgctatattatgtatttacttgtacacttgtctgttaactgtcccctttcattagaattgtaaactataaagacagtgactttgtatattctctttattactgtatcacccactcgtggaacagtgcatggcatgtatacataggcacttagtaaacatatgtcaaattaatttaaaaatagttgattgaaaaaataaattcttgcaatgatgctcagtagatgtaattcaagtctgtggaatttcattactatgttttatttgtatatgtcttttatttat

SEQ ID NO: 1892 - DNA, 1050 bp, Homo sapiens
aaatagatttaatgataaatcatctattatgacatgttagagacactgatttcccctagccattcttttttacaattaagaaatttttattaagtttcttttactttcttttcttgaaacatatttcttatttaaaaattatacctggctgggcacagtgaatcacacctgtaatcccagcactttgggaggccgaggtgggcagatcacctgaggtcaggagttcaagaccagcctgaccaatatggtgaaacgccatctctactaaaaatacaaaaattagctgggtgtggtggcatgtacctatagtcccagctactcgggaggctgagacaggagaatcgcttgaacccagacggtggaggttgcagtgagctgagattacaccactgcactccaggctgggtgacagagtgagactctgactcaaacaaaaaaaaattattcctttacgtattaatcagatttctgctgaattaatgtgtttttattacatgtaagacctgccatgtgaactgcagtttccacaatgtcttcttctggttgttgtcatggataagctgccatctcagcctaaggaagtgcaaaccctgtggtgcacagacagccaggtctcagaaacgacaaccaggtagcaaacatgtttttatccagtcatattaccaatggttaagaaggccctgttgtttggaatggtcttgaaattaagtttgtgtgttttttttttaaatcagatatttatgttaatagttattgtgtagacacacatatatattgctactttataaaagcagataaatataaaatatataaacctatattagatgctaaaaatattttaatatttaattttgttcagtattgcttaatggtcagcattataaacattgattgtaatagagtagctataagtagaaacatttaaaaacgagctctgataaatagaacactagacactgtaaggtatatcctggcaaatttaacctttaatcatcttccttgccaacaccgtagtccaggctctagtttctttcttcctggattactctg

SEQ ID NO: 1893 - DNA, 1815 bp, Homo sapiens
aagaggtttctctcttctgtctctctaatatgccttagacaagtcgactcttgattttgttgtattttttttttaagtcaagatgatttgagaggaacttgagtttgacattgatagatacttttggcaaaagaagtcatgttttatgaatgggtacagacagaaaattattttataatgatttcatcatcttaacattaacattttttgcttttaaattctgaggtgttttatgtgttccatataagatgattatgacctatttgttacatatttttttccctggcctttaagatcttatgtgggccatacatcttttgttttctaatagtcttattgtatcatatatttcttggtttacctttaaaggattttgtagatcagatccagtgaggtgtgtaataacctgaacagctgacatctatgtctccatggctgatggtctggattatcacttacacactttactaaatccttaacatatctttcacaaagcagataaagagtgatttttatgttatgtgttttatgtctgaagtttcctttaaataaaagctttcttagtgcattatgttgtaggaatggatttcttctagttcattatgataaaattgattccaggatggaatgatactatattatgataggaattgataaaattgaatttataaaatttttttgttagtggtggtttttttcttagagacagggtctcattctgtcacccaggctggaatgcagtggtgtgcaatcatagttcactacagcctcaaacttctgggtgcaaatggtcctcctccctcaccctgctgagtagctgggactacaggcatgcgccactatgcccagctgatttttaaaactttttgtggatatggagttcttgctgtgttgcccaggctagtttcaaactcccgggctcaagcagtcctcccaccttggcctcccaaagtgctgggattacagttgtgaaccaccacactcagcccctgtaacatcttttaatgaagcttctgtcttgtagagttttatctacctctctactattgtagttagatcttaaaaagttccatgaattgtctttgagtaggaggactgacatacccagttatcatcaaaatgataattagaaatagaaattacagtgttaaatatgtcagaagttcaatctcattctaaatttagattcattgaagataagaaaagccccaaattaaaagtcaatattacctacaatcttttcccctagaaagagctgctattaatattttggcatattctcttcttgtaaaaattctgattctaaattagtcagtctctcctctctctctcatgtctttttccagataaagtcatgccctggagaatgttatcaactcatcaacctatcaatactgttgaagcgtctctttttcttcatggcaccaccccatcaggcaaggaaggatatcatctttgtcactgtctgtgaagctgctcagagttggattcagactcctttgatagcctttttttttccatttttaaaaatttatcttattattttttttgagacagagtctcgctctgtcacccaggctggttttacagtggctcgatcacagctcactgcagcctcgacttcctgggctcaagcaatcctcccacctcagcctcctgagtagctgggactacaggcacacaccactacgcctggctaatttttaaaaaaattacttgtagagactgggtctcactatgttgcctaggctggtctcaaactcctgggctcaagtgatccatctctgccttccaaagtgctgagattgcaggtgt

SEQ ID NO: 1894 - DNA, 1050 bp, Homo sapiens
gtcttatggtcctcggtttgaatcctggcataccatgaccttaggcaagtcatcctttctgaacttcattttccttgtctgcaaagcagaagatatgtataactattttgaaaaagtttgtaaagacttggaaataatacatgcaaaacaggatagtgctgggtttaagagggtgctcagtaaatgctaggagttatttctgactagggtttttgcctcaagtccaagtcttttcctgccctagagtggttggccaggaaccagaggtactacacctacctcttagccttcttttcgtagccccacctattagccctctaagagcacggggagcttgcttgcttacaaaagaattttctactccagatatcttagaagaagtgggactgggagggaaagggtcacatgtcataagactttaagaaagtcactttcctttttttttttttttttttttttttaaatagagacagggtctggttatgttgcccaggctggtctcaaacttgaactcagacgatcctcctgcctcggcgtcccaaagtgctgggattagaggtgtgagctattgagctcagctgtcactttccttttaacctcaattttcttatttatacaacaggaataaaattattttcccaaggtggttatgaaattttaacttttaaaataatataactcagaatgaattagctatgaggtctagaagcagtgttctaaattagataaattatagtttatgcctagagatctcttactctcagttttctaaatttttccaaataattgagactatcagatatgtaaattataggtaaatgaggggttacttttaatttgtatcttcagttatcaaatgcagattttctttatgtacaagttattgtgataaaatttaagaaaacctgaatctgcatacctattttaagagtccttaggagagttaattataaaattgagatagatactaatactcatatggcagttaagaaacttgataagatacacatatggcatgaaaagaccatttaacaaatgttaggtctcctc

SEQ ID NO: 1895 - DNA, 1042 bp, Homo sapiens
aatatattctctttaattgtattttctaattgttttctgctgatatataaaaaatacaagacaaaagaaaagtcaacaaaagacatgaatagatatttcctagaaaaggaaatatgaagagatgctcatcaccaccaaggagcagagaattacaaatcaagaatacagtgaggtactattttacacccatttgattgacaaaaattaaaacatctgacagtatcgtgtattgaagagaaagtgcatccacaggatcttatacattactagagggagcacactttggaaagcattttcacatttcttctaaagttatattttgtgactcagtagttcttagataatatccaaagcaaattcttgtacatgtaaaataagagacacattattgaaatttacaaaagcaaaaacctgtaaccaacctaaatgtctatcagtggaagaagatcaatagactctggtttattcacacaatgaaatgttatacaacaaaatgaatgactgctgaaacatagacaatatgaatgactattgacagtgtaatattaagtaaaacagatgtacagcacaaaaccctttttataaagtcaaacaactaagtaaatactttttagaaatatttgtagatgcaatatgactattagagaaggaagagaataatcaacatatgattcaaatgatagttttctgaggtggagggagcagggcttaaataaaggatatggagtatatatcacaaactggtagcccattagcttaatttaacccaaaaatgtatgtggcttttcagctttgcctcctttctttccccttctttcttttttccctcctttcttcctgcctgccttcctttctttcccttcttccctccctccctctttcattcctttctttcttctttgtctctctttcttttatccaatctttacatttcttttagttaataatggtgataatcattgtgttatttgctaagccagctatacctgttgcctttgtttgggggtaggtccatgtactaggttagccattgcattgtgag

SEQ ID NO: 1896 - DNA, 1022 bp, Homo sapiens
tccaagttgggctgggcacagtggctcacacctgtaatcccagcacttagggaggcagaggcgggaggatagcttgagcctaggagttcgagacctgactgggtaatatagcgacaccctgttctccacaaaaaggaaaaaagaaagacaaaaaaaagtcttaagagttgggaaaaagtgagcaaattgaaagaaaatattaatatatgaaataaacattggttattgtctgaaacatgttaaggtggtggagactttatagaaaactctaaaaggtataaataatatgacatcagctacaaaccaatttttattaatctccattctgcatataatacataattaacttacacaaatttctttgtactcctaaacacatgccacagtattctggcttccagtttgtggattcctagattatatatataatggatttcagaggtccaatttatgtaagcctctttactttagatcgtagtctttgttcccattagagcaaaataatgaactgcagatgggtttcttttaagaggacttttgaaagaacatatacataaatcttcttgattaaattttatacttagaggactgagactggtaaggtgttggatagggtagcagtttctttttctttcataaactcatttttatgctttttttgccccctaggcaagaaaaatctcgttgggaagtcctccaacaagaacaacggctaatggaagagaaaaataaacgtaaaaaagctcttttggctaaagctattgcagaaaggtgaggcacctgaaccaggagaggctgtttgtaacctgtaaccagttgtgtcatgtgttatatttgttttcccatgtctcttttaataaactgatattttttcttcaaccattacttttaagactaactaaacaaattatgctttataagtgatactgaaatactagttataatttattaaagagaactttttaagcatagagcatattaaatttgtaaatatagttgcagttttaaagaccttcattagt

SEQ ID NO: 1897 - DNA, 2233 bp, Homo sapiens
ttccagtctggtggcccttccggccacccctttaaccccagctttccctcccccttctttcgatcagagatcggcggagaccctcgaagtgcgcaaacttgacactcaccctgaccggtaaggaaagcgagggtgtgggggccgcgatcaaagagggccccatcgggaacggccagagtgcggcctggggcgtgggagcgcacccagaccctggcgcccggaggctagggggccgcgtggagagggccttgggtccgggcatttcccttctgtttggttaccatcatctctgtgtctggggaagtcggcctccagcttggggagcgggaaaccggagtcagacccgccccatgtggtctgcagcgggagttctggaccggtctgtcttgctcccacctagaccccagtcctggccctgcgaggggattacgcatgttgccgggtaagcgaagggggtttccgtcttcctggactggcggacgtgaagtcttttttttttttttttttttttagtgtcgggtatgcgtttccccaaacaactgaaggactcagccggggctttcactgtctacctcttcctgtgtagtgagggtgggacttgcaatgagcaatgtatgggagggtctggtttaaagacctggttagatgagaggctcttcggggaatcaagaccaaccctacttccgctagggaagtgctgcccaactccggaggaggatttgggtagtcttttcacactctaggccgctccatcctctaacttgcgtggtgaatctcggtagctccctgtctttgagatagcgttgatattggtggtgtcagggtaaaggccccgttttaggactgaagaaaagggcatggggccactatagagacattgatagagtcttccttcctttgcatgagaggagtacctttaatttaaagggatgtatgtgtgttttgacattatttgggatcttttgagggtctgacatgcctgatgtttgctggcttataaagctacctggatttccgcattggctggttttcagcctgggttcatagattcatacctcgttagagtacttagaattgtacagtaggcggctctgctgtaagattttcatttggaatgcaccagaagaatcggaggattttttgattgttgagtacttaatagcttactcctgcaaataaaaataatagggtgatactaagcacctaccaagcctaaccccaccatttttcaaaactagatttcacctcccatattggtaattaagatgctgctttgactggagccatttttaggtgtgtgtcacagatgcactgcagcatcttttctggctcaccccaaatgcattgatcccctaaaaaattaggaataaattgaacttgaattttgtctttagcatgtagtcaaatagtaattctctccttttctgtaagtggattttcagaatatagcctttttaagtgattgtgtttgctctgcttagcttatgtgtggctgttctccattaggtgaccttttgctatacactgagcacagtaataagtccttttcatacattttttttttaatctccacaacagacctttgagaaaagtgctattaagatcatccccattttacagatgaggaaatgaaatctgagagagtagtctgaccaaggtcacatagcagttattggtggtattgtgtaggttcaattccatactgtctgaacccaaaggggatgctctaaaccttcaacctgctttttaaattataaactacagtaactaaataagataaagcattattaactagtagtttttctttagcttgactagtatatgaatattgttgcatgctaaggttaaagttttgaaagttgtaaaaatggaatatatccactttggacttggggtagaggctaatttttttgtgtccttttctatttgagtgcttagagataacttaaaactaactctaccatgtcgtagatataatttttaaatttaggcgtctgatctatattattggtagaatattccctcatctgtaaaatggtgatgataataggacttccctcagaggcttttataggagtaaaaaaagataatggataatgtatgtaaagggcttattactatgcttagtgcatagtaaaaggtcaactaatagtggagggagaatggtaggatattggtagaagaaaatactctcttccaagcaataaataatctgtaaattctcagggtgatg

SEQ ID NO: 1898 - DNA, 1028 bp, Homo sapiens
atggatacatgtatgtggttggagaatgggtatctagataagttaataattcattttttcttccctgtttgccagtgaacaatctgaaggtacagggctgctatatatggttatgcagcttgtatactgcccaaagatgctggactgaaggaagcaacaagtcagcctgtgttctgcttacagagtcctgtgccccagcttaggcctcgcagagggaactgtgcctccacttctctctccaaggcatcagctccttgccaaaagtgtctgtatttccccagaaggatgtatttttcctagttacataaaggccctatggagagcaatggatgctctgaaagactccttaaggagacatattaaggatacatttagaacaacatcaaaaacaattgggaaattggagaaatggtcactaaggaacaaaaagctttgaactttttgctgagatgggttaggtggttgggcaagtacagaattctcatttatccagtgtactttaaagatctgtattgtagcttattaaatatttttattaatcaagaaactatattaaatatcatagtttatcatatttcaaagaagagtgataagagtaaaacaatacttaacacaatttaatcttacccaaaaactttgtaattttggggtttaaattaaaatttagatttttggtcatgtggctggtagttttatatataagtaactttttaatgttaggttttataattaaagctatataaattttatagctcttaattgaagaagcacaatagggaaggtacacagttacttctgaaggttaggaaaatggaacagtggcattttattttgaaaacagaggacattgaaaacaaaggaggctttagacaggtgaattttaagtttatatttggaaatttgatttgtggtgtacagttctttaagttttagtacgtatggatttttgtagcccccacaactaggatacagaatgtagaaagataaaacatctcccaactgtagaactagagtcttctggcattttg

SEQ ID NO: 1899 - DNA, 1042 bp, Homo sapiens
ctcactgtagcctcaacctcctaggctcaagcgatccttctgtctcagtctcctgagcatctgggagacaggcatgtgccaccaggcctggctaaattttattttttgtagagatgaggtctcaccatgttacccagattggtcttgaactcctgggctcaagtggtcctcccaccttcgcctttcaaagtgctggtattacaggtgtaagccactgcgcgtggccctaatcgggtatttttacgttatactatatctttggagctcagattttggtggggcagtggggggatacaaggtctccttttgtcccccaggctggagtgcagtggcacaatcatggctcactgtagcctcaacctcctaggctccagtgagcctcccatcttggcctgccaagtagctgggactacaggcatgagccaccatacccagctaattttttttttttttttttttttttaagaaaagacaaagtcttgctgtgttgcccaggctggtcttgaactcctgagctcaagccatccttccgcctcggcttccgaaattcctggaattacaggcatgagccactatgccctgccaataattactattttattgctagagcttttagtcaaccttaactgaaatcaccagtcctttctgctctcctcctcattctcttctgacttcctctcttagtccattcatgctgctgtaacaaaatgcctgagactgggtaacttataaataacagaaattaatttctgttggtactgaaggctggaaagtccaagatcaagttatcgacaggcaggatctccgcctccaagatggcaccttgttcatgtcctcagatgacagaagtgcatagctagttccctccagccctttcataaggcacacatcacatctgtgagggcagagcccacatggcccaatcacctcctaaagaccccacctcttaaaagtgttgcattgggggttaagtttcagcatgaaatttggaagaaacataggcattcaaaccattttctttcactgtctggattagacttca

SEQ ID NO: 1900 - DNA, 1027 bp, Homo sapiens
cagcactgtgttgaatagaaatggtaaaagtggacattctagctgtgtactagatttcaggaaaaagccttcaggtttttcccattgattttgatgttagctgtgggatttttgtaaatgacctttattatgttgaggaattttcctctgtacctgttttgttgagagtttttatcatgaaaggatgttaaactttgtcacgtggttttctgcatttattgagatgatcatttggtttttacttttcattctgttaaactgtggtatatcacattgatttgcatatattaaaccaatcttgcattctagggataaatcaaacttggtttaatgtgttattgagaaggattggtattgtcttgattttaagtagggaagttaaggttcattttatgattcttttaagcttgagtgttctgcgatggctagagttaaatcggatgttctataaccctgtggttaaattgtgtattactactttgtgttccttcataagaatatggagaagctgaacttgacattttattttgatttttgtttagttgtaacgttggacattttaatacgcttgcttactaacatttctctagtgaattgtctgttcaaagctttactctttgggctgctttgatttgttgagttcttataacatatttacattttgtcaagtgttgattattttcttcactgaccatcaatttaattttttttttctttttctttttccttttttttgagacagagtcttgctctgtcgcccaggctggagtgcagtggcatgatctctgctcaccgcaagctccgccttccaggttgaagccattctcctgcctcagcctcccgagtagctgggactacaggcacctgccaccatgcctggctaattttttgtatttttagtagagacgggtttcaccgtgttagccaggatggtctcgatctcctgacctcacgatccacctgcctcagccccccaaagtgctgggattacaggccaaagccaccgtgcccggcccaatttgatttt

SEQ ID NO: 1901 - DNA, 1207 bp, Homo sapiens
gtagctgggattacaggtgcctgccaccatgcctggctaatttttgtatttttagtagagacggggtttcaccatgttggccaggctggtcttgaactcctgacctcaggtgatcgcctgcctcagtctcccaaagtgctgggattacaggtgtgagccatcgtgcccggccagaaacatggttctgcgaaccgcagtagcagtaggtgtaggaaggaaagtttggatgttagatacaggttggtttggagatttgctcctaggaagtttaaggagttcttttctcatgatgttgctttctctctaatatacagaaagggtcttcaccaagagtgctgcttgagtaataatggtgttcagaaaagtccaagatttcaggattcttagttaaataacttaagcaagttgactgtttttcttgatacatcagttcctttttttttcacctgatgaaaaagctctttgaattttaattttgtcaggtagtgaatatttactgtcctcttttgtcactgtagatgaatattctttctatatctttgtacatgttactggtaaatttgccaataggatagattttggtagtacattctcttttcacaacatcatcatcattagcggtcttggggtaaaattaattgtatacattcttctacatatagtagcaaattgtattagtgtagtcctattggttgtaggtcagtcttttttcaggttgtcggttgtctcaaggaaagatggtttattgtaaacgtatacgtgaaaagcgaaatggttatctacactgttatgtgggaggaggcagcatagtgtaatggattgaacccgacaccctagtttcaaattcaatctgatttagtctttatgtgtaaaaatcaagacagtaactacattgtaaagttgtttgactgaaatgagataatagaggtgagaatgcctgataaattttatggaactatacaaacgttgggtggcattttacatgcatataaaatgacatctctgctgattctgtaattgacaaatataaaactaacggatgaaacgaaatttataaaagtaaagtggatataggctttactttgatgctttttgcttggtatacctattctatactatctttggctcctgtgtttcagttctcaatgttttcagctattgatcgtttctatggtagaattagccatcttctaccctactgctacaa

SEQ ID NO: 1902 - DNA, 1027 bp, Homo sapiens
tgttaaagaatgaagcccttcccctttctttgtagggaacttatgtttgagtacctgctatttgctaagtgttatgctgtctgtattacatattacatattttatactctttaaagtcttttgactatagtaacttttggttaattttccctattaaaagtatttcaatttgtcagggtagaacagatgacagaattgggaatcacaaccttgcttatgtcatagcctttattaggctccccgctttcatactaccaccaactcaggtattccctttccaatatgattaagagttgactccgatacctaaattccatgatactaaggatgtctgtctgccaatttactgtgtatctccagcattgaaactgcctgatgtttcataggtgctcaagtaataatttgtatatactgtagcaagaaagttaggatagaattaatagtgtccatcttagtcatccttctttcaacaactatttagacttctgtatgtcaaggattttgccagactcttagctaattgaatgaccaagcctaaatagtggtaatttaaaaaaaataagacaagccattggatacttgatgttttcttgcctatctcttatcaaaattctatactcctgcctggggagatttatatagtaaatttgactacttctgtagtaatgtatcaaatacgtaaatgcttgttagctgtagtaaaattattttatagtaatgagtcagttataggtatgagtgtcccagaaacacattgcattttgtgagcctcttaactactttcttatttttaagcattacctcattacaagaattgaataaaactgtacaccctttcaaaacaccttttactcatgtgaatgcattaggcaggttgctgttacctctttgaataacagtagtaagtacagtggtgatcctgttgactgccaggtggggagtttgcttagctttagccctcaactaatttcaccagtccagactgtatgtatgtttatactgctatttttaattataagtgttcact

SEQ ID NO: 1903 - DNA, 1042 bp, Homo sapiens
actgtgttttggtagagccataaagcattgttaaaggatatactcaaggctcttaaaaaggttttttaaaaaatctcttgggctagctaagttccaatgtcaagagccatgtatgagtcaatgatattggttaaggaaaggagtctttaagataccctgtgccccacatcattttatctttacctctgcatatccaagcaaagcttgtaccttcaaagtatccagccatcgcatagattgttagaaaccatactcatttttcatctatgtccccaacatctcctgtttcagacatgctgccacgattcctgagaggagaagagctagaaagtagccataaagcaccactgctgtaatattcccctttcccccaaggaatgatggaatccccagcagaatttagttttcccactttcgaaacaggaactgtctataaaacattctatggaagaaccaatctgggccctcaagctaacaaaactagctgttttaatttatagaagtacaaaaaataggtagataggaagttgggtgaatagtgaggtgtaataatcttagctgtaaattaaatcaaagtaaagtaaatgaagcaataaattaaataaaggcattttagcctcatcttgatcttggggtctttattcatcaaacactatttcagtaatatgatttgaacgaattctgagaattcttagcagaggaatttgatgtgtattgaaaatgtaaggagtcataatgaaagagaaacaagctcttcacttgcatggtcatcttaaatgagtcctctggaatggtactggtagattactgtcttagactttcatctcctcatggctgatcattagcttttcaaaggagtctaggtgaattttaaagtgatatggctatgaacagtcatcactgaaatgtggaataatttaagagaaagaggcagagagctctatcctgggagggtggtttgtattatcttcagtataaaagttacctttaatgtttttttaaaaaaatctataggaatccaagtgaatagtcagtttcagca

SEQ ID NO: 1904 - DNA, 1043 bp, Homo sapiens
gaatggccagtatgcacatgaaaagatattcagtgtctttagttattagggaaatacaagttaaaaccactgagattttactgcactgccagaattaaagactgatgacaccatgtgttggcaaggatgtatagagcagctggcacccttatacattggaaaaccttataaccactttggaaaacagtttggcagtttcttgtaaatgaaatatctatttaccatatgacacaggattttcacttgtagctgtttatccaacagccaggaaaacatacatttacacaaagacttacgcatgaatgttcatagctgttttattcatagtttaaaaactggaagcaacccacgtgtctatcatacatgaaacaacgtgcccacaatggaatactatccagcagtaaaatggagcaaactacttatacataaaataacctcaatgccattatacttagcaaaagaagctagcacaaaagagaatataattttatacatgtatataaaattctaggacaaacagaactatacaaggttagggttggggtgcttggggccacagggggaggcagaggagtgatggaaatgttgtgtctgcgttggagcagtggttacacaggtgtatcatttgtccaaactcatcaaactatacacttaaaatatgtgcagcacagcacattttatgtaaattttacttttatgaagtgagttgtgtaaattaggcactaatatatttggtttttcagcttatctctgagctgtggatgaagaaactcagcacaagagagatgaagtaatttgcatatgatggcactattagtaaatggtagtctgcattcatttaaaaagatagtcaagtgttttcgttgtgtcattgtttaatctttttataagcattccagctgggttacatatggctcttaagatttcttcaccctagtagcttttaaaatcaatatgttaaaaacatttttttaattacttttattgtttttgcatagttgcaagcagtgattttaaaacctgtcattgttttataacacatt

SEQ ID NO: 1905 - DNA, 1840 bp, Homo sapiens
gctgcttctaaagtatccatgctaaatttcctttgtctctaaatttagattttgagattcactgttgtgcttctagttttattcagcaaatactgaatgagcaacaacgtctggcacaataataggtacatactcagtaaacattggaccgctggattaattattctggtcttagtttggtgaattatctagatgtaatatatttcccatcttatgtgttttcattttaatgtgtatgttcatcagagaaatttctgatatttttgtggggtttttccttctccatgcctgatacccagtgttagtcagaaatagagttgtcataactcatctgataccttaatgtttcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaaggtttgatagtattcttcattctcttttaaaaactttacaaagagctttatgttggttacagtttggggtttgtatattttaaatatatgtaatcaatataaaagtgattgttttatgatagcatttgcagtacaaaatatgggctagagccgtgttttctaattctgtatatgaacagacgtctctgaagtgtttctcagttattagatgagcttcatttctgttttatctgcagaattgtattggcttcatagtcacatatactgattctccccctgcttttttctgactccaagacatttaactaaacaaaatctcatttgttcacatgcattaatacctctaaaactgaactggcatagagcttaatgagtatgttggattatcataattaaatgactgcacctagttcataatttcaggtttgctgtttaatcagtttaaacatgcaagcttccatggtgtagttgatatgctattaaactgtaatttcctggagtaattatactttaaaataaaattctttttctagatctaatcaacttttttgttcttctccgagttggcttgtagactgattaatggcattcaaatatagtataaagccttggcaaagttaaagttcagggttttcgttttttgtttgttgttgttgtggtggtggtggttgttgttgtttttgagacagagtctctctctgtctccaggctggagtgcagtggcggaatctcagctcactgcaaactccacctcccaggttcaagtgattctcctgccccagcctcccaagtagctggggctacaggcgcgtgccaccgcacccagctaatttttgtatttttagtagagacggggtttcactatgttggc

SEQ ID NO: 1906 - DNA, 1012 bp, Homo sapiens
cttgctctgttattcaggctggagtgcgttggtatgatcttggctcactgcagcgttcacctcccaggctcaagtgatcggcttacctcagcttcctgagtggctgagactacatgcgttcaccaccacaccccgctaatctttgtggggttttttgttttgtttttgtttttgtttttgtttttgagacagagtcttgctctgtctcccaggctggagtgcagtggcgcgatctcagctcactgcaagctctgcctcccgggttcacaccattcttctgcctcagcctcctgagtagctgggactacaggcacccgccaccacgcccagctaaatttttgtatttttagtagagacggggtttcaccgtgttagccaggatggtctcgatctcctgaccttgtgataatctttgtattttttatagagatggggttttgccgtgttgcccaggctggtcttgaactcttgggctcaagcagtctgactgccttacctcccaaagtgctgggattatagacgtgagccatcgtgtgcagccacttgggatgtctttattgtagagtaggtgtgaagaaatttaggtgtatctacaatgcttatataatatagctagatgtaatttttccattagtgagatgtttctttttaacagtattttagggaacatttttaaggccaagataaggagaaatacaataatacaaagttaactttgaaatggcgcacaattggtgatgactgtaataatttatagccatacagttggaacttcctgcccttttatgggctatatttttttggtaatgttttataatgttttataattatttgtaattaactgggacagataagcttactcaagtgtactctttcattctaggtggaaattactggtcttgatggattagaaattcacatcagcatggtcttaactttgtttttccttaaggaataaacttcatttatttatttctattttttatttttattttttgagaagggtctcgct

SEQ ID NO: 1907 - DNA, 1020 bp, Homo sapiens
agagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactc

SEQ ID NO: 1908 - DNA, 1009 bp, Homo sapiens
aatttttgtatttttagtagagacagagttttgccatgttggccaggctggtctcaaacttccggcctcaagcagtatgcccatctcggcctccaaaagtgctgggattacagacgtgagccactgcacctggccagttttaggatttttattttcaactttaagagtatgaaatcttttcagatctttacaatgaatggccatgcaatagggtgagaaataggttatacactataagttataggaactaggcctttggctagttttttttttttttttaagtactactgtactaaacatttttattaattttcatttgaaaaacagaaaatatcttaaatcctttcccacacccacaggtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtttaaatcttgtttcaacttgttgctagttatctagatttgttgcccaaagtgtatcagcaaatgttcaaggtttttatacttgtcaaggctgttttcattattcaagtgttaaaagtgacatcatcttcccaacttttaatcattttgaccagaatcaaaggaaattttaaataaaatataaggactgtagctccttatattttgacttacagcaaagaccatctttttttttttttttaaatactgtaagttctagggtacatgtgcacaacatgcaggtttgttacatatgtatacatgtgctatgttggtgtgctgcacccattaactcatcgtttacactaggtatttctcctaatgctatccctcccccctccccccatcccacaacaggcccaggtgtgtgatgttccctgccctgtgtgcaagtgttctcgttgttcagttcctacctatgagtgagaacatgaggtgtttggttttctgtccttg

SEQ ID NO: 1909 - DNA, 1023 bp, Homo sapiens
aaaaatacaaaaattaatgtcatggtggcgcacgcctgtaatcccagctacttcagtgactcaggcacaagaatcacttgagcctggaaggcagaggttgcagtgagctgagatcatgccactgcactccagcctgcatgatagcgagactcaaaaaaaagaggaagaagtgagcaattaattcagtttaaaatgtattttttttctattactacttcacaggagtctgtaacagactatactacaccctcttcttctttgcctaacaccgtggctactaataatacaaagatggaggatactttggttaataatgtaagtaatcagtttgagatgtggcaagtttggattggaacctggctattattatcaagcacattatttcatgttttatttactgtagtgatcaatatttaactcagggaaagagttgatagtaaatttgtgtttaggagtactgtaatataattagcaaaaatagtcaaagctgagttttttatttttcctctgaaagccatctgctttccatttaagatgaaggtttgtggtgcgtaggcttggtttcgtgtaaatactaatcttattaacctggtattggtaagaagttgttttagctctcacatttacaaatttaacatgaacggttggtgattttgttcttacataaaacctttttataattcagtgaaacccaacttatttaagataactaaaattagaattaaaagacaactatagaattcccaaagaatcaagtatgtctttaaaaaagaaaaaataccagcgtgttaacaacattcttgttgtgtagattgagctatattgtattgtatacataagtacgccaaacactctgatatgctctaatataaggtgatgttaagtcatgttgtaacttaggacctagttttccagagcaaccatgttactaatataattcaaggttgtgttaaaagtctgtacagttcatcattttgcttagctcactgtctgatagatgaaaaattgttagcccagaaacat

SEQ ID NO: 1910 - DNA, 1038 bp, Homo sapiens
gttagtattactcagtagtacaatcatcttgtatcttgaatgtcttgaagattaaatgcaggtggccttttggattatcatagcacagctgctttcaacatgtatgaaagaatctccattaggtagtccatagtatcacaaagtgattatcttaaaactctcaagcatcccagttatttttcctgaacaactgaacgaaccatccaaaacgtaatacataataaagtcccaagatccagagataaaggcagtgagtttctaatatcttaaagtttctaacaatatttgccataattattactatagcagaacagttttattgtaatgagatggtgctaacagtccatactttcttcccaagattacttttgttcttgaatcttgttataaaagttaaccatattgcaggaaagagattaattttttatatttttgctgtcatgttaaatacttctggtggaacctgtagatatatggtgaaggttttattccttagagctttgctacacagtatgcagcctgtagaccagcaccatcagcatcacctggcaacttgtttgaaacccagcatttcaggccttaacatagaccaattgaatcaaaatctgctttttatcagcatcctcaggtgatttatgtacatattaaaatatgagaagcactgccttctgagtatacaccttatatctggtgcagactctctttctgccaacttaacgtataaaaaggcagataataatttcccttcagaagttttatctgaggtatccttaattaccaactactataaacacaatgtgactcttaagtaatcacatatttctgttagctctgatgaaaaataaacactacccttagaacaccttagcattgtctttaatggggctttcgtagtagacacatagttagattgtgatatgtgttgcctaccttttcaggtgcccctgcccaacacccttcccctccctaagagggagactatacaacagagctccagcctaacttcagttcctcccactactttcagcctcaccttca

SEQ ID NO: 1911 - DNA, 1068 bp, Homo sapiens
cacagcacctccaattgcaactggagtcagcagtagtgccagtggaccaagcactgctaattacaattcgttctcaagtgcatccatgccccagattcctgttgcttcagtcactcctacagcatcactatcaggtagaactttttcgttctgtttctttaaatatcttacattatttaaaattttttatgatctcttcttgtttactatctctagccctccgaaaatagtaatattcaatcttcccacctcagcctcccaaagtgctgggattacaggcatgagccaccacatgtggccagtaattgctttttaaaatgtcattttcctctaaatttttctaggaagttcaccttttgattgtcattttttatgtatgtacaactaactagatcagctcaaaaagaacagagaatcacacctcttttaaatgtttgacaatctgtatctaatttgaaggtgctgttggcctaaacctgttgggataacgtattttctggtaaagacttagggatggagaattttcagcctctgctatttgagtgatgtaattcattggatttggctttagtttggtttggattttgttttattttgttttttaggagagtcctttggtgcccaaagttagaaggtgcttttcttgctctttttccttagattttcttaaatttttactagtgtgtaatcttttcattgaactatctcattatttggaggccttacggttcttaaagaaacacagatgtttccaaaatgcttgactctagaaaagtacacccttttccttttaccatatgtagaaccaagtttcttctgttgaaaaaataaaatttaatttcaagctttctcagtattatctgcttccaaagcagtaggaagctcctttccagtgatataaattactttgtttgactggttctcattcaatattgctttttagtattccagcccaccgtgctatttttaggtaccaaaaagctggtcttaggtttatacaagttattttgatattgtctgtaatcagaagtatatattaacacaaactcccgagattctacgctgcat

SEQ ID NO: 1912 - DNA, 1041 bp, Homo sapiens
tggttcctagttctttctttggaacccaactaacccgtttccccaggtctagatttcctccactgtgcttgactaggataatttttttaacaaggcccttattgcctagtcatcctactggtagatgattcactagaaggatagaagcacttgaattttggtccactctcaggtggaacatcatctgaagataatgacaacttatacattactttttaatcaaataccagtattgacattttgggctagtactaaagtcataatagctcactaatcaataaaacaaattaaccctaacacctaagttttataattctatttacttattaagtagtttatttaatttgttttaaaggtattactatataccaggtggttttgttttgtttttgtttgtttcttggttagttgtttttggagttgtgtggttttttttgttttttaagagttgatgtcttgctctgtcgctcaggctggagtgcagcgatgtcatcactgttcactgcagcctcaaactcctgggttcaagcaatccttccatctcagcctcccaagtagctgcgactacaggcaccaccatgcccaactaattttttaattttgtgtagagacaggatcttacaatgttccccaggctggtcttatactcctggcctcaacatgtgccagtttttgcaggagagagaaatccagccttaagtttatgtgacattttaggaccagttgagatctttcaaggcccatgtatattcataattatttctaaggtatagcacttttctcttttgtgtccttatatctgtggtcataagtgaatgaagctcttgattatatatcctattctttgtgatgattaaaaaacaaatcatttctggctaaactataacagttacataggctctcagcctcattttattaattttgtgttttgtttctttcttgttttgattttctgttgtttattgttccatattttctagtcatatttacatttggtgataattaccttttcttttataagctacctcatctacttttggc

SEQ ID NO: 1913 - DNA, 1162 bp, Homo sapiens
ctaaagaacctaaaagtatgtgtgccatctggctaccaaaaactataaatctgaatctcctctatgtacgagctgaggcatggcagttaactacatcatgttagggggtgcagggcagggtggaatataacagaacagagaggggtaaatatcaaagcatggaagtaatgatgataaatatgctgtgtagtgaagaaagcattttttccaaaaattcactcagatgcactgtaagttacctttgcaactagggaaataatgaaaactgatttttattgaactttccttatatatgatagatattcagcctttcacatacattaactaaatttagtcttcacacaaccacctaagataagtcaccctcatttaacatgtggatgttaggacttgaagagggtgaggctttttttgttttgttttgttttaacctgaggttatacataaagtggcagaccctcagtgtctctggtttccagtttaatgagggaagaagagtgagtaagagtcagatagtaggagcagtgcatcatggcatagctgtcatccatactcatgatggtggccttaaatcatcataaagaaaaataagttacattcaggacacttagtttaggaaggctgtgcatttgtttttaggaatttgttttcagaagtgggttcagatagaatttctatactttatagattaaacctgtcatcagttaatacagtatgttttatattaccataatgatactcctagagaagccaggttcagctaatgaaactttcttaacagagagcctagtcattagtaaacctcataaatgtggcttttatttttaccttttgattaaagatgctttagtaaaatttaagacacctgtatcattacttatatagctgttgtaggtcttccctcctcattttactctcatttaatttcgttattttctcccgttagaagccccaactagaagctaaaggaagtcttgtattgaatttgggattatcttggaatttatattaaaaataaaacttgaaaatttctgacacaggaatagcagctagatttaatctcacaagccagtctccttttaaattgtattggctgcttgaaacactgttgaaaagtttgcaaccgcttttcagtactgtgaaaaagagtacagtgattaat

SEQ ID NO: 1914 - DNA, 1840 bp, Homo sapiens
aacttttacatgtgaagcttccttgtatacagggctttaaatcttgaaataagttgctttagacacagtctgtattctctgcctcttttcttgatttctgagctaattagagtgcatccaagtatcagtgatggggagacattctgaagtatgcatcctttttcaaacatcatagagtgtacctacaggaacctaggtggcatagcctgcagctatacacctaggctgtagagtacagcctattgtgtctaattaggctataaacccgtgcagcattttactgtacttaatactgtaggcagttgtaacacagtggtaaatatttgtgtctaaacatagaaatctaaacaatctaaacagaaaaggtacaataaaaatatagcatacaagattaaaaatggtacgtaccatgtatagagcacttaccatgaatggagcttgcaggactggcagttgctgtaggtgagtcagtgagtgagtggcgagtgatattactgtacactactgtggactctatactacactgtgggtacactaaatttgttaaaaaaaaaaaaacaaatttttcttcaataataaattaacctcaacttactataattttttgactcttataataacatttagcttacaacacaaacacattgtacatctgcacagaagtatttctttttttgtttgtttttttgagacaaggtctgtgtcacccaggctggagtgcagtggcacatacagctcactacctcgaactcctgagctcaagccattgtccagcctcagcttcccaagtagctaggactacaggcacttgctaccatgcccacctaattttttatttttttgtagagatgatgtcttgttctcttgcccaggctggtctcaaattcctggcctcaagcagccctttcacctcagcctcccaaagtgctgggattatgagcatgaacaccatgtctggccttttcttttgtaacgtttttctgttttttaattttttaatttttttttaactttttaaacttttttgttaaaaactaagatgcaaacacacacattaggctaggctacgcagggctaggatcatcaatatactttcatctacctccacatcctgtcccactgggaggtcttcaggggcagtaacacatacagagctgtcatgtcctatgataacaatgccttcttctggaatacccgctaaaggatctacctgaagctgttttataagttttaagtaaaaagagtacactctaaaataaccagaaaatgtatagtaaatacataaactagtaacataattctttttatcagtatcagatattatgtactgtatgtaactgtatgtactgaactgttaggactgtaggtgtagtaggtttgtttatatttaatactagcaccagcaaaaacacttgagtcatatgttctatgatattagaacagctatgatgtcactaggtgataggaatttttcagcttccttatgatcttatgggaccatcaatatatatgtggtctgttgttgactaaaatgtcatgcagcacatgactgtattgggtcatttgggatttgcattcttaagattttcagattccagatgaaattaacttctaacaatattttctctttaatccttatgtagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactag

SEQ ID NO: 1915 - DNA, 1056 bp, Homo sapiens
aattattatagacttccccattttctttctttttttttttttttttaatatatattttcttcccccctttcccctgactctcctcctcccagcagcttaaaatgtaaatcatggttatatgaaaactctggaatgggtaagatgtgttactatcttagtacttttttccattatgagtcatcaaagtacagttttcttctcaaactgttttcatacccttattggcctaccacatgaggtggttgtattccacagtggattgtgcagttatagatgaagaactcagaaaagcactttgggatccttcatgatgaaaggcactgataaacatgaggtttgctaatgcagaaagagtgcctttaggagtctgtgtggggacagttttgtagcataaaccttacatgtctgccagtacagccagttgaatccgtttatttctatatttactttaggcttgactttcagggatcttagtaatttttgcctgttttgtcactacatatgtcatcagatcagactagaacaaagaaaagcttactgctttcaaacagggaaatgtgcatagtaatgctttactctgaattagaaacatgtttatgataatcctattagaaaatttgattgattgattaaagtgtctttttgggtcgacatccctagtgtttctgatcctgagtaatcaaatttaaagactacccagcagcaaaacttttattaaataattatctacttttattaaggctgtatgcctaggatttccatctgtttgttataattagaaataccagtgtgagtaaaaatcttaggaagttatttggccttggattccagttctactcctggctccttggctcttgattttcgcatattcccatgttggaaataacattagagcttaatagtagtaatggggtgggagagggtacaaacttcttgaaaattgcttcagatctttggatagtacaggttacctatagaacataaagcatttttttaatatgcaagaaggatggaaacttaagttttaattgtgaatgttacagtggtaaaatttac

SEQ ID NO: 1916 - DNA, 1808 bp, Homo sapiens
taagtatatttttgggggcacatagtcaaaactaagaaattatttaccagctcagaatgtggtaggagctatcagaacttagtgatcaagtgaagtcgtagttactaatttctgatgctcttcccctgcagaagagagctgtgggaagaggactcagccacaagacatttggtcctaggtgttggtaatgccacaatataagtgcttccttttcattttattgtagaccacatattgataactagaagttttaagtgttacatgtatgtttttagatttgcaagcaggttccctaaataaaatttaatatgagagggcagaccttgaaaaggtggtgggaggtggtcctgtggttttttttttttttttaaatcacatgaaatatttcaaaaataggaagaaatctattcattaaaagctcaaagatcaatgaggtacttttggctttggccaaaccagtgtggggaaaactgatttgtgattggtaaaagaatttgaaccaagattgatttgacaggctttggtaatgctgcagtattttcagttgttctttctcattttttaaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgcc

SEQ ID NO: 1917 - DNA, 1037 bp, Homo sapiens
cacctgaagtccctgaatgtgccttcttggaataccctatacttttgtcctatcttagtgttgatgtatgtcactagaatctcagttcttagatttaattctcagggtctgtctccttcgggtgacttttgttgtcttcctttgatccccctgtggtggctgtgctctgtgcttaggagtaggagttgggcctttgttttcctgtgatttgtggaacttgaatggcttacccttacttggtgagggtgtctgagaagacggtgtggccttttgagtcaagggcaagggacattgcacctctgctgccttgtaatcatgagcaagattgtttggccactcttcttccctttcctagagagggtctaataattcttatagtgaagaagtctttttttttgagacagggatttactcttgcccaggctggagtgcagtggtatgatcgcagcttactgcagccttgacctccttaggctcccacgtcagcttaccgtgtagctggtaccacaggtgtgtgtcaccatgcccagttaatttttctactttctatagacaggattttgccatgttgcccaggctggtctcgaactcctgagctcaagtaatctgcccacctcggcctcccaaagtgctgggattacaggtgtgagccactgcccctggccactttgagatctttaagagacaataataataacacactagttcatcttctggatctagtcatcatgaatccaggattcagttatcagatgtcaaattcactcctagatttctgaaatgagacagggagacctctaaatcttgtatcccctgaatggagacagtgagctgactttcccttttgccttccctgaggctggtacagaattttccagtgaacaggtggcaatgtgatgctctattcttttcttacagagatcccactggcattgttggtggtaggcctgggcgggggcagcctccccctctttgtccacgatcattttccaaagtcctgcattgatgctgtggagatcgatccctccatgttggaa

SEQ ID NO: 1918 - DNA, 1032 bp, Homo sapiens
cacatcttcaggtatctttatagcagtgccgcagtccaccggtaccaatttactgtattagtctgtcttcattttgctgataaagacatacccaaggctgggtaattgacaaaagaaagaggtttaatggactcatagttccacgtggctggggaggcctgacaactgtggcagaaggtgaaaggcacgtctcacatggcagcaaacaagagaagacagcatgttcagggaaactcccctttataaaaccatcagatctcatgagacttattcactatcacaagaacagcatgggaaagacctgtcctcatgattcaatgatctcccactgggtccctgccatgacatgtggcaattgtgggagttacaattcaagatgagatttgggtggggatgcagccaaaccatatcacaggttatgatgtgtgtgtatgtgtttgtacttgtatttttatgtgtatgtgtatgtatgtggaggcatctgtgtgtttgggagaacaaggaaaagggctgtgatgttcctgaaagtgagttggaacagaagcttggaagtgagaaacactgtgaggttgctggagtatatagtgtgtctgtgtgagtttaggttggagtgggatacacaaggagctcgtggacaaagggaatccatcaaaggtgttggagcaaggggatggtatagtcagctttacatgctgagtggattgctgtgattacaatgggcaggatagatggaacatggcaagatttggggtgtgactgtggagtaagctgtccagatgagaggtgatagaactaccctcacttggccttggtgatagtgatttggggagggggagatcaataaatttttagaaagtaatgtcagatagatatacctatcttatatatcttttgttacattcgtttctaagtaccacatagtttctgctaatgttgcaaatcatatttctaaaaaattatggttttgaattaattctcatggttgaatattatgtagcagtaaaactattgaactgcagccatgtgcatcaa

SEQ ID NO: 1919 - DNA, 1059 bp, Homo sapiens
acaagtggaaacaggttcagagaagcgacatgatgtgcccagtggtagagtcaggactaggactcaggtttcctgccatgcaatgcagtattctcctccaattcctctttgctattttctttggtggcatgtccctcctgtttcttcttcctctttttttttttttttttttttttttgagatagtcttgctgtgtcgccaggctggagtgcagtggcactatcttggctcactgcaacttctgtctcccagattcaagtgattctcccttctcagcctcccgagtagctgggattacaggcgcaccaccacgcccagctaatttttgtatttttagtagagacggggtttaaccatgttggccaggatggtctcgatctcttgacctcatgatccacctgcctcggcctcccaaagtgctgggattacaggcatgagccaccgtacccgaccgtccctccttctaatgacctcaatttagtctttactttttcccagtgtcagcacatatgatccaaaaggccttctgaacttctatcaatattttgatagcttctattctcaactctttagtaactattaccaaatgaccattttttttttgccataactctatctcttaagatactaccatatttccctataaaaatgcattaacaagttggtaacatgttgaccatggtaacatcttgagcccaggagatggagtttacagtgaggtgtgattgtccactgcacttcagcctggtgacagagaaagaccctgtcccaaaaaataaatataaaaaattccaacatcttatctcaccattcagagaaaacctcttttaaacatctgtctttcaatgaaaatgcatgaattatatatatgatatatatatgaattatattatatacataaatagaattatgctatttgtgccattctacaatttgattctttcagtcaagaaaactcttggtgctctttccaccaaatatagatttattactctcttttatagttacacagtgtacttttgtatgaatttattgtaatttatttaaccagcatcctat

SEQ ID NO: 1920 - DNA, 1071 bp, Homo sapiens
tagagattaaatataaatatatgagaacaaaatccttaatgttctcactttcaaattataaagtactttttttagtgggaggaaaggggaatgtgcatttcaaggatattagctgtatctgagaatacagggcaatatatgctaagtgaggaaaaaaatacatggccgaagaatgtcatgagaatggaaaagggagccctcccatgggcttgtaaggccagaaagccttcctggaggaggtggaaattgagctggactctgaagaggaggtaggaaccaggaagagagcaggatctccagctggggtaatgtcaagtgtgactggttatctttctcctgccaagtggagatatcctagtgtgtagctccctttcaggatctgagtaggtacgagggtgcagccatgaagccagtggtctaaagaccgtggagttttcttgagactactagaacagtccatcaaacacagggagtttatacagtgctcaagagaaaaaggttaaaaagtgctgttgatgagcaacctgctggttcacagatgctctttactattcaaaatataattctgattaaagcaaggaattaaaatccaaataaaaagatgcatagtttatactttgagtttcatacttgtacatctctatagttataacttctttttttttattattatactttaagttttagggtacatgtgcacattgtgcaggttagttacatatgtatacatgtgccatgctggtgcgctgcacccactaactcgtcatctagcattaggtatatctcccaatgctatcccttccccctcccctcaccccacaacagtccccagagtgtgatattccccttcctgtgtccgtgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcgttgttggacatttggg

SEQ ID NO: 1921 - DNA, 1030 bp, Homo sapiens
tggaatagaaaggggggaagggcggggaaaggattgagaaatcggatggttgccatgtctgtgtggaaagaggtagacacgggagacttttcattttgttctgtactaagaaaaattcttctgccttgtgatcctgttgatcggtgaccctacccccaaccctgtgctccctgaaacatgtgctgtgtccactcagggttaaatggattaagggtggtgcaagatgtgctttgttaaacagatgcttgaaggcagcatgctcattaagagtcatcaccactccctaatctcaagtacccagggacacaaacactgcggaaggccgcagggtcctctgcataggaaaaccagagacctttgttcatttgtttatctgctgaccctccctccactattgtcctatgaccctgccaaatccccctctgtgagaaacacccaagaatgatcaataaaaaaaaaaaaaaaaaaaaaaaaaaaaaagaataagggggcagtgctaaaaaggagtatgtttcttctgggtgactgttagatattacaagaagaaagatacaatgagagtaggggtggaacataagcctggagcattcgtttatctataagtaggccatccagtgctgtgtatacccagagtgttacatgtcatgggtatttattttccgccaatgccatgctatatgcagttttatattatgcacatggaaccatgcttttaattttttcctaagcagcaatatttttggcatctttccatgttaataaatgtaaatcttagcatcattttaaaaaaaaacagctttattggggtatagttgacatacaataaattgcatgtataataaactacatgtcaaagtgtataatttggtaagttttgacatttatgtatctgaagccatcaccacaataaagataacaaacatatccatcattcccaaaagtttcatcatacctctttgtaatttctctcaaactctcttcccccacagcaattacagatctgctttctgttactataaattagtttaca

SEQ ID NO: 1922 - DNA, 1090 bp, Homo sapiens
actcttctctgaagtttgggactgaattagctatagcctccaaggtggtataacttgaagaagtaaataataaagtggaatcagaacttcagtagttctgattcaaagaactggtctttggcacaagaatgtcttgagtttgactataatcatcactgctttctaaattagcttgaaattggcccattttgaaactagttttttttcttgtttttaatgtgtacatagtatccacaagctagaattgtctttaatcttaatagaaactccttttctttttgctctcaagtagttactagttataggaaatatgtcaccagaatactttgcctgtgctgagagttggatgtcaaagagcatccacactgcataaacattcttgatattatataatttacttaactactaaaaagggagaagctgttatcttagagcagcattcttggctttgtgtgtatggcttcctgattcttttgtttacattcttgaactaaaacatttaaatcttttacatcagcaagatttctccatatcactctgattttcttgttctttgtcatgtgaatttgccagacctctgcctactttgatattggcgcaggtctgcctttgctcttaaatatgtggttttggtttttgttaaaatcaccctatctgctaaagggagataggtgcatgtgcatgttgaagagaaaatgtagtttttacttctcaagtattttttgtggaaaaaaagtagatcctagaaggaccattttcctagaaaatgtgggcatgcttcagagatagtacacataggaggaagtctttttttgttggtttatcttctgttgtattatataaactcttcaacttcagcagcctggaaaaatgtttgttttctttatcaaaaagagacattggagcactgaagactgagtaaataatatggagatatttggtctttaggaccaaatattaggagcattttattcctaaaggaatgaggcgggatgaataagttgcccaattcaaaaatttaaaagttgactaatccaggagaaattagggatatttatctctagtttggcaattatattcaaagatgtca

SEQ ID NO: 1923 - DNA, 1029 bp, Homo sapiens
aattgattttttgtttttaattttaaaagtactttccagtgacaaaacacttttattaggctggcaacaagtttgaattatctatactcactttcaccttttttcggttgcttaactttagccactttttctgcttgattcccagagggctcatggaaaaaaatgatagtatatagaccttaaagcttttagtggaatttgaccagatatcacttaagagtttagataagtgaagacagagatggactgaactggatgattgggcacatttgcagtttgctctcttttaaacaggtctcggcatcctagttctagttgtaataatttctgcttttaagtgccagagacagtgccaattcattaagacaccaggcctggctttttaaacctatttactcttttttttatcctctgtgtgtccattgtctgtccttagggcttctctaccaacgttttgcaaacatctaggcacaagtgtccagagttcctgaaacaccaccttttcttacatctcttaaattgaaatgccactaataaggtgtcaccaaggcagtcttatatctgaagtaggaaatttttctaatccatacatagaattaattggctaatcatgtgtgtgtgtgtgttcatgtgtaacatgcccacttagctaccccatacctgctcttacttttccctacctccatctgcatcccaagggaaccacagaaattactaaattttacatagcagaagataaatagaattgtattgcataggcctgaataagagtcactttcagaaaaatagatttgtctcatatatcaaaatcagaagtatgtttccattactaagtggaataagtaagaaattaaagctgatttagaccaattcttacttcataggtaccgaaaacaaatggaagaaatgcaaaaggctttcaataaaacaatcgtgaaacttcagaatacttcaagaatagcagaggagcaggttggtttctacatcccttatttactttttatataaatttccactgaattctgtagg

SEQ ID NO: 1924 - DNA, 1043 bp, Homo sapiens
ttgtagaaagataagccttaaggaactaaggttgatctctaagttttgggcttacgtaactgggtggttgatagttcattttataagatgggaaagactgggtaaaagcacaattattttttctccttgaggaggagatagtgtaaatggaaagacaaacaaaatgtgacaaaatgttaacaattggtgagatagataaaggtgtaaatatatttcttgttttatttctaaaacttccataggtttcactcctatagaaagaattggaatgctgcaaagaattttttttctttaatgtcatagtttattttcaaagagcatgccctgcatttctggtctttgaagcacattaaaaaaatacttaaaatgatttgtcctttgaattttagatacccttatatttttcctaatatgatttcctatgattattatttaaccctcttctcatctcaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtaatatcagcattatatttcacaattttattttttttactatgctttgtatatttttgagaaattttaagcaaataaagggagactgaggtaatttctttccctatatgattatcttgaaaccaaaacattaaaaacatcattcgatagtaagatggtcctatgcctaacctggctctgtagactataatagagaaaacactaatagtaagtgcatgaaacccctgaaatatttggttgagaaagatgcttaaatgtggaattcaaaggaagaagagaatactattttaatacagtaccttttagacaaagatctctaaatttttttttccacctgtattagcaataactggagtgttagagttagtcccgtgtggtatgtacagttctcaataacctctgtgtagcctcaacaaaagagtaaattatatgtgc

SEQ ID NO: 1925 - DNA, 1029 bp, Homo sapiens
aggaatgtttcttttcttatcaggtaaaagagtgaggctgggcccaaagaaagatcgttattgtattggttgataaccagctactagttaacaacttaaggaagtatagttatttgaagacgaccagtcaagcataggaatcatatcatcttccaccttgcctctttttgcttactaatttaaaatgcataaatatatagttaacctgatacaaattcattggttctattactagaggataataaggaatgaatgatttgtcttattttagtgtttaattatagcaaatccaccaaatccactttacattttacatctgcttttttttttttttacttacagtagacccaaatgatttgtacattgtagaacccctcaagttttctccagaaaagaaggtaattgtttatttctttttaagtttattgctatgttttgtgataataaatgaagaaaagaggttgaaaggtttaaggtaattacctttaagtagtccttaactgaatgtttattttctatcatgataatgttgtaaataaatattaacaggggtcagcaagctgtgacccacaggccatatgggccatgagccagataggttttctcatttttaaagagtgataaaacagaacagcatgcaagagagaaaatgtgtgacctgcaaagcctaaaatatttactgtctgacccttcacaaaaaaaatttgttgatccttggatgattgtcattatttattaccgaatgcatgccaagcacagagcatgcaccgttcctctaatcctcaccacaacctgaagatgatgttatcctcatttttttttttaataaaaaaacagcaactcagaatgtacttaggattttttggcttcaaagtctttgctttttcattttgcctttcaaattaagttatactaattttagttgtaatttcatctaggtgaaagaacttgggctttgtaggcaaatagcctaagattcattctcaacccggctgcttactacattgtaacttgggcaaagaaccaaac

SEQ ID NO: 1926 - DNA, 1061 bp, Homo sapiens
ctgggaacaaaggcttaggctcttaaacagtcttccgcattaaatgtgtggtctctgtcttactggcctcaggccccaatgggagcctgcttattagagaagcttttgccaattgcttctctgctttaagatagtaaaaccagcattcagcctttttggctgtaattttagtgttctttcaacacttcctccatgaaagaggcagaggagataattccctttctcaatattccctcttcttaggaaaaaaacacacagggctttttctcctcaactactagaatgctaatgttttcatgtaatagtttcataatttgaggtgttagatttaagtatttatccattttcgttttatttttgtataaggtgagagatacggatcaattttcattcttctgcatatgaatactcaattttccctgcaccatttactgaagagtctgtcttttctccaatgtatgttctccgcatttttgttgaaaataagttcactataggtgtgtggatttgtttcgggcttctttatactgtttcattggtctatacatctggttttatgccactaccatgcagttttggtaactatagctctgtagtataatttgaagtcaggtaatgtgattcctccagttgtattatttttgctcagggtagctttcactattatggatcttttttgattccatataaattttaggatttttttccattttatgaataatgtcattggtattttgatagggattgcaatgaatctttagattgttttgggtagtatggacattttaacaatattgattattttcaatccatgaatatggaatactttttcatgttttggtgtccccttcatttcctttcatcaatgttttatagttttcattttagagacgttttacttctttggctaattcctaggtatttaattttatttgtgactactgtaaatgagatcactttttaaatttctctttcagagtgttcactgttggcatatagaaatactactgattttggtatttcacttttatatcctgtaaatttactgaatttattagttc

SEQ ID NO: 1927 - DNA, 1048 bp, Homo sapiens
cactctgcgtaggtgtgccttcagagattccagaacttgcaacacttggagggaaggactttctgacgctgttccgctggagtggcctattcttgctagtgatggccgttccaggctccaggacacgtgtactccccaactttgagactctcttgttttccagtggcttgcccctcactgtcccctccgctttctaccttgcttctagcacatgagcttgctgatgatagccaaattgatgacctgtgatctgacttggcagttttaccattatggataggagtagtaaatcggtgttgcccttttttttttttaacagctcctgaatcagcaaactggaagttgcttagttttcatcagaagcattccaggcatgtctagttatattatggttctggagtactagtggtcccactacactgtggggctccaaggcttgacaacagttcttccccagattatatcctttttatatacagtatccagggagacaggcttatgaaattaatcagtgattggacagggctgtgcagagaaccagggacagattcttacacatcatatgcctatccaaccctttataacctcttaagtcccttttccagccactgaatagggaaaagttaagctttgtgaaagataggactaggccagaaaaaggttgagaaatggaatattcaaaccttgaatgcagaaaaatactttagaaatacagcttatggccattcttatacttaggatctaggtagtaatatttctccagcaatccttgggatttttagagttgtgttccttcccatttctacctgcagccctcatcccccatccccatgaaacataaactatttccagaactcttagcttgtatagattaaatattagcataaaacgtatttactgtgccaacagttataaatgctgtcactttttaagctaaccatacttttttggggttttgttaatgtttattggcctctagatccatctagatttgatcaaaagtggtactttatcagggagccatagttaggaacacggtagaaatatc

SEQ ID NO: 1928 - DNA, 1046 bp, Homo sapiens
ggtggcaccataattattaaaggaggcaacaccttaacattagtctttttaaatatgtgtcatcttgaatttcatgtctttgattgaattgggctataagcataggcttctctggaggtaagtagattgaaaagcactcctcaacagaaaagcttaaaagtaaatatcatcataagcattcatttaaaaaagaaagcctgtttttgatccagaagttgtgacttttcattctctgtgatgttggtgataactcttaattcaattgtgaccttgtttttcttcctttcagatggggcattctcttctcccaccctcgggactttaccccagtgtgcaccacagagcttggcagagctgcaaagctggcaccagaatttgccaagaggaatgttaagttgattgccctttcaatagacagtgttgaggaccatcttgcctggagcaaggttagtatcaattggcatgtgctttgagcctgagattataggtcaagttataaattatggagtacttggttttgaggttaaggtacaagtaagccttaggttcaaagttcactaattatttgaaaatttcagttgaaccacacagtgatcacattgctaaatccattggtcagtcaattctcagccctcctcttggcctgccagcagcattcaacccagctgatcactgtacctcctgaaactttttcctttcttgacttccaggacaccacattctagctgttcctgctcactgattcttcatctcccaactcctaatttatgctgaagttaccctgaacttatttcttggacctcatctcttttctgtctgcactctttcccttggtgagctcatccactcacctttaaataccatctatgtgctgtgattctcaaattttcatctctatgccagactcttccaggttcatataaccactgcctacctagcatctctcctgggatgtccagtcatctcaaacctagcatgtctaactaggcctcattcttagatccagagttttactcatctaagctaatggcaactacatttttata

SEQ ID NO: 1929 - DNA, 1064 bp, Homo sapiens
ataaagttttactagggaaggagggaagtgtatcatttttctttagttcagacttgaaatgctttgttttctctttgaatttcaccctagtttaggtttacttctgcctcttcacccatttatttttgacttgtccttcaagtatatattcaactctccattcttgtgtttgctttgttttgtgatttgttttttttttttttggtcatttcttatttgtcttgtaacttagcatctgagtcagggtgctttatgaggtagggaccagatctataagattttctttacatatggcattatttctagatgtgatggatttaacaaacctattgttatctgatgatttttacagtatttgggtacccagaggtaccttgtatttggatctaactaaattattgcaattttaaaggggttgctgctattttctcatagcagtaaaagcatgctgaatttaagagaactgggcatgaaaacagctttggtccatgattacaacctaagtactgtactctgctgttattcctggcaataattggaatgaagagtgttcatctactcactttttaaaattaaaattgcttaaagaaaattactgtgatttggtcctctttcctgtcttgcaaggtgatggctgttaactgatgaaattcagagcatgtgttgggtttagattcctctttccccttttacttgtgtttcaggatatcaatgcttacaattgtgaagagcccacagaaaagttaccttttcccatcatcgatgataggaatcgggagcttgccatcctgttgggcatgctggatccagcagagaaggatgaaaagggcatgcctgtgacagctcgtgtggtaggtcatacaaattcattttgtagttagcttaactgatcaggctgtatgtccgtgtaaatgctggtaccagctagaggagataggggaatatctacgattatgaaataactgtgtattggcgacaatatcactgattatctgtaatgctgatgcaattttcagctaaattttccaactgctttattcatagttcatggaaatctacaaaaa

SEQ ID NO: 1930 - DNA, 1091 bp, Homo sapiens
acaccgagcgtgagccaaagcagggcgaggcatcacctcacccaggaagtgcaaggggtcagggaattccctttcctagccaaggaaagaggtgacagatggcacctggaaaatcgggtcactcctaccttaatactgcgcttttccaacagtcttagcaaacggcacgccaggagattatatcccgcgcctggctcagagggtcctacgcccacagagcctcactcattgctagcacagcagtctgagatcacactgtaaagcagcagcgaggctgggggaggggcacccaccattgtccaggcttgagtaggtaaataaagcggctgggaagctcgaacgtggtggagcccactgcagttcaaggaggcctgcctgcctcagtagactccacctctgggggcagggcatagccaaaaaaaaaaaggcagcagaaacctctgcacacttaaatgtccctgtctgacagctttgaagagagtagtggttctcccagcacgcagcttgagatctgaaaacggacagactgcctcctcaagtgggtccctgacccccaagtagcttaactgggaggcaccccccagtaggggcagactgacacctccaacggacgggtactcctctgaggcaaaacttccagaggaacgatcaggcagcaacatttgttgttcaccaatatccgctgttctgcagcctccgcagctgataccctggcaaacagcctctggagtggacctccagcaaactccaacagacctgcagctgagggtcctgagtgttagaaggaaaactaacaaacagaaaatacatccacaccaaaaccccatctgtacgtcaccatcatcaaagaccaaaggtagataaaaccacaaagatggggaaaaaacagagcagaaaactgaaaattctaaaaatcagagcacctctcctcctccaaaggaacacagctcctcaccagcaacggaacaaagctggacggagaatgactttgacgagttgagagaagaaggcttcagactatcaaacttctctgagctaaaggaggaagttcgaacccatggcaaagaagttaaaaaccttgaaaaaagatt

SEQ ID NO: 1931 - DNA, 1068 bp, Homo sapiens
cctccactcactgcaacctccgttcaagcaattctcctgcctcagcttcccgggaagctgagattacaggcgtgcaccaccaggcctggctaatttttgtatttttagtagagacaaggtttcaccatgttggccaggctggtctcgaatgcctgacctcaaatgatccgccctccttggcctcccaaagtgctaagattacaggtgtgagccaccccacccagcctacatttccttttaaattcacttcttagtattttttgttgctatcaaaaataggtttttctcctccattatatcttctaactggtaatcattaatgtatatgaaagctgcctcactgaattttttaattatttgtgttacatttaccattgattctttagagtttttttggaatcctattatatcacctgcatatcagtagttttatttcttcctttccaattgttcatgcttctaattgttttcttttgtctagttgcttgataactctagtaaaatgttaaatggtaatggaaatattgtacatacttatttgtttctgacattagtaggaatgcctctggtgttttcccattaagtaatatactggctttaggattgaggtatagatattttatcatgtttagaaagtatttgcttgaacccaggaggcggaggttgcagtgagctgagactgcgccactgcactccagcctgggcaacagagtgagactttgtctccaaaaaaaaaaagtattcatgtccaacaattcctattctcttgaatactttttattaggagcagtgttgaattttgtcaaagactttttcagtttttatggagataatcatatgaactttctccttaaacccattaatgtaacttacattaatggaatcctacaagtgaaaacatctttgaattattggcatacaccttttgattatggtggtgttagaatctattcgctaatattcagtatttttacatcaatattcataaatgatattagtctttaatttccttgtactgtctttgtcaagttaagtatgaatattatacttcatgaaaatgagttggaa

SEQ ID NO: 1932 - DNA, 1033 bp, Homo sapiens
ctgtgtcgactatgaacttgacagctacttaaaaacttttatgatgaaattgctgatgacattgatgaatgcctttttaattgtatagtgaagtgtgtcaacatgtggaagatctgcataattcatggaatcagtttttctaaatgattaatgcacaggttaagatgtatccaaagcagaagatagaccaacagatctaatgggaacaatatgaaaggtctattgatatggttttagatttcagcagtcacttgtcaagttttgatgtaatatcaagaagaatatccataattatcagaaaagctattaaaatcctcctcccccttccaatttcatatttgtgtaagccatattttcttgacatacttcaaccaaaataacattgcaaaagattgaatgcagaagcaggtaagaactcaattgccttctaatatagccagatattgaagaatcatacaaaaatgtaatttttttgcttttgaaataaaaaaatttgttttaaaaatgatagtctgggccaggcacggtggctgatgtctgtaatcccagcaccttgggaggccaaggtgggcagatgtacttgaggtcaggagtttgagaccagcctggccaaaatggcaaaaccctgtctctactaaatatacaaaaattagctgggcgtggtggtgcacgcctgttagctccttgggaagctgaggcagaagaatcccttgaacctgggacacggaggctgcagtgagacgaaatcatgccactgcactccaacctgggtgacagagtgagactcagtctcaaaaaaaaaaaaaaagcacataaataggtttatttttgatgcactaatttttttaaatttctcaattttaatttctaatatggtaaatcactagatgtaatgcatgtaaacagaagctctttgtgtcctcaagtttttgagactttaaagggatctcaaggcaaaaatgtttgagaactgctgctctaaatcttccagtttacaggaaatacaaaggaacagaggaatgtgttaacttca

SEQ ID NO: 1933 - DNA, 1047 bp, Homo sapiens
tctctactaaaaatacaaaaaaagttcgccaggcggggtgatgctcgtctgtaattctagctactcaggaggctgaggaaggagaattgcttgaacccagaaggcagaggttgcagtgagctgagattgcgccactgcactccactctgggcaacagaacgagactccgtctcaggaaaaaaaaaaaagtttgtcccaagtaggtggatatttttcccataagtttagtgactgtttcctgaacccaaatctgaagagggtttctgtacctgttcctgatgctgaggatagtatgagaaatagaggttggatgttaaaatgttggcatttctgggaccttttgatgattcatagaggtattaaattagtagttggaactcttccagaaaatgttagattgtatctttttttagaaaaagactatattgctatatttcaaaaatgatccatcagatgtttctattatgctaaaatactatctttggattttactatatgcaaagtttccaaatttaataaaattttcttaaaaggacttaagccaatgaaatttcttttaattgttcatctataataatttttcattaataagccatctgtataagattaatataccaggtaagtagacaataaaaattgaaactgaaataaaaaacaatcttttttttggcaatgagctacatagataacaattgcatgaatgtaactaatgaaggtacataattatcataaaaaacatgaaaaattataattatcataaaaaagaaacatgaaaaattgcatggatttttgtttgctttttattttgtatgcttcaactttggacttagagattttatcttaaaatgtttcttttccccccccccattaatcaggcaaaacacattcttggtcctaagagatttcgatgggcttgttcaagttatcattccccaggatgaggtaatagaaaatttcctgttattatctaaaagcttctttgatgctattgctggggtaagctaagtagttagatgaatatgttagaggttttaaattcagaagttt

SEQ ID NO: 1934 - DNA, 1302 bp, Homo sapiens
attaaagaattagataaaataaagaacttccatcatacttactgggcaaagttggtttctattgcaatttttactaacgcttgtatgcctaagaaaaatattatttattcagctcttaagttttgaaataaataaagagcaatgaattatcttttagggatcaacatccagagatgagtatagctaaccctggagaactcctttgactctgacccattattgctatgggatttaactgcccctaagactaaccctggagacaattgcttttcaagtatgtgggacttgtttgcactaataatagtcattcttacccttattttcctttaaggaaagtttttttaaagctcttaactaatagttttacttgctgtattatatagagtcaaaatggggatgcagtttttactaaatttggtaataaagtcattaaggagcagccccagcctttatggtaattaagctgtgactattaacgttttttaaaccatctacttataattactgaagattcctgtaagttcatttgtttctcagaactcttttcccccttgttctgtagtcggcagcctctgtgaagaagattttatgtgaagcccctgtggaatctgtggtgcaagtgtctggtacagtcatttcccgtcctgcaggacaagagaatccagtaggtagtttcgaagatatctgtgtaatttttgcttgtatgcatttgcaccatctgtgtacacattctggcaacacatgactggacattaggcactaaagttgaataaattctacaaatgaactgacagatttcaaaatcttgactataaacaaacacatctatgtaaatatgcatgctaagtctcactctgtcaccaggctggagtacggtggcgtgatcttggctcactgcaacctctgcctcctgggttcaagtgattctcctgcctcagcctcccgagtagctgggactacaggtgcatgccaccacgcccagctaatttttatatttttagcagagagagggtttcaccatgttggccaggatggtcaccatctcttgacctcatgatctgcccatctcagcctcccaaagtgccaggattacaggcgtgagccaccgtgcctggccctttttttttttttttcaggacgggtcttgcagtattacccaggctggtcttgaactcctgggcttaagtgatcctcctgtctcagcctcccaagtatcagactgcaaggatatgccatgacatttgttgatatctgaacacatcagccacatatgcataagaatgtcaaaatcatgcacagaca

SEQ ID NO: 1935 - DNA, 1035 bp, Homo sapiens
cattaatagcttaaaactgcagatcttaagtcaatattgttcaaatccccatggcctcacatacgcactcattggagtctggaaagcactgctccataatgttcagcttgtatgaaaacaggaagatgccagtgtccttctgattgccatggttactcactttgcttgttttgtcaaagcaaggaagagtaagaaattctaggaagctcacctagattgtaggccccaacaacagggacttccttctgtgtttatggagttccctgccaagcaccaaatacactgttgaatctgttttagggcctttagtaagcctttactaggaacactaatcgctgtgacaatccaagtagcatgtgaacattagtcctgaatacttttccagaatgagatagaaaagaacctctcaaacaaacaaaagttctctaaaaaggtagggaacgatggttggctacagtttgttaaagattcttatttaaaagttttctacaacttttatagaaaaactaagttatttccaacattagattacatttctcatctgttatctttgtattttactcacagggttagacagactgatatgccttgtcactggatctccaagcatcagagatgtcatagccttcccaaagtccttccggggacatgacctcatgagcaataccccagattctgtccctcctgaggaactgaagccctatcatatccgagtctccaagccaacagactccaaagcagaaagagctcattgaatcatgcataccatgcagaaagttgagcttttaggttttgtcctctttgcttccccaaggctaaagtcagatctagagttctgccacaggtctaacaatcaagtctttagatggaaggaatccaggcaacattcttcaccacaacgaagaaacagataaaagatacccaattttgacttgatttcatgcatcatttggattttttttggttaggactttttttgaagttcctttttacttaggtgtgaaagatggttctttgttgaaataatatagtggt

SEQ ID NO: 1936 - DNA, 1070 bp, Homo sapiens
tcttgaactcctggactcaagagatccaccttcctcggcctcctgaagtgctgggattacaggcatgagccaacgtgcctggcctggaaagcttactattaaataatttgatttcttggagatatcagttgtattttaagtttacaaataggtgaatactcttgtggtatggaaacattgcatggctgctgaatctctttcaacaggagtttctattgggtggctacatggatcatattcttgagatagtgaaaagttttacctacttatcttaatcccattctacctctacacctccagcatgattttgtgctcgaagatgaatcaattcctttcattcttgttacctttcatacaggaaaattcatcgcccaattttatatgttgttaatcttttaaaattggcagttgttaccagcctctctcatttaaaataacagatcattgaagttttttgatttttggttagatgtgtcagatttaggatgccttatttaaactcgtgctgtcttactagactgttcctgctctgagaagaaatatggacagagaatgaatttcattgtccatattgatgaaccccaaatcaatacacttcttaagaaaggtttgagattatccagtccatgtgcaatgaatccttggagcattagctgtgtggccttcctactgataatctgcagttatcacagtaaagagatctctgttcctaggtcaggccttagcaattacaaatacaggaaataaaggggtactcaatgctgaagacttaattttgggtacctacaaagtcctgggaagggaaaaagaagaccttggcatttgtatttgcataaccagagatggaatgtttgaggcttttaggcataaagattaattagattttatcatataaagattagggcaaattatttttttttccagttcattcttaacatgttaagggacaaattttaatgaataaaaatttaaaggccttaaaactttcttttggattcacatttccactctggtataatccactctggtgtagtctgccctttatgacagagaaagcctttgaaaatatt

SEQ ID NO: 1937 - DNA, 1025 bp, Homo sapiens
taccaactgaggtggagaaaagtgtaggcagcttgctttgagaattttagagctaaagtacagtgaagggtaattttaaattttacttcttttagaaggttttatttataattaaattgcttttttggttttatttgaataaatataaaattatacattcaaataattatttcttgaaattttctcctttattttaaaatgctggttagtatgtgatagttgtagcacatttaaagaagaatacaagtaaaaagtgcaattctacttctccctatacattgtttaataagcatatgccttttaaaaaatgaccttataatgggctgagtatattttggatattgttctgtggcagcataataccacataacttaattaactgtctccttattgttaaatgtttagattccctccttcctgcaccccctttgaaagcaatgctgacatgtgtgtccttgtaattgtactttgatatattggcaagtattttcctgggacagaattttgcagatggatcactggattattgtgtacatttactttaaaatttgcttaaagtcggggcgcggtggctcacacctgtaatcccagcactttgggaggccaaggtgggcggatcacctaaggtcgggagttcgcgaccagcctgaccaacatggagaaaccccgtctttactaaaaatacaaaattagccaggagtggtggtgcatgcctgtattcccagctacttgggaagggtgaggcaggagaatcgcttgaacccgggaggcggaggttgcggtgagccgagattgcgccattgcactccagcctgggcaacaagagcgaaattccatctcaaaaaaaaaaaaaaaaaatttcttaaaaattttcttttaattctaagagagttttatgttgacttctagtgctttttgggcgctgatgctcacacttattttgataaagatgaaagatgtttaccaaatagaatattggacatagaaactcccaaggaaattctctacgtagctgaatttcaggc

SEQ ID NO: 1938 - DNA, 1041 bp, Homo sapiens
acagggtaattttctttttacaagactgaagcctctgtgaaggcaagggccatccatatatattgggtttaccatagtgtaatagcctttggttagagcagtgtctgctatgtaataagaagcttaaatatttgtagacttaatcaaatgtttattatttatatataaagtgtcaggcactgtggggggcattacttagtaaaatgccacttagtcatctcattgatagcctatagtacattttaaaatggaagtgtgtacatccaagtatgcatttaatgaaatatgggacatttaaaaaagttttcagatgctaatactgaagagaataatgcaaatttactaaaataattaggaccctttttaaaacatgggggcaatgttgcttatctttttaaaaatagtcatttatttttcgttcactatcttaagaattctgatcatcttgtaggaaacttagaaacactaggaaggtcataggcactattattaataattatagaattgttttcctctaaattagagttttctttgtgaccctacataacgtaatgatatttgctctctggagagccaaatgggcctgaagtatagaaacagaactgaaatatagataattaaaactaaactaatatactataattctgattgttatgtcttaagatttgttggccttaataaggtgtgctgggataaacaaaaaggaaggcatcatttgtaaaggttttcttctttaatcccacttttgtttttgcatgaccagaaattctctgatatagcagggtatactttatataaagactatgggcagtaagtgtttagtgtttgtctttatattaggtctatagagtgtggtttcttgattatgggtgaggaaattagcctttcaaattccattagctgtaaagtggatttggatttggtatttgtattggttggctaatttaattcaaatcttttaaaattctcgtgctgaaatgatcttaggaagatcaaaatttctctaacagaaattattttggtctttgaagtgtataaatt

SEQ ID NO: 1939 - DNA, 1044 bp, Homo sapiens
aagataatattttgagagattcaaaagtatgaaatggctggctctggaactctgacataagatttaggattataaaatcctagaatcctagattttaaatcctaaaattttaaaatataaaaggagtgaaaatacagagagacctagattttgtttgaaatatttcatttctttttgggcattggcaagattataatgatggtggagttttgcaatgacttttgagtgtttctttttttgtttcttcagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgaggtaagctctaatttgtttttctttagacacatattaagtcttttgggtggtggtgaagatgttatagcatcatcaggtgtagaacttactgtgaactcacactgtagacatgcagagtaaacatgtttaggcttagactgtgttcattgtttgaaaggggcatttgaacaattgtattagtctattcttgcactgcaataaagaaatatctgagattggataattgataaagagaagaggtttaactggctcttggttctgcagggtgtataggaaacatgatgctggccatctgctcagcttctgggagggaggcctcaggaggggaggcctcaggaaacttaaaatcatggcagaaggcaaggggaagcagaattgtcttacgtggcaggagcaggagcaagagcgagaagggggaggtgccacacgcttttaaacaaccaggtttcatgagaacagctatcatgagaacagcaccgaggggatggtgctaaaccattcataagaaattgttcccatgatccaatcacctttcaccagccccacctccaacattggagattacaatttgacatgagatttag

SEQ ID NO: 1940 - DNA, 1045 bp, Homo sapiens
tctggcactccctagtgagatgaacccggtacctcagatggaaatgcagaaatcacccgtcttctgcgtcgctcacgctgggagctgtagaccggagctgttcctattcggccatcttggctcctcttcgataatttgtttacttgcattgttagtaccactttcctctccctttctctgtcttcattcactacattccagttatactagcctctgtattcattcttataggacttaccagtcatatttcccgccccaggaccttggcatattatctttatactccctaagtaaatctttccctgattttccaatgctttttgtttcatcttagtaaacattttatcataagaagccttccttggttatatcatgtaactctctttcctcatactgggccatttttttttccttcgtagcacttttctttgaattgatattatatttatttgcttattggtttattggatatcttcctcactagattataagcttgtgagaatagtttctttatatttttccctgctgtagcttcagtggctagggaagtaagtgattcattgtaagattttagcaaatatttgctgaatgaacaaataagcagaccaggtcaaggaaatgaggttgaatttgtctggagcctggaatattctctgaaagttgctttaatcttttaaaaaccctttctgatttgcctcattctctaaagtttagaatgtgggaaaacttttgctaaattccaagtaccaaaatattggcaatataaatttagaaaattttggtaaaaatgctttgaatttttcaggaaagggtttgcatgtatattgtttatatgttatcgtctaaaaatgtcaaaatgtctttttaaagaaaaattgttttcaaagtgtcttctatgctatctgtttagcttcaatttgccaaacacaccttgacagagatttagtgttttgacttgcctctttattcctggggttgtccccttaccctcagtttctaaatttgagatcttgaaggggtcttgaatgtgtagatcagtccagga

SEQ ID NO: 1941 - DNA, 1051 bp, Homo sapiens
aactgaacatgcacagacacatataatttagattgtaactgtagaaattctctatcagaacccatgccttctgaaagaagttgaagttttgtgttttgttttttagataaggctttatctatttttttcccagcacttacatatctatgtgtatactgacttcttgttcaaaatggtctgatagacaggagagtgaatgagtataagtatgctgctagtgtgcctagcatatagtagacagtgaatataaatatgctgaaggaatatgtatgtttctgtgaatgaggggggctatttctgatccttacgaactccactacagaggtggggaagcagatggtagaatcctggcatttcatgttggcagccatcatttaacccacctgtgtgatttccgaatcactggagctcaacagcaaggaaatgagctttgaagacctggaaaatctgctgcttggagagagagaaatgctgctgcagaaggatactgaattgctgcaagaagtttccataactaatggtatgaaactgtcttttggattgtagcattcacttgggtttagagtaggggaagtgtttatttttgagagcttatcatggtaggtaagtagtggaagaaaccctgggaagttcttggccagaccattttggatatagtattaaataaatgctgtttctatagagcatattttttccattgcacgttgtaagaaagttatctccatctattatttaattttttgagtgcattttagaaagtattacattatgggggcattagtggtaaaatatattgtttgaaggagaaatacatgacagtggtcattaaaccttattatgagacattatttctttttaaaaaaaattttaaaaatcctcctccaggtaatgaatgacacatcagttctaaatgaggaataacccaatataaatagagagcttatgccaggcactgtgctaagcgttcatttgatactcataacagcccgtgaccaggttggacttattagacaagtgactttatgtttctctttgcctggagcagttctat

SEQ ID NO: 1942 - DNA, 1039 bp, Homo sapiens
aaaagaaaataaaaggtgcttaaaattccgccgcagttaagattttggtgtatctccattccagatatctacatgtgctctcctccctgcctcttcaaaaacaacagcaacaaactcaaacagatatacagttttgtgtttagtattttctatagatactgttttctggagaaagattgtattatttatcaataaaccttttccttctgcaaagaaatgcccattcaagactatttgtgtgtatgtgttttaataagtgtgacatgtattgaagtgtttgccatggtatgtgtttttaatttcctttcttgatgtacagttagcccactatatttgtggattctacatccatggagtcaactaaccatggctttaaaatatttgataaaaatgtatggtttcatctgtactgaatatctatagccttttttccttgtcattagtccctaaaagatacagtataaaaaccattcacatagcatttatattctattaggtattataagtaatttagagattaaagtatatggaaagatgtgtgtaggctatatggaatattacacagttttatataagggacttaaacatctatgcattttggtatctgggagttttggggggtcctagaaacaattccccatgggtaccaaaggacaactgtaattggttatccagtttgttataagatactgatagtcattgtttctgaagtttatcttgttaattcttggattactgtttcagcttattcacagactctagaattcacaatatattttaactcttttggtagaaatggcagcttgtaagacatagtattaaatgcaatttgattgctgttaatgaaattaatgtactgtcgtgttctttctccaaaagagagatagatggaatcttatttttttttctccatcattctgtatcactctggctcagctccatacgcttaacctttctataaagaattttttgaagccttgccagatgctttagaatttgccaagttctttgactttttttgatatggccttctgatgtg

SEQ ID NO: 1943 - DNA, 1049 bp, Homo sapiens
gtctaaaagtatgctcttctcacttcctttgctttggatttcactgttttacaggcacttatgaccacccaaccagctaaaccagacatgtgacagtcttaagaacttcaagtaaacattattcctaaatttgttttaaaactgaaatttatcatgttgtcattttttttttttttttggagatagagtcttgctctgtcgcccaggcaagattgcagcagtgcaatcttggctcactgcaacctctgcctcctgggttcaaccaattctcctgcctcagcctccccagtagctgggactacaagcatgcaccaccactcagctaatttttgtatttttagtagagatggggttttaccatgttggccaggctggcctcaaactcttgatctcaagtgatcagcctgccttggcctcccaaagtgctgggattacaggcgtaagccaccgtgcttggccatgttgtcttttttaagatcttgcttttaactttggttagcagacaaaatataaggctcttgtaaactcaatttagaaattaataatgactgtgttgctgactataaagtttatagtcaaataaaattaatagtttgctgcctgtggcaaggtgagagtttagtatatcttaagaataagggtgttgttgcttaaatactttgttgttttgttctaaccttggaataggttattttatcattttattagattattggtaattcctattccttttgaatatttcagccctgtgcctaaggatagagataaattttatttcaaattaaagcaaggaatagagaagaaggttgtgattacagtgcagcaactttctaacaaagaattagctattgaaaggtaagcagcttgctcctaaatgctaccaaaaacttgtattgacattgttactgtctcagatgcattgctcagtgtggcttttcactatacttcattttctccaattaaaaatgaggataattaataatactttctctactttaacttagatgtaactggtttcattgaaaatcaattgctggggtaagtaaaca

SEQ ID NO: 1944 - DNA, 1044 bp, Homo sapiens
taacttgatgttagaccattctgagggtcttttgctggatttacttagtacttatttttacttttgccttagcaagttgttacagttttatttaggtaaaaactcaagttactatcttgaagttgcctagatgtcagtctgatttggatgttttattctcttatgtgaattagtacgtttatgaacttttacagcaaaataaagaattttagatgttataataatttctcttagaggatatcattcctccctttcctgaaaatgggaatagattagtgggatgacccatattctgcataacattttaaaagctaccctgtgagcttactcacttgtcctttttgtgttttcttttaaggcagtagaaggataactctctttttccataggaaaacaggtattacttacttatacaaaagtactttcattattctctgttaatgatttcatgtgacaattgatagaaagctattggcattttcaggtgaataatttggggagtggataactggaagcttctatctgactctcagcctttgaactgaaacttgtaatcaggacagaattttcagcatcttttcattgctggcttctgttggcacccagtggggagaggcggcatcatggtttaagtattaaatgtggatgtagtactattacgtttttagcattgtattttaagaaatacttttaaaatatgagcaatgaaaacatatattgttgtctgtaatgtgttctcataagttgattgattctagatgttttggagctcattaaaaaaaattccagtttgaagtaattgtagatgcacaggaaattgcaataatagtatagagatgctctatgtgtgcttccccatttccccctatggtaacatcttacataaccatagtacagtatcacagctaggaaactggcattggtacaatttgcagacctctattgcagctctttttgaatccttttataaatcacagtatacttctataatataaacatttaatttattggtttaagaaatttggatatgtagcctggctgcta

SEQ ID NO: 1945 - DNA, 1043 bp, Homo sapiens
ttttaaggctaattttctacttgtatactctattttattccattttgacatctcaaagacattgtttaagcagtctttcttctaccacacttgcttgttagattagcccatccagtctcatgactttaaatatatctatgactggatgattccaaatgtttttctctgacctgaggtctccaaacttatatattcaacaacttcagatcttcatctggcatctcaaagttaatatgttcaaaaatcaaactaaaaaatcaagtttgacactgtcccaaacttgttcctcctgtaatttctcacagtctttttaatttgtaacttgatctttccaattattgtagatgaaaaacttggcattttcaactccattttctctcactctacatctaattcttcattaaatcatattagttctacttccaactatgtaaagaaagaaaaaccctagaggaaagggattaaagaaaaaatacgaatagaaatgggaaaaaatatagactgtagataaaagaaaaaaattagaaaaaaaaacaaaagaaatgacaatcgagagaaaaagaaataggaactccaagtctaatcactagttttcttattttatcaaaagttaatgtaggtacttttgctataaattttctcataaaattgaattcatcattttttgcccatgttttgttcaaccctatctacatgtgttttatgagtgataatcaggaatcagtagcctgcaaaatgagcctttatgaaggagaaaaatggacttttgttaatcagctgtagctgtacaggggaagatattccttttctttatgcttttagatgtttttgaattgtgtttacaaatacattcaattgtaaaaatacttgtaaattagcacccgtttattttgatgcatatagctagtatctgcaaaagcccaaataatgtatcactatctgaatgtcctgtattagtcttactgaatggaaaagcaaaataattgattttaaatgttttaagcagggattaaaccatgtcagactttgaaatttattggttt

SEQ ID NO: 1946 - DNA, 1032 bp, Homo sapiens
agtggtatcatgtttccctgattctttgtgatcctcatatcattgtattagtgtctgcacaatttaggaagtgatcacctcttctagcctttacatgttcactttggcaaggaaagatctttactagtctgccaagcctgggcttctggttgggccagctggtagcatatgcaggtaagtgaggctggggtctctgatctggtggggctgctgccgttgctctaaggttgggtggagctctcttgttgggcaggccccctgactggtatctgaggtcaagtgggactgttggttgggctttgtaattgcctctggttgggtgaggctgcaggctgtgccccaaagttaggcggggttgctggctgggctctacagctggatggcattacagtcaggtagggatactgattggactccctgattggttggggctggaagctgtgccccactgtttgatgtagtcattggctaggctccctggttgggtgggattgcaggttatactctgggctgctggcttggttccctgcctgggcatggttgccatctgtgctttgcagctgggctggattgctgactgggaaacctagacacccagtactgccaaccatactccctggccagactgggtgccaggattgctttgcaggtgggaggagctgctgcctgggctccttgtcaggtgaagctgtcagcagggatgtgtggtgccattgccaagatacatgtgcttgttgcatgtggtctagtcctgacaattctcaatattctgtaggagaagagatataatttggccttttgggaagcatgctggaatattgggaaagctagatgttcaccttgtgctgctggtgaaaccatagactcagcaaatctctcttggcatgaggctgttttggcctggggtagtggcaacatcatcaaattgaaattgctccacttatacttccaatacaacttttctaagttttgtgcttctggaatttttgcaaagatgttcttgtatgtagatagttgctagttggtatttct

SEQ ID NO: 1947 - DNA, 1031 bp, Homo sapiens
ctccagcacctgttgtttcctgactttttaacgatcgccattctaactggtgtgagatggtatctcattgtggttttgatttgcatttctctgatggccagtgatgatgagcattttttcatgtgtctgttggctgcagaaatatcttcttgaagtatcttatgagaagtttcaaatgatctcctgtgactttagaattttcatgattgttacgtcatgtcctgtttctcatttgacatcattcaattcttgtttttttttgttgctgtaccccttaccactgcttttttttggaaatagtggggtatctgctctatttactacatggttgctgctgagcaataactgacctcacaaaaagcacatatcatatggctctgtgctcaatactctttttatacaaactagagctaaatgacagatgtttacttttaagaccttgtatcatgtgcttctagggtatggtttattaatagtaaatttcttaatttttattatctttgaaaaaagcatcttagaattctcagtcttgcttctgtatgaaactgtttttttctatgattgccataaacataataattatttttagctaatatttatttagtgcttactatatgctaagaacattccaagtatttcaaatatgttaacttatttgagtcttacaatcccatgaatactcttattaacttggttttaaggatgagaaactgagacacagagagcatcatcacttgctaagctcactcagcttaaagtgacaaagctgagatctgagtccaggctatctgactttaagatttgtacttgtaactatgacattattcggtcaagttagtcagttgactaaaacatgagaacagctcacttttaaaactaaggtaaaattcacataacatgaaaataacatgaaaacttaaacatgtacaactcagtggcattttagtacattcacaattttgggcaaccatcacctctatctagttcttaaacattttcgtcatccaagaggaaatattatacctattaag

SEQ ID NO: 1948 - DNA, 1933 bp, Homo sapiens
gcatcctggttgtgttccagatcttagaggaaaggctttcagtttttctccattcagtatggtactagctgttggtctgtcatatatggcttttattatgttgaggtatgttccttctatctcaagcttttttgagggtttttaatcatgaagggatgtggaattttatcaaatgctttttcagtatcaattcaaatgatcatagtttttttccttcattctgttgatacgatgtatcacattgatagatttgaaccatccctgcatcccagggataaatctcaattggtcatcatgaatgatctttctataatgtattgttgaattctgtttgctggtattttgttgatgatttttgcgtgagtatttatcagagatattggcctatacttttcttttttttgatatgcgtttgtctggttttggtatcagggtaatactggccttgtagaatgagtctggacatttggaagagttccctcgtcctctgttttgcagtagttcgatttggattggtgttagttctttaaatgtttgatagaattcaacagtgaagtcatcggttcctgggcttttctttagtgggagacttcttattattgcttcaatctcagtacttgttattagtctattcaggtcttggatttcttcatggttcaatcttggtaggttgtatgtgtctaggaatgtgttctattcttctagattttccaattcattggcatacagttgcgcatagtaaccactgatgatcctttgaatttctgccatctcagtgataatgtctctgttttcctttctgatcttatttatctgtatctttttgctttttttcttagtctggctaaaggtttgtcaattttgttgaacttttcaagaaaccagtggtttgtttcattgattgttcattttttaaagtttcaatttatttgttctctgatctttattagctctttccttcaactaattttgggtttggtttgcttctgcttttctcatttttttaagatgcatcattagaaggtttatttgaagttcttcctttttttgatgtagacagttatagctataaacttccctctttgtactgcttttgctgggtttcggtatgttgtgtttccttaatcatttatttcacgaaatttttcaatttccttctcaatttcttcattgacccactggtcgttcaggagcgtattgtttaatttctctgtatttgtatagtttccaaaattcctctttttaacaatttctagttttattccactgtggtcgagaagatgcttgatattatttcagtttttttggaatgttttaaaacttattttgtgacctaaaatatggtctgtccttgagaatcatctgtgttctgaggaaaagaatatgtattctgcagccattggatgaaatattctgtaaatatctatgaggtccattaggtctatgatgcagattaagtctgatgtttctttgttgatttttttgtctagaaggtctgtccagtgctcacagtgggggtttgaaggtattattgtgttggggtttatctttctctttagctctaataatatttgctttgtatatcttgatgttccagtgttgagggcagatatatttaaaattgttgtatctttttgccgaattgatccctttatcattatatggtgactttctttgtctctcagagttttctgtcttgaagtctatttttccactataagtatagctattcctgctcttttttgtttgttttcttgtttcagttggcatggaatatctttttccatctctttattctccgtctatatgtgtccgtgtaggtgaagtttgtttcttgtaggcaacagatcaatgggttttgctttttcattcatttagccagtctgtgtcttttgattggagagtttagtccatttacattcattgttatcat

SEQ ID NO: 1949 - DNA, 1058 bp, Homo sapiens
cctcaaaatgtaagaaatgaggggtgcagaagagatagattagagatattctggagataaaattagtgaggcttataaatgaattggatactatagatggcagaagaaagagaggagaaagactcaaaggttataatgcaatttttggtttaggtaactggatgatcttgatgccagcaaatgagataggaaacacaggggggaggaagtgtgggtttggaggtgggaggaaaatgtattcagttttaaatattgatgagtttgagttcactgtggaacactgaaatggaactatttttcagttattagaaatagtcttaaactgtgagaaaaactttacaactggagataaagtcttcagagtcatcagtatgaagcaatgagaatggctgaaattatctttgaggaaaatgtgggagaggtgggttaaaagtagatgttaggacatcactaacatttaaggggtaggtccaggaagagaaagccctagctaaaggatctgcagaaaaatgatgacaatatgagagccaagacagggatagaataagggatggagattgtcaaagaagaagtgatattcggtgttgtcaaataaacaaggaggtttaataagataaagaccaaaatctgttcttacaagttcattagtttggggggattatggaacctctacaagggtgattttaataaaactgggaaagaaacctcattgtagtgcattgaggattgactaaagataaggaaggagagaacagtgtttaagtaactcttttaagaaatataagaagaggaaagagattagattgagaatactgaattatttctggccaagagaggacaattttagggtgtaaaagacttgagcttctatgtggttagaaaggaagaactaaaaatagagagaagttcacccatcctgcacttaaccatacagtttcctgacatgcttctgtgtcttagcaaatgctatttactctgcttagagttttttcaacaaaggcatgttaatagtgggggaaagaaagtaattttagcatcgtggcagtttctcagacatc

SEQ ID NO: 1950 - DNA, 1048 bp, Homo sapiens
gagcagaatacagaagggtggacttgtagctgataggcagtgggtaaatgactacaaaagggtaaaagctgggcctaattctcatttacccatttatctggtccaattgaattaggctttcctgatacccaatgtttttagatagagatttatttattaggagcactgataagaaaaaaaacagcaccaacaacttgtcctaatcttcttcatctttggtctgaaagtgtacttttatggtccaaccatgtggatgtgattgatagtattggatgtaatggtagcgtatgcattgataccacagcttggctgctactgttacgtggtttcttcctttcccacttcaagttatttgctgggggaaggcttaggaatttacatggacctccatgcatcatagaaataagcaacgtgtctcctgcggcagctctactctctggacagagtttatttgtccctgattctctggtgaagaacaggggcatagtcttccgttgtggccacttcataaaacaaggactcccttcttactggctctcacattactgagaattgggtgcttactttttacgggcccaacacattctttctagtatagcaaaatacacaacacctaaaactaataccttatactccaattgaaattaatcagcaaaacagctcctagatatcaatatataggtattgtagaaactaattttctttggataaggtgtttcttcttgtccgtaatttactcccaaaggcaaaataatttcaacttgataagatctatcggaggggaatataatttaatgggaaaaatacattacgcttaaactcagaactgaattagacttccagttgtagtgctaacttgataggtagcttgcacaagttatttaacatttttaggttccatttttccagtgaagcttttataaacctgctcatgtatgcatgctttgtctttcagaagtggaataatgtttgcaaagtttttttgtgtgttttgtttttctttttcctagcccttagattgagaaaataccttaatttttattgtctt

SEQ ID NO: 1951 - DNA, 1029 bp, Homo sapiens
acactttgtgctttggggaaatattttttaaagtgaggatacagtatatatgctcagtgaaattttaaacgtgtttgaaaagattttgaacttactcttaaatagctagatcattcttttaaaaaagcaaaacatgaataaagtcagaattcttataattaaatacactatcagaaagatgtaaaggaaaaatatttcaatactaatttgaaatcattagaaaaaataaaaataatatagaaaactaagaacagactgtataaaaagttcagtactggaggtctttataacagattggagatacaggtgtattgaaataactacatgaaaaaagcacataagctaaagaaagaaaggttgagagagagagagagaaaacatttgggataggagaacttgtaaaaacaaaactaaacgtggtagcaagatttcttttatatgttgaatatattcagaatggtaatgctgatgatttaactattatttaaataatttaaaggattaggcagaataatatctggataactgcttcaggttttgagatgcatggaaaacttaaaaaagtttaaagacaaaaataaaggtagtgcttactgtgaatacttagtaagtcaacttttagcaggaagaatatgcaggaagattttctaaccaaaaagactaagtgaacattggaggaaaataattgggtattggattattacatcaagtaaagtcaccttcaaatcggtcattcttttttattgagtaagagaaaattggtacatagccacctacttccacctcctatcaaaatttctgtaattccattggtgacttttcagtggtcacattcaatgacttttatccccctcatctcttgctttttctgctgtttttattgaataagagaaaattgatacatatttagtaggcattttaattgtattttcatggctattcattacttatcagcagagtgggaaaatgtattctgaattaatatgcttttcatcttcataatgacctttaatctatcctttttcttga

SEQ ID NO: 1952 - DNA, 1031 bp, Homo sapiens
caccaccctaggtcttaccacctaattacttaatctactctaagtactgtattttaaaataatagtaaaattttattttttaatttaaaggaacctctcctcataaatgagatttttataatcaagactttgttcctcagactatatgaacttttagaactttttatctgctgtaatttctttttacttttctttcctctttgcctccttcccttccataaatattttctgagtgcctagtataattatcactgctgaattcagttttttttttttaatttaactttttttttttaaattgatggcctctgcattggaatatgcaagatgatccattggtgtgtgggaaaaaatgtccaaagttccatttgtatttcttttaaataagtacaccaaaggatactaagctgtactaatatttggtgtgccatagtactgaggctttatgaggtccttgggtccagtggccactggtcccacatggttcaggagtgaccttagggaagaatggaacttacacactttggaggaataattgtggggctcacactcgtatattaacttccaaaatattataggtttcttgcagtttgcatgtgttagattaagtggatttacaggttatctagatgtaacttaatcctcataaaatgtgtgattggcttaaaaagattactatcacaggatgctgcatgtcaagttttttttttaatttaatatgttccttcagggaagaattaatattatgataatgacaaagcaactacttttggaaacaaactcatgtaacaaagatggacattttgaaacatatggcggtttaaacacctctgtgatttttttcattgaaataacatgcatcactataaaaaactcttacatcttcacacttaaaaacctggaatcagaaactttaaatatgtttaaaacttatacaagtagttgcagagaatttggaactgattgttaaaagcatataaacacaacaccttctgatttgttcatatgaatatctagaagctggtgtggtg

SEQ ID NO: 1953 - DNA, 1135 bp, Homo sapiens
gtcttgtaaagatcctttagaaaaactctatatttttctgatcatcagttattaagagtaataaagaaaaggttgaagaaataaaagcactatctcatttctatatactgttcattgtatggaaatgaaaatttataattcagaaactattctatcaggaaacacatataaaccttagaagtcagtgagtaagaaagaagttctaaagcgcctaacttcaagtcatctcttttaagatgagtcttgagccttcaaccattgtctgttgttacatgattcctgccactgagttgtagggtactactgctgctgatgaatcactggaagacttttaccacatatttctgaaatcctatgtcctttattgtttatcattgagatgtttttattattcctgttaagctgcatttttcataacgtttgaggtgatctgaaacgacaatagaaggatcatgaccttgttcctgtgtagaaacaagcaaacagtatttagagcttctgaaatgagtacttcttaattgttggcttgaggacccactaagcaatgatcacattttcacatattcttagccatttgaaatggagattgtgtatgttttagggcaagtcaaattttatgtagcatgacagaactgtgtgtgtactttcagtaattgtatgacatatatggtatagtttgcctatcatatctgctggtttatataacataggaaatattagattgtagttgtgtggtcttttgtaaaaatgatcttgtatgtaacgtgtgtactgtatactttgttaaaatcaaaagatgcttttaattgataagcttttagaaataataatgccatgaggtgtttctctctaccacttgaattcctgtttttctcccaaatgaatcttttctttcgaaagtgtatgtggttatatatgagagtgtgtgtgtgtgtgtgtgtgtgtgtgtgtgtgtgtgtgtatatatatgtgtataccatttcttttcttctctcttttttttttttaagagacagggtctcaccatgttgctcaaactggagtggtggctcttcacaggtgtgatcatagtgcactgcagttcattcttttaaaaggatttaagtgctagtgtttgatagacctggatttaaga

SEQ ID NO: 1954 - DNA, 1085 bp, Homo sapiens
cccagctacttgggaggctggggtgggaggatcacttgagcccgggaggcagaggttgcagtgagccaagatcacgccactgcactccagcctgggtgacagagtgagaccctgtatcaaaaaaataaaagaaaaaaagaaaaaagaaagagaaactaagaattaatgaaagaggttctttaagaaaatatacaatttattttctcttttcttgcataattatatatttgcttatggttaatttttttacagaataatttaaatcaaattttcttgatccccatcctttgagatctttcatttactgtctgtctatagtgatatctacatatataaaaactgtaattatatgtgaatttgagaagtaacagttttcttctcaactctccaacactgtgtataaaatttaaaatatactctaagtattttcatgtacttaagtgatatattctattattagtaacaaatatagtttttgttatccttcaaatgtgtttaatagttttgaggtaaattaaggaagatataactttttaatattaccttcattttcatattatggaattagagtaggagtatactgttttgaagaaagatgttagaggttattgttgagcatagatcatttcatggcttacatggtttactttttaaaaacttaaggcagtgttagtcaaataacaatactagatttcactgagagtcagaggattgcttaattatacgactgccttgttctttgtcatcaccttgtgtagttttgtaggctttaatcagtaataaaatcagtacttgcctgggcatggtggctcatgctttaatctcaatactttggaaagccaaggcaggaagatctcgagtccaggagttaaagacgctgtctctacaaaaaatacaaaaattagctgggtgtggtgccacatgcctatggttacagccactcgggaggctgaagtgggaggatcacttgagcctaggaggctgcagtgagctgtgattgtgccatttgccattttaatgacaaaacccacaattacttttgcatcaacctagtctcatattttcaagagcctgggattacactc

SEQ ID NO: 1955 - DNA, 1078 bp, Homo sapiens
tctgcatatggctagccaactatcccgtaatagcagggataatgtgtggctaagtcttttcaccatttattgaataaggagccctttccctattgcttatttttgttgactttgttgaggatcagatggctgtaggtgtgtggctttatttctgcgttctttattttgttggtttatgtatctgtttttgtaccaattatcatgctgttttggttactgtagccttatatatagtatgaattcaggtaatgtgatgcctccagctttgttctttttgcttagaatgctttggctatttgggccattttttggttccatatgaattttagaatagtttttttctagttctgtgaaaactaatgttggtagttgaatagaaatagcattcaatctcttgctttctttgggcagtatggccactttaatgaaattgattcttccaatccatgatcgtggaattttttaaaaattgtttctgtcatttcagatttatttgagcaatgttttgtagttctccttgtagaaatcttttacctccttggttagatgtattcctaggtatatttttttgtgtatgtggctaattgtgggattgtgttcttgatttggctctcagcttgaacgatattgctatatagaaatgctactgatttttgtgtgctgattttttatcttaaaacttttctgaagtcatttatcagttccaggaaccttctggcagagtctttagggttttctagtataggatcacatcatcagtgaagagagatcatttgacttcttcttttccaatttggatgcctttctttctcttgcctgattgctctgggtaggacttccattactatgttgaataggagtgatgagagtgggcatccttgtcttgttcattctcaaggggaatgctttcagtttttacctgttcagtatgatgtttgctgtgggtttgtcatgaatggttcctgttattttgaggtatgttgctttgattcctggtttcttgagtatttttatcatgaagggatgttggattttatcaaaagcttttttcacatttattgagatgatcacatggctt

SEQ ID NO: 1956 - DNA, 1065 bp, Homo sapiens
cagtcttgtgactatatatcctggtgatgttcattttgtgtagtatctcacagatattctctattcttgtatctggatgtctacctctctagcaagattagggaagttttcttgaattattcactcaaatatgtttttcagattgtttactttttctcctttctcaggaatgccagtaattcatagatttggtcattttacataatcctatttttatcaaagactttgttcatttttaaaaattcttttttctttatttttgttgactgtattagttcaaaacactggtcttcaggctctgagattctttcctcaacatggtctcttctgttgctaacacattcaattgtattttgaaattccttaagtgaattttttaatgactgaagctgtcattgatttatttttaaagatatttctctcttatttcctggcttgctttagacgtttgtgtcgattttcaaccttgtcttgaatctcattgagcttccttgcaatccatgctttgaattctttctgtcatttatgagtttccattttagttggggaccattgcttgacagctctaaggccatcccttggtagtgtcactacattgagatttttcatggtgccagaattcttgtactggttccttctcatctgaagacactggtacttctaatttttgtcattattttctcgcaggtatgattgtttttctttcttcatttccctatagtgttattttattttttctgtaccctcctccccccctttctctatgggtgagactgcagagaattctggttagggtcttttggctttgcttctatagccctatgcacttctttgggcaagttttatattgggctgtgcaatttaatgtacaagccagtagatgacgctaggcagccaatgcagttgggtatatacttgattcttgtttattttcggaagctctctgttgtgtcaggcagtgtactgattctttgaatgcacagtggtcgagctccctgcttaactaccataggacagaggccatgaaggcagggatagaccagcacatctgcccacacgtcccct

SEQ ID NO: 1957 - DNA, 1047 bp, Homo sapiens
ccttccctatagcctgttctctacagtgcagctgaagaaccctttttaaaaatgtttcagtgacatattcaggatatagaataaaatccagaatttttaaactattttcagtgttcttcattcattcccaaaatctaagtttctctctgctgtcatttctcttgagcctgaaataatttttttagcacttcttatggttcaggtctgttggtgaaaacttctcttagatttcctttatttgaacattctctattttgcctttattctttattcttgcagggtgttttcactggactactgagttgacagtttttgctttcagcattttgaaaatgttccactgccctctggtcttcatactgcctgatgaaagtttgtgttttttgttgttgtttgtttgttttgtgtgtttttgtttttgagacggagtctcactctgttgcccaggctggagtacagtggcacgatctcggctcactgcaaactctgcatactgggttcaagtgattctcctgccttatcctcctgagtagctgggattacaggcatgtgccaccatgcctggctaatttttgtatttttagtagagacagggtttcgctatattggccaggctggtcttgaactcctgacctcaggtgatctgcctgcctcagcttctcaaagtgctgggattacaggtgtgagccaacacgcccagcctctgatgaaagtttatcatcattccaggattggtttcataggcatgtgacctatgttgttgcataggtacccgtacttagaaagatcctgtgtttcattaaatgttctactattgctatcttgatacgcttaatggcttttgaacaagggccctgtattttcattttgcactgattctgtggtttcttctattttatatatattatacatgaaacaaaccagaaaatcttctctgcctattgggtaagaattgtcttgtatctaggctgcctgtgctagataataaggatcatcaagatttaagtagatttttttttaaacattcgaccaacttccaaaaacagt

SEQ ID NO: 1958 - DNA, 1867 bp, Homo sapiens
tcctctctccttcctaactctattagttcccagcatctattgttgctatctttatgtccatgagtacccaatatttacttcctacttacaagtgagaacatgggtttttggttttctattcttgcattaatttgcttaggataatagcctctggtcgcatccattctcctgcaaaagatatgatttaattttttatggctgtgtagtatcgcatgttgtctgtgtaccacatttctttgtccagtctgctagcataaaacataatattaaaaatcaattttaaaaagccccccatttatctgggaaatgtaagatccacgtaccttaggttttcgtagactaagccttggtaatttttatgttactttattgctaatcacaggattttcctaaaaaacatggtcaggttcagacaatgatatttcttttcttttctttctttttttctttttgagaaggagtctctcactgtcaccaggctggagtgcaatggcatgatctcagctgactgcaacctctgcctcctgggttcaggcaattctcctgcctcagcctcctgagtagctgggactacaagcgtgcgcctccatgcccagctaatttttgtattttcagtagggacagggtttcaccatgttggccaggatggtcttgatctcttgacctcgtgatccacctgcctcggcctctgaaagtgctagtattacaggcgtgagccactgtgcctggctgatatttcttttctttaatgtactttaaaaaaggaatggtgagggagttggcaattcaatagaaaagagaaagtgttattattaatttccaaaactcagcatgttacctgtggttgcagtttctgaaggaaaaacgattagatagaaatcttactgatggtaaaataatatgcttatcttactatcagtgagctttgaatgaatagccactgtatgctttacatgctttaagttttagttttcataaccaacttttaaaggtaagtattattatctccattttaaagatagaagctgagatacatggagagaaagatatacccaaggcctcatagttaatgagtggtgcagccatcatgccaacccaaatctgtctgactataaagcctacattctttcctctaagtcatagtatctccttgtcttcaaacttaataaatgtttattaaaggtaataacatacctagaggaaaatatgagaagaaaggtcatactgtgtatggttttattttattgctctgcatactgttttgacctattaattttgttttaaacacatattttgtgtttgagactttctcccactaagaaggtggtaaatatacacgtaaattagtatttttgtctccatttttctttatgatcgagaaacatagtggaacctctcaaagtttttgcttacttggcccattgtcttagatctcagctagctagggcagtctcaaagtgttgtataactggcatttgatatgtcttttctcagtgtctcacttgcagctgggctgttgtgtcttgagtacaaacactgagccatgagtcagatatactgattgagtgtgaaagtatgtgcaggctggatatacttactccatccaccagtatctgttcttttagacattttagtagctctcattctttatggcacattgctacaaaggattctggtatgtttctttttaaatatcattatactatataatttcctggcaatgccttaaaattcactcaaataatttagggctctcatttcgtggctttacacagaactcgaacacttgattacatgcaaatgccatctcagccttttcagtctcttcagctataacttacacaggtcttaaatgatacattttaat

SEQ ID NO: 1959 - DNA, 1059 bp, Homo sapiens
ttgggaggctgaagcaggagaattgcttgaacctgggaggtgaaggttgcagtgagccgagatcatgctattgcactcctgcctggtcaacaagatcgaaactctgtctcaaaacaaacaaacaaacaaacaaataaaaaacgaacaaaaaaatgaagtagctagtacagtcagttgctaaaaagaaaaaactactttgagctgctgaagctttttttttttttttaaagttggtggaaagaaagagggaggcttagtgggtcaaaggcactgcttctgaaactcttcatctcatgttttcatctccctttagaagcatgtgcaattatcaattatttatagtatttgtagattcaaatagctaccagtgattatttttggaaacaaactaaagggatttagtatgtgaaattttctgaatgatattttttgccattttcctaattttataaatattatgattcaaaactgcttcaaatatgtgtaatggctatactttttcaatggtttggtagtaaagcttagcatttaacttttctttacaaggaatgtgggacctatctacattcacgaatatttatcaaatataattttattttaaatatttatttttcttgtactagagaatatctgattttgtttgattttaatactattatctctgaaagtcaaaatatttccctataaaataggactttctagccttttgtataaaatttaaatattgccttttcatccttaaacatagtattcacttgaaaatcgttattctaatgtatcttacaaacgtctcatttctggtaatgagaaatacactttctgttctatattcacctaaacctccaaagattttggcagtaacatggttttctctgaaaggaagttcaacatggaggaaagaataggaccttctactctttaggaataatttttttccaacttttattttagaatcagggagtagaaatcatttttacaattaataatacataatagttatatatggggtacatgtgatattttgatacatgcatacaatgtgtaatgatcaaatcaggg

SEQ ID NO: 1960 - DNA, 1125 bp, Homo sapiens
caaagcaattttaaagagccacaatttatatttacacaaaattaagccattttaaaaatcttgatgattcagttaatcagaggtatttgatacattatttaataatatttgctttggcagtactattgttttaaactattaataatccattgggaagttttggttttcttcaagtttagtaaatcagtaagaaaatgaataaatgatcttgatgtttttcttgaaaatacagttcacggagtctgttagaataaaaggaaacacttacacagttgtccctcattatctgtgtgggattggttccgggatgccccaaggataccaaaatccacagatgcttaagtcccttttatataatcacatacaataacctacacacacccttccatatactttaaattatctctgagttacttacaatatctaatacaatgtaaatgcaatataattagttgtattgtttagggaatagtgacaagaaatgtacaaatacatttcaagtacatgtacaagtctgtatgtgttgaacacagatgcgaccatccatttttttcccctgaatattttcaagcagtggttggttgaatcgatggatgtgaaccctatgaatatggaggactgactgtatatgcttttatgctttcagtactgtttaaagtcactgagatagtagagccatcattagaacccatatagtcagagtgaataccttaataatgtttattgtatgttttcccaaacaaatgaatagaaaaattttatgtaaaattgtgtattaaaagattgtaaatggtcaggtttccattagtttgattttgagagaaagatttcagagaatcattaggtccttctgcctttttcagaccagtcaacggactgaagggtcttaagaaaagacctcagggatttcttatagagataatttgagtgacaaggtatattgtttccacgtttttatatacccaccagcttgcccttccataattggcaccttttaatttctgacaatgttgtaaaaggatgagttatagcaaatcattattaacttatctcaaatgtttctaattctcatccctttcacataattaacttcctttttttcctcctcattcatttagttatttt

SEQ ID NO: 1961 - DNA, 1035 bp, Homo sapiens
ctccaggagcatatactatgctgccttcaatgagccttcttattctggggttttcataaaaattgaaacctgaacaatttcaaaggaaaatcattattaccatttcttattccttacactgctcatctctttttttgttgttgttttgttaatgtcattagtaccactgccttcttatatttccactttatagccctgtctgtttaataaatgttaattgaaaaaaagactacctggattttttttcttctaccttaatcactctttcatttagaatccagtttatacacttcattcttcactgtcttttaagattctttctctgggtaaccagatcacttttttttttgcttcttccatagaaagattaccttctttttttgaatctttatgtatagttttattatattctctatgtgctttgaatgataggaactttaggttaactgataacttatggatacagcctcctaccatggctaaaattcctttcataactagcaaggtagtctcttcaattattataaagttctgtgacttagaaaatacttcctaattaatgagccccaaaatcttcctattgatcctattgacataggatcaaatgtccaccatttgatcccatgtcatatctctgtggaaacacagaaataagtctccctttatgatgtagcttttctggcacatgaaaactactgttatatctgccttctcttctcagattaaacatctttatttctttaacacattgctaattcattcattcagcgaatatttattgagcattttttttgaggcggagtctcgctctgtcacccaggctggagtgcaatggtgtgatctcagctcactgtgacctccgcctcccgggtttgagcaattctcctgcctcagcctccagagtagctgggactactggtgtgtgccaccatgcccggctaatttttgtacttttagtaggctctgggtttcaccacattggccaggctggtttcgaactgctgacctcaggcgatccacccacttcggcctccc

SEQ ID NO: 1962 - DNA, 1102 bp, Homo sapiens
acatatgtacattctatgtaaatttgtttgtatcagagaagtggtaatgctaccttttgtatacaaaggtgatgatactgaattaaatttccagaagtaatgatgagtttttattcatgcatccatgttgtaatctctggccttccttgaattcaggggcattctaaaatgcagtgttttggcctggcatagtggctcaggcctgtaatcctagcactttggaaagctgagacaggtggatcacctgaggtcaggagttcgagaccagcctggccaacatggtgaaaccccgtctctactaaaagtacaaaaattagctggatgtagtggtggatgcctgtagtcccagctacttgggaggctgaggcaggagaatagcttgaacctgggagatggaggttacagtgagccaagatggcggcattgcactccagcctgggtggacagagcaagactttgtctgactggaaaaaaaaaatcaaaataaaaactaaaatacagtgtttagttagagaacagaccataccaattaatttttacataaattaaatccatgacttgcctggcattttgccctagccaaattaactagcctcagaagttggattttgcctctgtgtttgtttcattttctcagtcaagaattaagagtactgacattacatattaagcttttttgtatcccctggggtaactaactagcatggtggcttatacatagcaggtatttaggaaaaaaaaacacactttgatttactgatattgattatgtttcaatacaagggcagttcagctactttgcatggacttctttgggaaggatttactatgatttctatttctatattcgtgtatgtttttgtgtttgagttcagtcatacttattacttacccatcttcttattgaacctcccttttgatcgaatgtgattattgcattggtggtatattagttgttttgaagaattaatatttctttctaattcaagcctatgatgtgactcaggctggtgatacaatgatggtattaagacaatgttcatccccttcaacagggaaagtaaaactgttcaacttgcttttgaatacccagtatacctgt

SEQ ID NO: 1963 - DNA, 1051 bp, Homo sapiens
tacttaggattggggaggaaaaagactctactaatttttaaagtagacctaaacaatttgcactgcctgtgtctttgacctgattttttactctcacctttctttatctgtccagttacctttgtatactaccaaagctttaaccttctgtcctctcaaacttttttaaattttactttatttaactaccaatttatcaaaacagtcatttacacttgacgccagcccactccgaaacagctgctgtctagcttctgctaccagcacttgactatgcttatttgaagatcatcagtgatacactaattaaaactccagtgacttatctggctttgtgttccttcatctatgccacagttgaatcattgaccactttttgcttgaagttctcagctcatgctgctttctgttgagtgcttctcatgctacctcagtggtacttgttaaatgttttccttttctactttccctccatttagtcgcacaaagcccccaccctctatactcgtctctgcctatttaacagatcctacctatgctctaaggcctggttcataggccatcttccctttaaatctttgagctaaaatgttttctcagttctgtagtttttaatctaatttttacttggagcacttttaggatgactgttgccttgatagtatgattttgtacacatttcttaactactctagcagatgttaaaaaaataaaaaaaggagagaaatcatcactgtagcttctgcaatgctgtgcattattagaaatctttaaatatttttcttaatatactgtggtagggagaataatggcaccccaaagatccccatgtcttattctttgagttagtgggtgcagcgcaccagcatggcacatgtatacatatgtaactaacctgcacaatgtgcacatgtaccctaaaacttaaagtataataaaaaataaaaaaaaaaagaaaaaaaaagaaaaaaaaaagaaaccactgaatatgttaggttacagggcaaagtcaaattaagttggaattaaacctgttaatcagttgatctta

SEQ ID NO: 1964 - DNA, 1057 bp, Homo sapiens
catagtgacttcacgtttcatccatgttgttgcaaatgacagtatctcattattttttatggctgaatagtacttcattgtggatatgtaccacattttatttattcattcatctgtcgatggacacttaagttgctttcaaatcttggctattttactcctgtaatcccagcactttgggaggctgaggtggtcagaagtttgagaacagcctggccaacatggtgaaacctcgtctctactaaaaatacaaaaattagccaggcattgtggcaggtgcctgtaatcccagctagtcaggagactgaggcaggagaatcactggaattcataaggtggaggttctactgagccatgattgcaccactgcacaccagcctgagtgacaactccatctcaaaaaaaaaaaaaatcttggttattgtaaataatgctgcaataaacatttgagtgcagatatctctttgatattctgatgtcctttcttttgtttatatactcaatagtggaattgctggatcatatggtagctctatttttagttttttgaggagcctccaaactgttctccatagtggttgtactaatttatatttccaccagcagtgtaggaaggttcccttttctccacatcctcgccagcatctgttattgcctgtcatggataaaagccattttaactggggtgaaaagatatctcgtagttttgatttgcatttctctgatgatcagtgatattgattacctttacatatacctgtgtgtcattcgtatgtcatctttggagaaatgtttattcagatgttttcccattttttaataagattgttagatttttcttctatagagttgtttgagaaccttatagattctggttattaatcccttgtcagatgggtcgtttgcagatattttctcccattctgtgggttgttgcttgactttgtacattgtttcctttgctatgcagaagatttttaccttgatgtgatcccatttgtccatgtttgctttggttgcctgtgcttgtgtggtattactcaagaaatttttgccc

SEQ ID NO: 1965 - DNA, 1034 bp, Homo sapiens
ttattcagggccaaagggttctttagtccacaggtgatgggatctgccatgactgggtacttcctttcaagtcaatgcgttcccttctggctgagggagtttctcaaaatactttctgggagctaaggcctgaaatgggggtctcacaacattgtctggtaccctatcctactgtggctgagctggtatccaagatgcaagttaaaatcctctttactcttccctttcctctcctcaagcagaagcaaggggtcccttttggagccacaaggggtctcttttgcagcctggagctggaggagggtggtgcaagcactgtattaaccattgtgtctggtgtctcagtaagttacatgtccccccagtccactggctctgacaccagcccagcacaaggactcacctacgacttagagtccttatggcctagattgcctttcaagtttatttaggtgcccagagcactccatcctgcagtggcaaggcttgctggaactcagattttgactgctcagatgggtgattcccatctggctagagccagtccatatgctccttccatgagtggctgtcagctaagtacagcctggttctgcttttgctatgacaggacagcactgaattaagtgcagcgtgtcacaatcactgcattctttctccccagatgcacagattcttcttgccatgcagccactgctgggggatgagggaatgattgtgttggcagttcaagactttttcctgccctattcaatgcctctttctgtaatattcagttaaaaccaggtagtgtgaatgcttacctgatttttggttcttagaaggtgcttttttggtgtagttaataaatttggtattcctcttgggaagacaatcagtgtagctttctattccgccatcttgctccaccctctatgtcgaattactttttttttttttttttttttgagacaaaatttcactcttattgctcagactggagtacagtggcataaccttggctcactgcaacctccgcctcccaggttcaagtg

SEQ ID NO: 1966 - DNA, 1018 bp, Homo sapiens
tcatagaaacaaagtaaaatgctaactaccagaggctggaggctggaggattgggaagatgttggtcaagggacacaaaaatttcacttttataggaggaataagttcaagagatctattgtatatcatggtaattatacttaatgataatatattgtatacttgaacattgctaagtgtatatttgatatttacatattgtctatagccactctggtgctaccatggcagagataaatagtcagaaagaggttatacggcccacaaagcctaagatatttactgtctggccctttacagaaaacaaccttgtgatacacaataattaaaacaaatttaaaaaatcaggaaatggcagtacgtcatttagaaatatatatgtaaatacaaaaatcagttgtgtttctgtgcagtaacaaggaactgtttgacaagaaatgaagaaaacgattccatttacaatagctacaaaaaataggaataaatttaagcaaggaagtgaaagatctctatacaacaaaaaaatgataagtatattaggtaatgcgtgtgttaaatagcttgatttatccaccttacagtgtatgcatatatcaaaacatcatgttgtctacgcattgggtaaagtgtacactgcttgggttatgggtgcaccaaaatctctgaaatcactgctaaagaacttaattcatataaccaaaaaccacctgttccccaaaaactattgaaataatagtaataaaaaaaactcacacctgtaatcctagcactttgaaaggccaatgtggttggattgcttgagctcagaagttcgagtccaccctgggcaacatggcgaaacctcatctctacaaaaaaaatacaaaaattagctggatgtggaggcgcgtgcctgtggtcccagctacttggggggctgaggcgggaggatcccttgagcctgggaggcggaaacttaccttatacaccataattttaatttttacttgtcaatttaaaaagaatttaaggaacaatg

SEQ ID NO: 1967 - DNA, 1097 bp, Homo sapiens
ccaggttcaagcaattctcctgcctcagcctcccaagtagctgggattacaggcatgcaccaccacacccagctgattttgtatttttagtagagacggggtttctccatgttgaggctggtcacgaactcctgacctcaggtgatccacccacctcggcctcccaaagtgctgggattacaagcataagccactgtgcccggctgtgtccttttcaatagcatgtaattttcttacatattgtgaagtgttttagatgattttttccaatcctttatttatttaatattttgcttgataaagtataattgtacatattcatgggggtacataatgatagtttgatccacataatgtatagtgatcagggtaattaacatatccattgtctcaaactagatgatttttaatgaataataaactgatcttatttctaactagttaggaaaaacaaagaattcttcattatatttatgcacaacacaagggtacttatgagaagataacacttaccatctgggacacaacatttctaccctagtattctattcatggtgatagctaataactgacactattctcagggacagtagcagtggtagtattgccactattatagcccctactctagtcactgccttccagcaaacatgttcttgttatatattttccaattaacacttacataatgtctgaaatgtatggtggtaggtgttttagcctgttttacttcaaaataggaacgtaaggaagataaacatatacataagaagtgagtgtttaagcccatactaaaatttacatgttatactttagcacaacaccttcttcgaagtaaaggggacaactgaaatgtatcatcttgccatgtataaaaaggcatgtttcaaagcataatgaccacactgtaagccttcactctttctctaatcttctttaaatttgcacatgggtaacaggtcagacattcagaatagtgtagccaggtaaatcagaattttcattatctggatttgtatgcctcactgggtgcactgggggaggcctctatgacaagcatgttaaatgtgtacttttctggagcccaaaatgctgaa

SEQ ID NO: 1968 - DNA, 1090 bp, Homo sapiens
attcttgtttcattttgtagaggaaaggctttcaacttttttcggttcagtatatgttagctatgggtttgtcatttatggtctttattattttgaggtatattccttctatgcctagtttgttgacagtttttatcatgaagggacattgaattttgtcacacttttttctgcatcagttgaaatgatcgtatggtttttgtctatcattctgttgatgtgatgtatcacactgattgatttgcatatattaaatcatctttggatctctggtataaactccacttgatcatgatgtattatttgattttcgtttccctgatgattagtgatgttgaacattttttcatatacccattggtcatttgtatgtcttcttttgagaattgtctattcatgtcctttgcccatgttttaatgggattatttgtttttctattgtcgactgagtttcttgcatattctgggtattagtcctttgttggatgaatagtttgcaaatattgtctgttgtgctgttgaattacggtttgctagtattttgttgaggattttacatctgtgttcttcaaagatattgacctatagttttttgttgttgttgttgttattatgtccttgtctggttttggtatcatggtaatgctggattcatgatatgagttagggaaaatttgctcctcttcaatttcttggaatagtttgaggaggattggtattagttctttgtgtgttcggtagaactcagcagtgaatctctccagtcccggcttttctttgttgggagacattttaattattgcttcaagttctcgttactggtcttttcaggttttctgtttcttcctgattcaatcttggtaggttgtatgtttctaggaatttatccattttctcttaagttttccagtttgttagtgtatcgttatttataatagtctattatgatcttttgtagttttgtggtatcaattataaagtctcctttttcattttttaaaaatttgggtcatttcttttcctggttagtctagctctagtggtttatcaattttttcttttcaaagaaccaatttttcatttcattgat

SEQ ID NO: 1969 - DNA, 1050 bp, Homo sapiens
atgttatcaccaaggcttctggctagcagtaggctactagtagttgagtttttggggagtcaaaagttatacatggatttttgactgtgcatagggccagtgccccaactcctgcattgttcagaggtcaactctgtgtgtgtgtgtgtgtgtgtgtgtgtgtgtgtgtgtgtgtgtgtgtgtgtccctaaacaatatttagcaagttgactgtttttaaactttatatcaatggtgtatattaaatatgatcgtctacagtttgcttttacagctcaatagtttaaaaacaaaacaaaacaaaaagctgcagtaatccccctgccgttattcatgaggattacatttcacgacccccagtggatgtctaaaactagattagtactaaatcctgtatacattttcctatacatatgtacctatgatggtttaatttataatgtttgcacgggagattaaaaacaataactaataataaaatagaataactagagcaggccaggcaaggtgactcacgcctgtaatcccagctctttgggaggctgaggtgggcggatcactggaggttaggagttcgagactggcctggccaacatggtgaaaccccgtctctactaaatacaaaaattagccgggcatggtgtcatgtacctataatcgcatctactcgggaggctgaggcaggagaattgcttgaccctgggaagcagaggttgcagtgagccgagttcatgccactgcactccagcttggatgacagagcgaaactctgtctccaaaaaaaaaaaaaaaaaaaaaaaaaaaaataattagaatagtatgccagtatcactaatcttgtacattgtactttggagcaattattagggaaaataagggttacttgaacatagcactgtgatattgtaatagttgatctgatgacagttgaatggtaacccagaaggtgactaacaattagtgtatacagtgtggtttgattcattgaggttatgctcacatcatggtcaaaagatgaaagtggaatggtttatatctccttgttctcag

SEQ ID NO: 1970 - DNA, 1062 bp, Homo sapiens
ttctcccattctataggttgtctatttaatctgctgatagtttgttttgccgggcagaagctctttagtttaattagatcccatttgttgatttttgcttttcttgcaattgtttttggcatctttgtcatgaaatatttacctgtgcctacaccgcaaatggtattgcctaggttatcttccagggtttttgcagttttacgttttgcatttaagtctttaatccatcttgagttgatttttgtatgtggtataaggaaggcatccagtatcaatcttgtgcatatggctagccagttatcccagccaagatatttcactagtgaattttaccacacattttaggagaaattaacttcaagttcacaaaatctcttccagaaaagagaagaggagggaacacttcctgactgattttatgaagctaatgttattactctaaaacagacagattgtacagaaaaataaaactatagaccattatttctcacaaatgtacatgtaaacattttcagtaagaatcataatgcagaaatcctcaacaagaatcatagaattagggtcaggcgcagtggctgatgcctgtaattccaacacttaggaaggcagaggcaggcagatttcttgagcccaggagtttgaaaccagcctgggcaatatggcgaaatcccatctctgcaaaaattagctggacgtggtggcacacacctgtagtcccagctccttggcagggctgaggtgatagaatttgggccggggaggtcgaatctgcagtgagctgagatcatgccacttgcactgcagccagggtgacagagtgagaccttgtctcaaaaaaataaagaagcatagaattagaaggaattacaatcaatattcctcctcttcaagattaataaagattgcaactttaatggcaacctcaattctgtgctgttttagttactcctcctatagtctgaaaatgaattgatttaaggcaaattcagtaggtttttacagtttcatttgtcatcagtgtttttcaaatataagtacttttgcaaattggaccaaattctt

SEQ ID NO: 1971 - DNA, 1030 bp, Homo sapiens
agtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatggtcctttgggtatatacccagtaatgggatggctgggtcaaactgttgtggggtggggggaggggggagggatagcattgggagatatacttaatgttagatgacgagttagtgggtgcagtgcaccagcatggcacatgtatacatatgtaactaacctgcacattgtgcacatgtaccctaaaacttaaagtataataataataaataaaataaaataaaataaaataaaatataaaagtacaatatgagaagaaaaatcacgtcttccaattaaataatatacagttaatcaaagagagagcaagaatttgttcaactgtgtaccattataatcagacactataaagggattccaaaagtttgtgggaaaatgcaattaaaagaataaaataatgtgaacttttcttcccaacataagctccatcagggtcaagacactttccaaataaaaagtaatgagtacatagtaggtatatatatttatggggtacttgagatattttgatacaggcatgcaatgcatgacaataacatcaggggaaatgaggtattcaccatctcaagcatttatttctttgtgttataaacattccaattatactctttagatttatttatttatttattattttttgaaacagagtgtcactttgtcacccagactggagtgcagtggcacaatctcgactcactgcaacctccgcctcctgtgttcaagtgattcttctgcctcagcctcccgagtagttgggactacaggcgtg

SEQ ID NO: 1972 - DNA, 1029 bp, Homo sapiens
tttttttaaaatagtgttttctatattaaatataatataatatattatatttaattatattaattaaatataattttagattatattaattaaatataattaattaaaataattttacatttgcagagtactttgacatatattacctcatttatttttgacaattcctcatcaatggagcctacactggagatataatatgctgtgctcttaaattgagcagaaattaagagaatttcagtgacaataagtttagaaatcaactctgttttcaaggatacaacaatctgactttgtagttgaaaagttttctgtggctctggtgaaaggagaaatgatttgaactgtcacattagagggaagactgttaaaaactcattgtcatgttttaatggccctgtcaattccagttttgcctcttaatatctttcttcagagtaggaggaaatcgaaatgattcaaagcttcttctgttgtcattaatttgtatgggggaagttgagctgaaagtattagtagaattcataggtttctgcagatgaagaggtttgcaaattaatagatttctgcaaatgaaagtttctgaaaatttggttcttccctctttctctccctgtctttcctattggttaggtcaataacatattttaaaagaatgtccatgagacagggaagaatatactaccaccccaaatatattttgcatttttattatttaacatgagatgtaaaaatctgctataagttgggagacaggttggtatagtttaaagcactgggcatcaggaaatctggttctggttttgattctttcactaagtagatctaagaatgagggaaatttgtaagggtgtggtgtcataagattgttccggttccaatgttctgtgattctcagtgttgttcaaattttttttcctgacatataacacataaatgcagaatttagcagttaaatcctgcgtcagttattagctctggctctcaatactaaagatgtaaaagggtcttctccttaaatctgaagat

SEQ ID NO: 1973 - DNA, 1039 bp, Homo sapiens
ccttcagctacttatgcagaggactaataacatgaaggaacttttttgacattctggcaaaatgccacttatttatattgtatatgtatatatttttctgtagatgccagaggaacaagcattctgtgttttggtgaaaatcatgtacgactatggtttgagagacctctacagaaacaacttcgaagatcttcattgcaaattctaccagttggagagactaatgcaggtaaataaaaattaggaacttttatcactcagggatttgttgagtcatagaaaaagcctaatagagttggtaagcaataatgaattatagaagtttaatggaatattatagaaaatgtacatggatttagtttcagaccaatatctacattggtctatcataatatgtttatttagccattttactattttaaaaatatctcacattttaaatgttcaagttaaatatactttgaagtgagaatctaatgagtttaatcattaagagattgccaagtattgtttgtagaggaatggagatatttacagagtaaaaattgaaatacctaagagctttctgcatactaattagcaccacttccttatttgagtccacgtagaacacttggaaaagccagaaagatattcataagagaataaaacatactaaaatactgtagggatacatttaaaaatttttaaatataattcctaatctcaatgttgttgttgtgctttacaatgcgtatttataaatgtgtgtgagaaacatgcatccttttatatataccaaatattacacagtaaaaaagattgtgaccacaggcaaagtgattgaccagagctgacaaaaggaatttttaactagctttggagttctacctgaagttgataatcttaaatttataatgggtttttgtggcatgtttatgtgactttgtttaaaaggggttttgggaatccaagagaaatgtgaaggagatacatggatggattgattccatattggggaagggtaaaatggttgaggaaggaggttcgtggaatgtga

SEQ ID NO: 1974 - DNA, 1022 bp, Homo sapiens
tttaaaacagcatgtctcaatttgtatacaaggctactatgttggtctgtgaaatacgtaaaaaaaaaaaaaaaaaaaaaaaaaaagcgattgattttcagtgctgcaatcctgacctctagtggacattcagaacaaaacccaaacatcacattcttttatttagttactccatcaagcaccattagccaacctaaaatattaaactttcaaagagattaaaacatgagaagcagaataaagtaaaagaatttttggctaatattctaaatattcttgctgtagaacctgtatttaagagcagctagtattaacttatttctttttgcgtgttaattatctgtcactttcactactttctttgaaacaatgcattgctttatagatcatagcagcaagaaatttatcagagaagccaaatggattttcttttgattacctgtaatatataacaagctatacgaaaactgagtggctttaaaaggacaatgatttttatagtgagacatatagtgatgttatgtaacctcctgatagaatgcactgagaagggcacagcatcacttctgtggtatttgtgcccaaaatacatattctgaatttaatcataaggaaccagtagacatatcgagttgagggacattttataaaataactggccaatactcttccaaagcatcaaggtcatgaaaaataaacactgaaaacggtcccatatgaaaggagactaaggagacatgacaaccaaattcaatatataatccagaattgcatcctggaccagaaaaagggcattagtggagcatttgataaaaataatagtttcttggttttgatcattatactatggttatgtaagatgttaatgtttgggtaaaactgagtgaaggatatgtaggacttcttggtactgtttttgcaaagtttttctaaatccgaaattatttccaagtgaaaaaaagtaattaaaaccaatcatttattttcttacaatctcatgagtcagaaattttggaattcaa

SEQ ID NO: 1975 - DNA, 1050 bp, Homo sapiens
agagtgagaatccaaaaaagttaaaatgattaggagagaaaactcccaaaagaccctggagtacattggaggtgagtaggacaatagcagtcttttcctttgttgaggacaggggaggagtccctactcggttgcaaactccggatgagggctggggattgagggcttcccagaaagcatcacaagaaggtgtcacaccactctcgaaggcatctgaagcagtcctgggactgcttggcattggcaccaccagtgtccctcagccattctcagaagaggtcttcatctttctttagcaccagaaactggccaaggacaacataggccttgtcaaagcacccttcctccagcttcttgtccataacttcaccaatcccggccaggctccctactggcttttcccccacggactctgccacaaagtctcggtgcttttgggaggttgtaatcttgttcaggtttaattgtcagcttcagttcccataatggttcctcctgccacctggctgctcctgcctatacctcaagccactagaactttcccctgtaccacaatttatttaaccaattttatatttagtttttatggacatttgtttccagaatttcctgttaaataaaaccgtaacaaatatccttaaacttgcatctttgcatacttatctgatatctctggggtaaatttctagagatggaattgctaggtcaaactgtaaccaaattttaattttggatacatattacaaaattcttctctgctagcaatgtgagagtacattttcccatactcttcaaaaatttctaaacattaagcacctttatggaaatcaaaagcaagttataaatataaatataatatataaatatataaatttatttatacataaatataataaatataaatgtaaaacaaagcaatttaaaagtaatgatttagtaattttttattactaaatcatataaataaagctcttcagccagctttgaagactccagtattttcttttttggggagaatatccagtttctttagggaagcagtggatcatg

SEQ ID NO: 1976 - DNA, 1025 bp, Homo sapiens
ttcaggtaatatgaattcagtatgttagtttgttcattaactcttagattgcttctgtgatttatggtgatttatttcagcttatagtaacatcatctaaatattgaaatgttagaaatatcttcttaaaatgtttggaactaacttagatcttagctataaaagtatattcaagaaaatataaattctttttgaaatatatttgtcctcaaagcaggctgaaatgtaatgacgattcttgatgattattttgcagacctcaaaggaagaccttctgcaggctgattttgaaggtgctttaaagttctttagagttcagcttccaaagagatacagggcagaggaaaatgcaagaagactgatggagcaggcttgcaatattaaagtaagaacatgagtttttatataataaaggtaaaatatgagtgcagaataatatgacaaattatgtaaaaatttttttatatgttgcaaggtttgattatgtttaagattagattgtgtatgaactgatttctcccagatgtgtttgtcaggctaatgtgtgtatagtagctgtaccttctagtaggacttaaagttggcaggctcagattataacaataggaagataaacatttatctcataggtggggctctagagtgggctgctgtgatagtggtttccatggaagcagacttagtatttagcttttgccatctgttttaagattatttaggacaaagcaagaaaagcttgcttaggcaatgctttcatttctctaagtgacttggaaagtttgagtcttgatctgcccattcccatcccacacctgccaaatatctgtggatacattggtccatgtcacatgtctgataaagctaaacacattttataaatcaatttgaaattgaaaactctttccagaaagttgtagtattaaggtgagagagcactcttaaaatatttggaaccaatttactgatgttaattcttatacctctacaatataccagggtatctttttacctaaccataacgtaaa

SEQ ID NO: 1977 - DNA, 1069 bp, Homo sapiens
gcaagtcagcatcaggagtccatagcatccatcatcaagtgcaataagactgtgactctctgttactgagttgtgatgctttttctttttgccagtaagttacatggtccagttttttctttcttagatgacttcagggacttgttgtaagcctgctgaggtcaaggaatgcttctgccttatgtgcagtgtattataaaaagatttatctgtgataaaagtggaactcggctgggcatggtggctcacacctgtaatcccagcaatttgggaggctgaggcgggctgatcacttgaggccaggagttcgagaccagcctggccaacatagtgaaaccccatcgctactaaaaatacaaaaaaattagctgggcgtgttggcatgggcctgtaatcccagctactcaggaggctgaggcaagagaatcacttgaacccaggagacagaggctgcagtgagctgagatcatgccactgcactccagcctgggtgacagagcaagatttggtctcaaaaaaaaaaataaaaacaaaaaaaagtagaacccatgaagaaaaatttaaacaactgattttaatgactgtaaaggagtatcactagtagaaaaatgtttctatattgttaggataatcaagtttctttaaagataatattgatcatttttagcagaagtttgttatttatctttaggaaatgaaattaaatattttgctttgttttgtttttaatgtttctaaaaggaatgaaactgcattattgctgattctgttgtggattgaggcatttagagtagcaaaaattatattaatgctctgtgccaaaacacataaaatggctttatcactgattggtgtctcaattataaaaaggtaataatttgcataatatgataagaatgccacttgaaagaaaggaggctgggttgttttttttttttttaacatccagtaaaacatgattgacatcatctagtcaaattatatattatactgagctttattttctgtataaaccatattttacagatattattttaaaagaaattgaaatcttctgggcttaggtttc

SEQ ID NO: 1978 - DNA, 1028 bp, Homo sapiens
gtgttatgtctacaggttttcaaagatttatttacataattaaacactcatataacagtagcacacttaaaatgttaggctgatgctttcatatataatgaggttgagaggaattttagagtgccaaatatcactttgtcttaagtttctgccttgtaaatatgtatataattatcaggtaggggctagttatatttacatagcatacaattgaggctcatagaagtgtaacgtttctaccagtgagtaataacatcatctgagaattgagctacctaaacatcaggtaactttcagggtcttaaattattactaagaagaactattaggaaaataacagtacaattttagtttggctttaatatttgtaaaaaaaatttgccattctctcaggatcttagtgtgtgtgcatgtcctggcataatcaaaaacggaagttcttgcaagtgtttattgtttcttctcttagatgtcatcattataatggctattgagtttaagatatcaacgatctatacctctgaaaccaacttttttttgagatggagtttcgctcctattgcccaggttggagtgcaatggcatgttcttggctcaccgcagccgttgcctcctgggttcaagcaactctcctgtctcagcctccctagtagctgggattacaggcatgcgccaccatgcctggctaattttgtatttttagtagagatggggtttctccatgttggtcaggctggtctcaaactcctgacctcaggtgatccgcctgcctcacctcccaaagtgctgggattacaggcataagccaccacgcccggcccccaaaatcaactttttaactacaattgtagtaacttcttattatatttaatatgactcatcacaaacaacagaatgaaagagtatatcataacatttaaacctaactaatatgaagacctacttctctattttaaggcacaggaaccttaaaaacatggctatttcttgaaacaacaaattacaaaaaataaaaataaaaaaataaa

SEQ ID NO: 1979 - DNA, 1082 bp, Homo sapiens
ccattcctgttttcccagcagttttagtagttttttttagaagtatccttctataaatatttttatacatgcaaacaaatttatatgtgttctcttttttcagagctcttggtggcccttttatgttctgtactttgcttttctcacttaacagtatgtgttgatttttctatgtcagttcatgaagggtgtccttgttcatttgaaagctacatagtatttcactgtatagatttctataatatgtgtaaccaactccctcccactctgtgagtgtgtaggttgttttcaatattttgctcctacaatactgcagtgagtaatcttatataacatttcacaaaagtgtgtgagtatatctgtagattaaattcctaggagtggaactgctgggttgaaggatacattcatttgtaattttgatagataaggccaaattgttttccttaaaggttatattagttaatataactaccagcagtgtatatctgtgcctatttaaaggtggaaacttttgaacaggaatctaagaaaaaataggaatttatcagattgtcaggggacgggaaagatgttccaggcagaaggaatagcactttgagaggcacgggatagaaagatggcacaagaggatttttaacttattccatctggctaaaatgtagggggtaggccaggaaatagagagtgggagttgatcatgataggttgtgtatgtaatgctgagtaactgatattttaaattctataaatgaaggttttgagtagggaaatgatataataaggttgattaatgtattttattaaaagaatagctatttgtgtgtatttatttaaattgaagtttgccaaaaaggtgtagtccctaaagatttttcttgctttttttgtttgtttatttggagacagggtcttactctgttgcccaggctcgtgtgcagtggtgatcagatcatagctcactgcagccttgaaattccaggtttgatcctcccacctcaccctcccaagtagctggtactacaggcacatgccaccatgcctggctaatttttaaaacattttttgtagagatagggtct

SEQ ID NO: 1980 - DNA, 1074 bp, Homo sapiens
ctcagagttttggatatgctccatatccaaatgaaacagatgactgtgttctgttctgtagattttactacttttctctgccagtagcctctcacatttgtcacgcaataggaaccaagcaagagaatctggacagatcagctcacatctattgccctgttaaagtaactcaaagatatgcccaaagaattggatacttgtttcatcattggataagctggaactgtctataagtggctaggatgtatcatgccttatcacaagaaatagcagaaaaaaaatatatagtctttgatttcattaaattcctttgtttgtttgtttgtttgtttatttttggacacagggtctctctctgtcacccaggctggagtgcagtggtggtgctaacatatctcactgcagccttgaactcttggctgaagcaatcctcctgcctcagccttctgagtagctgggactaccagtgcatgccaccatgcccagctaactttttcatttttttgtagaaatggggcctcactttgttgctcaggctgttcttgaactcctggcctcatgtgatcctctcaccttggcctcctaaagtgctgggattgcaggccagatgagccactgcacccagccaatttcacaaagtttcagtattctcagaaaagaacatactcatatctagaaatgtcttatgacttaaaaagcaaagtataaccatgtgcatattaatagggcacaaagtgaatctggtagagtgccagctgtgtctaatctgataagtttatttcatatggaaaatgtgtgtcaatcttagatgaggctaatttgttgaaaataactgaattctggtctcttttagattgtcagaaagggattcatttaacagtaaaatttaatccagatatatgtagtcatatgtttttaaactttttaaaccctgaaaattattgaaatatgtgccattttaatagtatcagcttctgattgcttttattccatcatcatgtgatatactcctcattaagcagcaccagtaaccagagtttaattattgtgtagcactgtgtgaaagcttttgtc

SEQ ID NO: 1981 - DNA, 1048 bp, Homo sapiens
tgtttctttttaattttcgagggtacatagtaggtgtatatatttatggggtacatgagatgtttgatataggcatgcaatgtgaaaaacgtcatggaggatggggcatgtttctattctataggactaagtgagcaatagtcagggatatgtatgtatatattcttgataaacagaagatgcttttttgtgaagttttttattttctacaaatgtgatggtattttgtgaagtatttatatatatgtcttttatgttgacagagttcttctaggtcagagacgtgctggtagtttgataatacatactgaaatggcatttaacagataccagtaggtttgtcagatttggatgaagaattggagtcttttacattctactttgccctggaaaggaattaagagagctaggattccatttgtttgactacttacagaagtagaaatggttatggaattagtattgatacttagccatccagcttagtggagaactaccaatatttagatgtcggacaaaattgtttccataaaagctgtaaatgaactaatcttaaagaatgtatttagtgatcatatttttattctgagggataaaaagagcataggttttgtattcagaaacctggatttgaatctgaattctaccacttgttagatgcctagctttgggtagagtacttaactgctttgaggctccatttctcaacctagaaaatttcttatatttcaaattttttcatgtttatatgactggattttcataattttactttcctgacttatgagccatgtgcatttgctgttctaaagatagtttcagaggcttacttacgtcccatcttttgttgtcgttgccaggatgggatcagtcagataagtttgtgaaaatctacattaccttaactggagttcatcaagttcccactgagaatgtgcaggtgcatttcacagagaggtgagttctcattataatgggaaagacagtgaattaacagtcaacattgccttatcttgagactctcttctttgcagtttttaaaattctt

SEQ ID NO: 1982 - DNA, 1026 bp, Homo sapiens
aaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttcacttgaaaaagaagtataaaaacaactgtattgagttgaggctgtggagaaataaggacacatatatgggaatggaatgcaaaagttaaactttggttaacaagaatatttgggcaggtgcagtggctcacacctgtaatcccaacaccttgggaggccaaggtgggcggatcacttgaggtcaggagttcaagaccatctggccaacatggtgaaaccctgtctctactgaaaataaaaaaaactagctgggcatggtggcagatgcctgtaactccagctactcgggagactgaaggacaagaatcacttgaacctgggaagccgagggacgagaatcactggaacccgggaggcagaggttgcagtgagctgagattgtgccactgcactccagcctgggtgacagagtaagactcttgtctcagaaagagtatttggtaataaccatcagaatgacatattcatttatcctttgacccagaattttaacttctttctgggctctgaaaggtacatttagaaaaatttggaatgctatatgcaaaagattaaaaatactcgtgtctatttaacaggaatgtattatggtgcatccacatgagggagtacttaagtcacaaaacaatgaagagttctatataacgtaaaatggtctccaggatagagtaagtggaaaagcaaagtgcagaacatttatggtatacccactacatttgtgtaagaaagggtgagaaatgtgaatgtatgcacataggtgtatttgcttatgtttcaaaaagaaacgagtaaacccaaagctaataaaaa

SEQ ID NO: 1983 - DNA, 1068 bp, Homo sapiens
catgcagtccggaagttggaagctgagcattggccttctaaaatttcccagaaataaagccagtcagctgaatctaccttataccacaatcaaagccccaaaatcatcaaataggttaaaaggaaaaaatatcccaaagtcagcaacctcaaagattgaaggtagataggcccacaaagatgagaaagaatgagtgcaagaaccctgaaaactcaaaaagccagagtgccttttttcttccaaacaactgtatcacttctccagcaagggttctgaactgggctgagatggctgaaatgacaaaaacagtattcagaatacggataggaacaaagatcactgagttacaggagtacattgaaacccaatccaagtgatatggtttggatatgtgtccccacccaaatctcatgtcaaattgtaatccccaatgttgtaggatgggcctgctgggaggtgattggatcatgggggtggatttgccccatgctgttctcatgatagtgagttctcatgagatctggttgtttaacagtgtgtagcacctcccccttctctctttttcctgctccagccgtgtaagatatgcctgcttccccttcaccttctgctatgattgggagtttcctgaggcctccccagccatgcttcctgtacagtctgtggaaccatgagccaattaaacctcttttccttataaattacccagtctcagatatgtcttttttttttttttcctcccgcagcattactgctgacttattacaaatccctaagagggctttatttttttcttttcaacatcctgttctacagcttccttggctctttttgcttttatgccaaagagctgggcaatggcacaggccatgaggagatgcgcgaaggctttgaaattcttctcctcctcagtgatgactagggctttctcctttttatagaccttctggatgggcatgactggtcctgtcagctggatggccaatatcagttcttcaacagaactgtctcccttcttaggggccaagggcttcctggggaagaggatgagcttggaattgtactcct

SEQ ID NO: 1984 - DNA, 1047 bp, Homo sapiens
tttacccagtagtcactcaggagcaggttgttcagtttccatgtagttgtgtggttttgagtgtgtttcttttttctttctttctttctttctttttttttttttgacggagtctccctctgtctcccaggctggagttcagaggcgcgatcttggctcactgcaagctccaagctgcgcctcccgggttcacgctattctcctgcctcggcctcccgagtagctgggactacaggtgccctccaccatgcctggctaatttcttgtatttttagcagagatggggtttcaccgtgtttgccaggagggtctggatctcctgacctcatgatccatccgcctcagcctcccaaagtgcgagtgtgtttcttaatcctgagttctaatttgattgcactgtggtctgagagactgttacgattttcgttcttttgcatttgctgaggagtgttttacttccagttatgtggtcaattttagaataagtgtgatgagttgctgagaataatgtatattcttttgatttggggtggagagttctgtagatatcccttaggtccacttggtccagagctgagttcaagttctgaatattcttgttaattttctgtcttgttgatctgtctactattgacagtgggttgctaaagtgtcccactattgttgtgtgggagtataagtctctttgtaggtctctaagaacttgctttatgaatctgggtgctcctgtattggatgcatatgtatttaggatagttagctcttcttgttgcattgatccctttactattatgtaatgcccttttttgtctcttttgatctttgttggtttaaagtctgttttatcagagactaggattgcaacccctgcttttttttttgttttccatttgcttggtaactatttctccattcctttatttcgagcctatgtgtgtctttgcacatgagatgggtctcctgaatatagcacaccgatggggcttgactctattccagttttccagtctgtgtcttttaattggggcatttagcccatttacattt

SEQ ID NO: 1985 - DNA, 1038 bp, Homo sapiens
ccaagaaaccacatggtgagacccattagcaggaaaccaagtctcctagcagcaccccacattaactgtcagccacagtgaatgaggccattttgatcttccagttatcccactgccctacctacaccacatgaagcagaagaaatgctcagtcaacccaagaatcatgagaaataagaagttgtgttttaaaccactcagttttgaggtagcttgttatataataacagataatcaaaacctctggaattcccatattttggagggaatagtttaactgacgtgcagctttggcaagggaatggcaggacagccaccagcttattacacctgtggtaagaggcaggcaccctcacaaggcaacaagggaaggggggaaagtgatgaccaccaagtggtggcagatagtccttatactagaatgcatgaggaatgccttcgagaaacttctagaaagatttggggggactttgatgagactgaaggtgagatttagagtgcacaataatgagaaggcatgaacgagagaaccccagcctgtgctggttttcatgttagtattgtaatcctgatattatctagggcctccctctccttgatatctgataagtcttgcacatcctgtggaagactccccaacattactatgaatttctaggggaactatttccctcttgttagacctagatccaaactctggcttcctccatctgtggaaagtctcactgtttcttttatgctgtttctgtttcacttaaaatcaacctgaacacagcatttaaacattccttttatttttacaatttctactcataaaagcaatctttgtgactaacagactaataagaaatttgagggtataagaagaacattcaaacttgtagcaatatggacttcaaattgaaattgagactatcctcattcttcaaatgcctttggttgccatgctgggggagatttttccaagtgacaactctgtaagtactgcctgagcctcattctatgtcatggttcctctctctcccttccatctttcag

SEQ ID NO: 1986 - DNA, 1770 bp, Homo sapiens
caaggcctttctgttgcatgttcctattttgaaatggctgctttttgtccaagtggttgctgattactctgtatcaacgtatggaccttgaataagatggtcagtacagtagctaccaagtaacgaaagatatgttgtaatgtctaaaacaatgactttgcttttaatgttgtctagttttataaagacttcatggttttcctttttatagaaaataaaatttatattcctgtttttgaatctagcttgataacatgattaagaaaaaatggtatcatatggtgatttctattgaaatagaaagataccccagatacagtcgatttcttcctgttttgttcaggtcagaaagtcttcagtcattcttttgcaagttcaaccaaaataagcttaagagaacattttcagttatttgcattttaggttgtagttttggtctatactgagattgtcatgccagagtgtcaccttgagagaggcttgactttgtaatatctattagctgatcatctttcttttcctgtagcttaactagcataataaatttcctcatatatatccagtaatattattctgtttacctgtgagcatattgtatgaaattatatgtttttacagagttgctttttccctacaatcttgaaaaaccttgcatttttttctgtcaacaaacttattaaacatgataagtcatttctccattttatcagggaaataattgtgaaaaagttagtgactcctaacgattcttggtgatgtgagatgattactatttgactcccaatccagtagtttcttttgaaatattaccctctattattgaagttcacatttactgttttaacatatttgtgttaaaatgtattacaagcatttttgtgcttttctaagttgtcttagaatttaacagtatgtcttatcctatcttctctgcctctttgagacccatgtggatagtaacagatattgagttctttggtgaactgcaggaataaaagtgaggatgctagatagagtaaccaataaattattttgtgttttttttattatggtaaatatagcaaattttcattttaagtttgctatatttaataagtatacaatttaatgatattaaatacattcataatgttgtgtaaccatcaccactacctataccccaaatgttttcatcatcttcaaacttcccattaaacaatgactctccctttcccctcctcttagcagctggtaacctctattctttctgtctccctgaatttgcctattctaggtacctcatataggtgaaatcatacatttgtcctcctgtgtctgacttattcactaagcataatggcttcaaggtccattcttgtaacatgtataaaaatttcattttttatggctaaataaatattccattgtatgtataaactatattttttatccattcatttgttgatggacatttgggttgtttccacattttgtctgttttgaataatgctgctatgagctttggtatacaaatatctgtttgagtctctgctttccattcttatatacctaggggtggaaatgctgggtgtatggttgttctatgtttagccttttgagaaactgccagactgttttggtacagcagctgtatgtacccttttacatccttaccagcaatgcacgagggttccagttactccacttccttaccaacatttattattcatttttggtttaaccatcctagtaggtgtgaagtgatatcccattgtggtttttatttgtatt

SEQ ID NO: 1987 - DNA, 1107 bp, Homo sapiens
tttgtctaaaaagtttctttgcatccctttgtaattcccccctttccccagcctaacactagacagctactaatctgctttctatctgtatagattagtttggattttcaagaattttatggacattaatccctcattatttaccaggggattggttccagggtcccaacagataccaaaatcctcagatgctgaagttccatatataaaatggcattctatttgcatatagtttaggcttatccttccatatactttaaaccattcctagattacataaaatagctaatacaatgtaaattctatgtgaatagtttttatactatatttatacagtgtatatatagtatatatagcatatatagtgtatatatatgctatatatactatatatacagtgtatatatagtatatatagcatatgtagtatatatatgctatatatactgtatatatacactatatacactatatatagtgtatacatatatatatatatatgtatgtatactgcaaactccaccttccaggttcaaggtattctcatgcctcagcctcctgagtagctgggattaaggcacacactactatgcctggctaattttttgtatttttagtagagatggggtttcaccatgtttcccaggctgatctcgaactcctgagctcaggcaatccgtctgcctcagcctcccaaatttgggatttgctgggattacaggattgagccactgcacccggccatactgtattgttttttaaaatttgtattctacattttttatagttgtgtttttttctttttacggaatatttttgatttgcagttggttcaatccatggatgtggaatttatggaaggtcaactgtaagtggaattgtatgatatatactaattttttgtttggcttctttcagcatattttgagattcatccatgttgttgcatgtatcaatagttaattcctttgtattgctgatagtatcccatcgatattctacaattgtttgccagctcgccttttgatgaacatttgagttgtttttagtttttgactatgacagataaagttgttgtgaacatttgtgtactagtctttgcgcaca

SEQ ID NO: 1988 - DNA, 1018 bp, Homo sapiens
ccttgatctcctgacctcgtgatccgcctgcctccgcctcccaaagtgctgggattacccaccacacctggcctagattgctaatttttgtaatttttgatttatcagtctgaaagtgaagagccaaacatagacttaaataatgcctaacacttttatagggctcaataactacttaaaacattcatacataatatatctcattctgttttcataacagacctgttagatgggtaagaaaggtattgttcttaatttacagatttatgccatatattgaagaacacttattaagacattggaatgaggctattttgtgtttacaaaaatcaaaatattcccttatactttctctactagagttaactggaagcatttgagtaataaagtaattgatactgttgtaaatagtaatttttatgatttaacctgagtagcttttggggctagcatctcaatcaggtgcagtttctgagatgaactcaactctaaccattctgtttaagcattttatgatgttttaatattttagtttaaaacagactttaaatttgtctttgaagtaactagtaaagatgcattttgaaatagatttatttatgtttaaaatgtactttgaaggaaatagtgtgatcttataaataaagcacaattaggatgtggaatatgctatggtctgaatgctgatgtcctccccaattcatatgttgaaagttaatcaccaatgtgatagtgttaagaggtggggcctttaggaggtgattcagtcacaagggtgacttaatccttgtgaatgggattagtgcccttataaaaggggtgcaagggagctagctgtatggacttttctgccatgtgagaatgcagcaagaggcactgtccatgaagcagaaagtgaaccttcaccagacactgaatctaatggggccttgatcttagacttccaggcctccagaaatgtgagaaataaatttctattatttgtaaattatgcagtctaagatattttgttatagca

SEQ ID NO: 1989 - DNA, 1050 bp, Homo sapiens
tagagttaaagattttgtgaaatgatttgtttgtggccaaagaaatcatgattgtgactcagatgatttagttaaatgtataccaaataactttttttaaactgtggaagaatatataaagaatctaatgttggtactgtttttagtcgccatttctgcgtcatattttatagagattgttcttactctagtgagggtgatttaaagggcaggtgttctggattgccaaaggcattgtggaaacagagatgctctcacttctttcctgctcagtgctttccagaagctgtcaggagaagtgccacgtgtattttctaccttctgttagctatgcagaaggaagaggaagaaaaatattatatttttggaaacttgagttaagaattcagattattatgggaatagaaaaatggtgatgagatgtctttatttgactgcacagggagaattgtttggagtctgaagatcttttggctacctttataaaaaagaataaaaattgataaccatgcttaaagtcatgagctgattctcctgaagttccctgaaatagtcatatgaatgatatcatatacttttgtacattgttgtcataatggatattcttttataccacatattaatatatctcaaatgtaaaagttttacataaagtactttttcagaatagtttcatgaattagaactgattttatcatacacactaaggcatcatagacagcactgtgttggtctctcttcataacagagagattatatgtataagccatataaccttgaacgagctgtataacctctttctcatttctctcatctctaaaatggtatgaaaatgccctatttaatttgattctgagctgcatacatttttttcacattctaagggctctgaaatcaggatacatgtttgtgattgctgtattttactatcagtcatgtgacagtagacatgaagttatatgaaaattcttaatttataccttttggtatggtcactgcatctgatcatccgaatggagttgatgatagtacatacctcgaaggactttt

SEQ ID NO: 1990 - DNA, 1048 bp, Homo sapiens
tgtacccagaggacgtctgtatagtcctgtggaaaggcccacctggagaggaacttaacatcctggctgaggtgtagtaaattttatgtttggtctttgtctctgttcctggcacagagttccttgaactcatggagtttcctgagtgttaggagagtgttttgttagtcataagaagttccttttgattacacctaaatttatgctggtgaggtgacttagagtggagccactgaattgcctcaggatatggctggtaaccagacagaccatgtgattagagggtggaaattttcagtttcactcaccaacctctgggggaagtagaggctggagattgagtcctgtaggagctcttccttaaaacagcagtgtttggtgaacttctggattgaacacgtggaggtactgggagggtggttcacatggagagggcatgggaactatgtgtccctcttccccatcttaacttgccctacgcatctctttcatttgactgttcttgggttgtatctcttataataaatcgtaaatataagtacagtgttttgtgagtcattctagcaaattattgaatatgaagaggttgttgtggagacccctgatttatagctggtcagtcagaagtatgggtggcccctccaggacttgagactggtgcctggaattagccaagcgtggtggcgggcacctgtagtcccagctactcgggaggctgaggcaggagaatcacttgagcctgggaggcggaggttgcagtgagccgagattgggccactgcactctagcctggcaacagagctagactctgtctcaaaaaaacaaaacaaaacaaaacaaaaaagccacctttttcggtagaaaattttatacatacacaaaagtggagaaaataatttaatgagtcccatgtaaccattactcagcttcaacagtggtcaactcatggccagtcttgtttcgtttgaacctgtttactttccagtcacaccctttcagattatgttgaagcaaatctcagacattatttcagtaaataattcagtat

SEQ ID NO: 1991 - DNA, 1030 bp, Homo sapiens
tctaatatccaatagatatttatttcccctattgtcttacagtttaatgtatttgaatgtgatccagataaatttcatacattttggtagttgttatatttctagatctctcttaatttatagattctttctctctcccaaccccctttttgtaatgttttgtcaaagaaacagggttgattatcttgtatagtttcccatagtgtagattttgctggttttatccttgtggtatcattaatatgttcctcttgctcccctgcatgttctctatgtttatagttagatccacaagcttaatctgatttagacattttttggtaagatgactttaaaaaaattagctttattgaggtgaaatgtgcataatatttaacataaaatacactggttttaagtgaactaggtatagttacagttttacaactattacagcaatctaattcaacagaacattttgattactctaaaaataaactttgtgcctatttatagtaagtccttattttcacccccagatgtagacaaccactaatctacttctgtctttataaattggctttttggggatacttaatataaacggaatcatacaatatgtgttctattgtatctggcttctttcactgagcatatttttgaggttcatccatgttgtagcaatgactggttgtttcttaatcctgaatagtattccattgtatgaatacaccatattttgcttggcctttcaccagttaatattttggctaagaataatgctactgtaaactttggtgtacaaatttttgtgcagacacaagttttttttttcttgtgtatatagacatcaaggaatggaattgatagataatgtaattctatgattaacatttttttgttttttgagatgcagtttcgttcttgttgcccaggctggaatgcagtggtgcgatcttggcttactgcaacctctacctcctgggtgcaagcgagtctcctgcctcagcctcctgagtagctgggattataggcgcccgccaccacgcct

SEQ ID NO: 1992 - DNA, 1031 bp, Homo sapiens
aaaataatttagaataaaataatttgtatttcagtatgtaaacacttaagcatatacactaggagacataatgagatagtgaagtccttgcacctatgtgtagaatcatcataattgcagtatttccaaatgcagattaataaaggtatgtttcattggcagctcaaataccacaaatagtgttgtcattggtgacatgatttttcaaaaaggtcaacaaccttggtaaagttccaaacaaaacaaaatacagacttcatctatttacctggtaattgcattcctagaaattcagtgtgtcttaaaattgtgtaaaaatatcttatatttatgtgtaaaacagatttcagtttcaggcttagataattataaatggattttcacctatgtgcatgtgtggttggacgtttgtcactttgtgggaatatccatgcattccattctaacatacgtgtccatttctccatcccttcctccccagtgttgtggggaggagagaactctgcatttccatagcaacctctagttactgtagtaaccaaatacacacaaattccaatgtgccacctacgggggtgcatagcccctattttgaaccactgccctggaggaatgatcaatgggaaaatagttttaacagtccagtgtgtctccagtaaggcagtgtggtctgttcttggtattcatgtttcctgagataatggcctttgtcatagaatgcacagaataaatgaaacataaaaggccaccatcacattgtaatgtacatctaaatatagcatttgccttggtggaaagtgtgtatacctgttgttcctttttagggcaaaggtcctaatttggtgtttgggtattccctgaaattacacatttcgtatgtatgttcttgggtacatttttctggggagatgattttcagtagatctgtaaagaagtgcctaaggtcatgatggagtctaacaggtatggaaggaacctgttctgtttctgtgaaccttagtggcacaccctgagattgactaagattcgag

SEQ ID NO: 1993 - DNA, 2194 bp, Homo sapiens
ggccctaacaggccatggactggtaccagttagggacccctgaactagagtatagtgcttacatataatgtctttcatgtttagttttacagacttcactagtttccagggttacttaggacagcaccctttcccacccaccatcttcagtaagattgtttcacaccatgtgtattacaaatagattgttttgtcacattctgcattcaatcctgggattcccagacctcctaaagaatttattttaaatttgtatcctttaagattcacactttgtgctgcaaagttctatgggttgtaacaaatatatagtgtcatatatccatcattactgtatcatagggaatagttccactgccaagaatatcccgaagaatatcctgtacttcacctgttcagtacccccgacccactcccttcttttggcagccaacttatatgtttaccatctctccagttttgccttttctggaatatcatattgttaaaatcatagagtatgtagacttctcaaactgactcctttcatgtagtaatatgcctttaggattcatccatgtctttgtgtggcttaatatctcattcctttgcatcactgaatagtatttatgtacctattgagggacatttttgttgcttctagtttttggtgattatgaataaagttggtataaaatacatccatgtgtgggtttctgtgtggacataagttttcagacagttgtgtaaatacctaggagcatgattgctggattatgtagtaagactgtgtttaactttttctgaaattgccaaactgtactccaaaatataccattttgcattcttaccagcaatgaatgagagttcctgttgctctgtatcctcaccagcagttggttagtattttggattttagccagtctaataggtatgtagtgttaaaacaacaaatctcactgttgcattcccctaatgaaagatgatgttgatcattttttgtatgcatatttgctatctgtgtattttctttggtaagctgcccattcagaccttatgcccatttttaaaattgagttatctgtttttatattggtgaactttatagagtctttgtatattttggatacaagtcctttgtcagatatgtgttttgcagatattttcttccagtttatatcttgtcttttgactctcttaccagtgtgttttgcaaagaatttaattttaattaaatcctgcaaattaattttttcatggagtatgcttttggtgttacatccaaaaactcatcaaaatccaggtcacgtataatttttcctgtttttttttttaaagaagttttatacttttacattttacatttagatctatgttccatttttagtttatttacatttagatctgtgttccatttttagtttattttgtgaaagatgttaggtttgtgtttaggttcatagttttacatacaggcatccaatgtttcagcattatttgttgaaatactattctttctccattgaattacttgtttccttttgtcaaaaaccagttaactatataaatgtgtgtctttttccagtctctctattctgtttcattgctttttctgttctttgtagatactatgctctcttgattactgtagctttgtagtaggtcttaagatctgctacagtgtgatccttcaactttgttctttttcagtattgtgttggttattctaggtcttttcctatttcatataaactttagggataatttgttatccacaaaacaacttgctggaaatttaattgagattgtgttgaatatatagaacaaatagggaagaattgaatcttttcaaaattgagtcttccaatccatgaatttagaatttctcttatttagatcttctttggtttctttcatcgatgttccatagcttttgcatgcaggttctgtacatattttgttaggtttatactgaagtatttcttttctattctctttttgttgtatgtgtggggatgccatcataaatggttttagtttttgtttttttttttttaattttcaaattgtagttgtttgttgctggcataaaggaaatcaatagtcttttgcttattaaccttgtatcctgtgaccttgctataactgctttttggttccgagaggtttttagtagagtctttacattttttttttctacagacagtcatgtcat

SEQ ID NO: 1994 - DNA, 1033 bp, Homo sapiens
ttttagagtgctatttggttgacagaaaaaatgagcagaaaatacaaagaagtcccatgtaaaccctgcttcctccccaaagccctcctactagaacttctcacaccagagtggtacatttgttaaaatagatgaacccacatcaacacatcatcaccacccaaagttcataattccattaaggttcactcttggtgttgtacatttatgagttttgacaagctacaggcatactgcagatattgtgtgttcagttccagaccactgcaataaagcaaatgtctcaataaagtgagtcacatgaatttttttgtttctcagtccatataaaagttgtgcattatgtctaaaaaatcacatacctgaatttaaaatttttttattgctaaaaactgctaatgatcatctgagccttcagagagttgtaatctttttgttgaagagtcttgcctcaatactgatgactgctagctgctcagggtgctggttgctgaacatggggatggctgtggcaatttcttaaaagaagacgacaatgaagttgccccattgatcaacttttcctttcatgaaagatttctctttagtatgcagtactgtttgatagcattgtacccacagaatttctttccaaactggagtcaatcccttcaaattcttccactgctatatcaactaagtttatgtaataaacttctatctcaagatggaataaacttccatctcaagaagccgctttctttgcttatccataagaagcaactcctcacccattcaagttttgagatcacagaaattcagtcacatcttcaggctccactcctaattcctattctcttgctatttctaacacatctgcattacatccttcactgaagtcttaaacctttcaaagtcatcaatgaaagttggaatcagcttcttccagatacctgttaatgttgatattatggatgtcatgttaggagggatgaaaacaacattaatctacttgtgtatctctatcagagctcttggggtaactaagtgcatt

SEQ ID NO: 1995 - DNA, 1066 bp, Homo sapiens
tctagtatatataaatgcttcctcgtagaaaatgagcaagaggcttgaacagatattttaacgaagagttcactgaggaacagacacaaattagtacatcctgtctgattccgtttatatcaagttccaaaaccgttaaaactaatctatggtgttagttattaggatggtggttacttttggggaggaggcatgaatagtgattgggagaaatataaaggtggattctggagtgccagtggtgttctgtttgttgacttgggtaggaattacacaggtgtgttcactttgtgataattcattgagcatatgtgtgttatacttaaagaaaattttaaaaagacaaagaaaaacaagctaaattgtactgtcacataagtggtctatactattacaaagtacacagtagggaggattaagaactatatagccaactctgttttatgctaccaaaagggccactaggatgaggactaacgaaaatcattaggccaggtgtgatggctcacacctataatcccagcactttgggaggctgaagctggagggtcacttatgtctaggagtatgagaccagcctagacaacatagtgagacccttatctctacaaaataaaaaaattagccaggcatggtggcacacatctgtagtctcagctactctgaaggctaaagtgggaggatctcttgagcctgggaggttgaggctaccgtgagctgagatcacaccactgcactctagcttaggcgacagagtgagaccttgtctcaaaaacaaaacaaaacaaaaaccacacattagattaagtgacattagggttcttggtaagtttaggaactgtagttttaatggtatgtggcagcagaagccctactgaaatgagttgagaagatagtgtgataaggaaatcaaaacagcaaatggagacaattcttcttaaacgtttgcctgtggaaaaactgaaagcgtttcctcttagatctggaacacaacaaggttgtgcacttttaccactcttatttgttatagtactggaagtcctagctagagcagtcagacaagaga

SEQ ID NO: 1996 - DNA, 1055 bp, Homo sapiens
ttagttctagagtgttgtatggtggttttcttcctcactgtattttatttaagtttaactgatgactgtatcctctaggcacagaaggaagtattccagaagcatattgagtattagcaagagtctttgtgggattaaaatctatatttagaataaaaatccaagggatatgatacaattggtagctgtttcatgatacacttatttcaccttggatagaagtaaaaactcaggaatattttttatttaaaggagaaatatgctggttgtgggaagaacaaaaactagttgagagagtctttgacctatgaaggatattaactaggaagagttaccgttatactgtatgcaaactggtcatgataaaattacatctcagatccaaagaaactcacagctagaataatgtatttagaaccaaacaaagtactattactatttcttgatatgtcggaatatatcaatatattcaatatttagtctcttatctggcttctatggattataacttttgtgtttaaatttacttatgataatcttgggcattctgtcattaaaaagcttatgagtttggagcgaggtgtcactgaaattttgaattgtatggatatatttctacttttcagttgctcaaggttcagaatatacattaagacttttttaaatgacttaatactgatttacgtacattttaggtagaataaacacccatttaaagtggaaaagttcagtaagctttgaccgattttgcacccatcgaaaccaccactatgatcaagatacagaatgttaccgttacccccaagagtttcctcctgtctcttagcattaagtttaatagtgattcctaagtctacaactctgttatactgttaagctgccccagagtaagtcccattgatgtttaaaatgcttaattttaaagtaaaagtaaatcagcatattcctcctattttggcatttgcagcccttgaaatatccaataattatatagcattcaaaatatatgatgttatcacattcaaactgaacaaccaacattgagctttactaga

SEQ ID NO: 1997 - DNA, 1086 bp, Homo sapiens
aggagaagggggagtcaggagacccagggagaggccctttgggtctgagttaaagcaatgagtcacttcttactacttaacaatgcaaaaagcactttgcggccgggcactgtggttcaagcctgtaatctcagcaccttgggaggccgagatgggtagattacccgaggtcaggagtctgagaccagcttggccaacatggtgaaatcctatctctataaaaatacaaaaaattagctgggtgtggtggcagacacctgtagtcccagcttctcaggaggctgaggcgcgagaattgcttgaacctaggaggcggaggctatagagagcaaagatcatgccactgcattccagcctgggtgacagatcaagactctgtctcaaaaaaaaaaaaaaaaaaaaaagcactttgcctgtgttacttcctctaatcctcacagtatcgtagtgtgggggagagctggcttttattttacccagattactgaagaggaaaatgtggttcagtccggttatgcaacttgcctaagatcacataactaactggcagaagcatgacttgaatgtagattctgaagtctaattctgaagtctattctcattccagggcactgggctacccagcaatggaaagctcaagctaaaactgccttgggttataatatagagaaagactgaataatgctggaaaaaatatttttattattgactaatgacatagaaaaatgctcatgatatgatactgagtgatggagaaaagattgactaccagactgcataagcattgtggtgctaatcttaaaaagtgtattctgtgctcgtctgtcctgtggacagtggtcaggcttcagccccatccctgagaatggccccctctgaaaatcttccttcttttcaactatactttgcaaccatggtgcattcttttgggttattcaatcacagggatgaaaattttagtgactgtctcgtaccatgaatcatagcaattttagtcataagataactctcacgttctactataaatagggctgggctttcattactagatacacagtaacaattaacaataaacagtagtttttc

SEQ ID NO: 1998 - DNA, 1115 bp, Homo sapiens
taaaattgtcactttaatatgaatacttttttttaagttaattttcaatgaaagataattcaaatagcttgaaactaccccagcctgagtgaagttccttggagaggaaaatgaatgtattgcattaccctgtaaattgtttctttaaatgtgtcttaaatttcctattgaatcctttttagtgagagaataaagattgtgataaattttagtaacgtggaattaatctggaatcttttttggtttaatgtcttgagcttttgatttaggaaaacttttaactacataatagaaataaaacactggaatttaaaatgtgttacatttacctattctatggaaagaaaaaagtttgaatataaatttacatagtcactttactaagtagctagttagggatatgggaaggatctatatatacatacagttatatggatatagcagtgttcatatgacttagcttgaggaagcttggccgtttatttcattacagagaaacttttggtactggcttttgaataatacattgctttggagtgtgaaagacttgaatctctcatcttgaatttaattgatagttttctgttatttcacttacatgaccttttttttcagaacagattttctttagtttgatttccttttgttgttcttgcagaagtgttttctgaaaaccttattaaatagcatcccccatcatactctgtgcctttgccttgctttatttatttatttttacatcattggtttatctgacattaaaacgtacattagtttattatctgcctccctctctgattgtaagcttcatgaggacaagggcttattttgtacactgttctcttcctagcacctagaaaagtatctgacacgtagtgatgctcagatatttgtggggtattgttattaagtgatcaaaggacccctggttttgttccttttttaaaaaaagattaatatttgatttatacagctgtgcagttaaaaagaaaattgtactacaagggttatacaggttgagcatcccaaatctgaaaatctgaaatccaaaatgctccaaaatattaaactttttgagtgccagcatgactctcaaagaaaatgttcattggagc

SEQ ID NO: 1999 - DNA, 1265 bp, Homo sapiens
gttaaaaaatctgaaatacaaagtgttggcaagaatgtagagcatttggaacccttatacatttcaagtgggtttgaaaattggtacagccactttggaaaattctttggcagcatttgcctaaaactgtatctgtatatgctctgtgatccaccagtttcatgtctggggatagacctgatagaaatcagtatatgtgtgcatcagaggacatgtacattagaagaaaacataggggtaaatctttatgaccttggaataggtaaaggattcttacgtatgacacaaagtgacaccaaaagcaggagcaacaaaacaagcaagaggtaaattgaacttaaaaattaaattttttgtgcttcaaaggatgccatcaagaatgtgaaaagacaatacacagaattggagaaaatatttgcaagtcatatctaacaagaaacttgtagtcagaatgtataaacactcctataactcaataataaaaagacaactcaatttaaaaacaggcaaaggagctgaatagaaatttctcaaagataaacaagtggccaataagcacatgaaaacatgctcgacattattagctatcaggaaaatgaaatcaaaaccgcagtgagataccgcttcacaccactaggatgacttgaatgaaaaagttagataataagtgtaggcaaggatgttaagaaattgggatcctcatacacttgtgggaatgtaaatggatgtggcttctttggaagaccatgtggcacttcttcaaataatttaacgtagcattaccatacgacccagcagttcctctcctagaacagcagatagaggtagaaaacagataagtggcttaggccagtagcaggggtaagggggtggtagctaaagggtatggatttctttctgagatgatgaaaatgttctaaaattgaccgtgttgatggttgtacctctgtgaatatgctataaaccattgacttgtacattttaaatgggtgaattgtatggtatgtgaattatatctcagtaaagctgttaaagataggaaaaataatcagtgatgtgacagtgttgccataatatttgagaagagcaagatgcagagggatataccaagtatttgtatgaagcaaacaactccgaaacctttatgtctgtatgtgtttcgatgattctgtaaggtggaaaatgttgcacactaaatgtaaatgtttgttttcttgttggtctaaaatagggagagggagagaaaaaagggaaaaaataactaa

SEQ ID NO: 2000 - DNA, 1032 bp, Homo sapiens
tctcttaaagcatttactaccatccagtacaggacctttagttgccatatctcttgagtttcctttaaattgtaatagttcttcagcctttctcataacattggcattttttgaagaatatatttatcgaatgtttctcagattagacttgtccatgtccttgagattagatttcagttatgggttcccagctcaacttcttgtcagtaatgttgtgtccttcccggagtatcatcacatccagaggcacatgatgtctctcttttccccattggtgataataattttgatgtactcagttaagggattgtccagttcttcacacaatatagttacttatttttttttcttgtaactagtaagcagtctgtgaggaaaaactgtttttgtttttttacttttttctaattaatgtctttgtaggaaatttaaaaatatacaggtaagctaaagttagggaaaaattgtcataaacctagcgataaccacattttagtgtatgttggttcatctctcttctttatgttataataatgattaccaaaaaggactataccttaaatactgtttggtaaattgcttcattcatttagcagtatattataaatatttttttcatgtgtcattaagtattacagtattttaatggctgcatagttttccattgtgtagcagtcacttgcctatagattgttctgtgatgttcagtttagcctcacattccaggtacaagagatccttagtggctgtcccctaggggttagggaatctcttaaacccaggagcctccaagcatggaatcttgatgtctgtcttatcccatcagcactgccatgttgtttttctgttctgctgttccacactaatatgctatgttcctttctctgaccattcctaggtccacagtagcacacttttgtcaaatatttaaacctatttctgattcacttgggttgttttcatgctttaactgctaatattgtatccagatgttggttttcttgtttgtcttattgcaaatataggctataa

SEQ ID NO: 2001 - DNA, 1041 bp, Homo sapiens
tagtgttcctatcattttaacatcctgagtatgatagtatctctgttttactgatgaggaaacagtgacaattgtctttggtacacaactaagtggtggaactgggtttcagactctaaaatctgattttttttaacctctcatctagtatatcaatgtgattttgtattccaaaacaaagtcattgataatcctgaaattcaatactacaaaatagatacaattttagttctttcgggaacaaaatatagtgtattcattgtgctatatacaagtctgtagtggccctgaacactgtaatgactatgagtttccatttatgtcctacatgatgtaggtagtattagtcctgtgattttcaagtaagttacttcctgtcttagtatctcaaattcgatacctataaatgaaggggtgggccgaaatgatcgtcagttcccatcatttccacaattctgtgttttcctaacttttcccccatacctcagagggctctctaagtagaaccattggattagcaatagaagaagaacaatgtattctataaataaagcacaagaagaaaatggcttttgtatttaaatggcaaaaagaaaaaaccagaaatacttatttcttctcctccctgaaaaaaaaaatcaaaaaaatgaaattctttatgcaaattacgtttttgacctaaaattcacctgtcttcttcttaggtgtattttttccttttgaatgaactgcaacagttgtattgctgctttatatgagatcagtgctgtctagcagaaatatagtataagccatttatataactttgttttctggtagccacattataaggtaaaaagaaagatgaaattgattttaatgattttatgtaacctgctacatacaaaatattatcgtttcaacttgtaatcagtgtaaaaaattattgagatatcttacattcttttttctccgctaagccttcaaatccaacatatacaacaattgcagtacatctttatttggagtagctatatttcaagtgcttagtagccattggtg

SEQ ID NO: 2002 - DNA, 1007 bp, Homo sapiens
ttacgctcaggcaatgagtccttcagtgtctctgctttatgcaatgagagtctcttattggaacccccaccatagattaggccctgggcaatgtgtcccatgaagcttggaaagctaaccagattttcaaatgtcctccaagggattgccagctttggtgttcagcttacatctctggattctccttagttttagggccctaagtattccttactttattgctagctttacagtgaattttcataagatgtgtttcatatcttacccaatatttttaattattttcactggaagagtaggtcaaggtgtctaatttaccagacttctggtatgtagtccttactaaattttgaatccattccccctcttcaactccactgacactaatgtatcagatccttctcatcatctctcactgtagtctctgaactgattcccttcctgtatgccaccttctgctccctgatctttccaaaatgtagtacacatccataatatcttacccaaagcatttggggccagatatatttaggaatacacttttttccccagattttagaaaggtggtatagttcatataccatctgtggtatgctcatcacaatcacctccacctcctgcttatgtaataccttgaaatcaaacacacttaatatttttggagcaaaacatgtaattattcaccttaagtgagatcaatgaagtctgtcattagcctcacatcaggttagattttcccacctagtgaacctgagaccacactaccaaataaacaaaactttgacttttcaggtttgagatctcagaattgcagataaagggttgtgaaccgatgcctggcattcagttatatcattctcaaatttaaaaattctccaaatcctccactggagttcttactgcttatgagagcaaatctagcctttaaagaggcttcacatgtaaaaatggccctttctggtttcatcttctggtactctgatacttctcatattcagcttccagac

SEQ ID NO: 2003 - DNA, 1022 bp, Homo sapiens
cgtaatgtttaatattcaactgatggaaggtatgaatacaaaaaaattgcatttaatcgtaaagattatgcttttggaaagtttgaggcatatctgaatcataggtttcaaaaaaattttactgatttcaatttccattattttttagtgagtaaatcttaagttttttccttaggaataatggaaaactagatgattaacatggaattatttgctgttgctgcacatgctgatattatgttaatcatatttggttctattacttatatgagatcagagtatgaattttgacctctgcaaatttgtgtattttcatatttgagtaacatgatattgtactcaatcttttcaggtagttttcatttatagtttatataagtaaaattttatattcaattaaatttatttatattcaatactattctttaatgttaaagagcaactattttgtttagaatcgattacattttgtacaaaggatcaatgtgtttttaaggttctgggctaaaatcatgactgactttttaaaactttattactaaaatataactttttaattaacaaagtgctgcttttgctttttatagtatctgaagagacagatgtttcccatgaaaaccagtgtagatttctatattggaaaaacattagtatggaaaagcttgtgatcctttttatgtttctcttttctattttatagaaaaaccttggtgtgaagggttttctttaaaaattctttttaataattatggccttattgtcttttcttaaaatttgaatttcatggaggaatggaaatgattataaatatacagttatgaattatatctttaaagttttagggaaaagaattatacgctgtgaaaaaaaaattctatttttattttttgcatccaggctggagtgtagcacgatcatagcttactgcagcccccaactcctgggctcagaggatcctccagcctcagcctcccaagtaactggactacaggcacatgccaccatgcccaactaatttttta

SEQ ID NO: 2004 - DNA, 1042 bp, Homo sapiens
gtaccaaagtttttgaatgattgacttaggggaaaataaagagcaggtttatcattatccctatgtcacataactatattttgcatatccagatacttccttaagtggtaaagagttagatatacaggcagcaagcaaacatttgcacctaatcttgagattactaatcaagtatcttgaaagtggagtaagagaaaattgtaaaaccgctgttttagaccatggaatatccatctaaaacattaaagcaaaggaccccttgacgttgtattttaaagagggagcgatactgttgagacatttttctaatagagattttctgaagatagtctgcatctttgagcctctgaacaatagatcccaactgtactacttataatactagaaagagtagtggattaggtgtcagaatattcttatctccagaaccagactataagatcctgaaaaacaaggacatacatctttgtgagtgagtgggtaacagagagtattatattctgctgcttgctaaccttgtgatctcagtctcttcatctctaaattaatactcatacttttttgttaatctcataggaaaattaggtgagacttacataggtggaaatgttttgcatgctgtaaaacaacaccaatattttaatatgaaataaagtgaaatctaatgtagtaatgaaatagaaacttcatgtctaaataaaaaaaaaaattttccagtctttggaatgatttgaaaaactatttcctgaaccttttagtgaacaccattgtgggtgactgactttgcttttttttttttcaactccccttgattatttacattgatctcaaaggcacttactgcaaatctgcctctcaagtgtcttacaacagtatcttttagttatgttgtatgtgatatagcactgatcaaagagaagaaaatatcagaaatccaaaaatgtaaggaattaaaggattttacagttattaggactagccatgactagatttatcaagaaaaagtgttaatcgcaaaatttggtgtttatttcttaacatt

SEQ ID NO: 2005 - DNA, 1060 bp, Homo sapiens
tcttaaggggcttgttgaagaatttggcatggtaagttttattttgctgacgagagcaaactagaatattgtgaaaaaaataatttagttatatgaaacatcataaatattctttaatgtgctttttctaagcctcatttctactttatgtactacaaagatgcagtagctcgaccaagaaagcatattttggctaggtgcggtggttcatgcctgtcatcctagcactttgggaggctgaggcaggtggatcacctgaggtcaggagttcgagaccagcctggccaacatggcaaaaccacgtctctactaaaaaatacaaaaaattagctgggtgtggtggcacacgcctgtattcccactccagcttgggtgacagagcaagactccatctcaaaaaaaaaaaaaaaaccatattttttgaactgtggaaatcagtaaattgttgcagtactctgtactgcttcctattaagtagaagcagaatgtaacagaaaagtttttgtaaaatctctagccctctgtagaatgtgagtatactcttttggtggatctagatatgactcctttttcctgttggagagagacttcttccccttccccatttaatttttaatttaatatgtcaggttttcatgatagtacttttttgttagaagagaaatacttttcttataaccctctgtaatatagtgttccttgcctactgctctctgaaaagcaccctgtttatgatattttcattaatctgtctcctcctcaacagaatgtaagcccctatttgtcttggtttaagggtttatccttacagcatctagaacaaaagtagtcatataataaatgtttcttggttcaactaattatccctttctagctcttcccattgtttcagtgattttgatttaatttctgtttaaacaataaatgtatttgtgtggcatatttgcatgggtcaactccttacccacccctgattttttttgttgttgttattttgttttgtttttggtgcctcagctggcacctagtatttacttagcactgtgcttggtgctaaata

SEQ ID NO: 2006 - DNA, 1068 bp, Homo sapiens
atactcattgcaaatggggtcagtcaaataagttttagaaatgcaaaatattatgtttcccttttggaaattctcaatgtacattcacatattaaagactgaaaagccctgaaataaaccagatgcccaaactcatagaatcttaaatttcccccaacaacacttactaacagcccatgagaatacatttcaggaatgttagcataaatgagtatctaaagagttgtatcaatctgtatgactaatagtaattttctcatttaacctacagttacctggtgatagttgatagatgttctagagatagaacgattaactaaggtcatgtatcacagaagatggtaaaccctagatagacataaatccttgtctaatcccagagtccctgctctgaactgctgtgttgcatgcatttgccctcatgttatttcataattttaggtattctccatttttaatccactaataatttcttcaaattttacaagtgacaacacattttgtgaaattacttttagggtgtctgactcttgaacttgagatttccacatttttggatcaggtgaatatcatccttctccagtgtttcgagccttttttataaacatgcaaaatatattaatggatttagaaaaaagaattaccctaaagatctcttagaacaaaaaatgtataaaaattctgattgtcaaattttatattttactagaaatatgtgagagtttagtcaagtaaagttcttaacaagaatttctgtactataaggataataggattgttgaaattttgagaaatgtgttatctatactttgccagatatgtacagtattccttttgggtcttactgggatagaattaatctcattaggtagttacacaactataacaatagaagggattcttagagactatgatctcttccttgtagattgttccgtgaggacagagactttttttttttttttttacttcatatcatcagtgtttaaacccttaggaaactgtctataattttttgttgattaaatttctcattttaaatacaaggaaattgaaaagtacacgcaa

SEQ ID NO: 2007 - DNA, 1053 bp, Homo sapiens
tatttaggggaaaatgagtgaatttgttttattggaacagatggtttttgtgaaggaaactagtggaaggtccgctaggaaagtaggcttcattctttaggaggacattattcttagccagactaagcaaattggactttttctgtttgcagaagcagatatgtgagtagtttaagaagatgaatctgctggcaatgtaaatatattttgatggagagagaaaacagagttacaccagttggcaagctattacacagttcatagtaagaactaacatttgagtgccaggcactgttctaagcactcttcaattgttaaatcttatgcagtaaatactgttattcccatttcacaggtaaggaaactgaggcacagataattttctttcccctaagatcacacagctggtagcctatggagtctctgtcttctagctgctgctgtggatcatttgaatctaaacaagagttctggctctgaatagaaatgagggacatgcacacaagagaccaaaaaggggacatgagtagaattcagtggactgtgtatggggcagctggggaagtatcaaagatgagccaagcttatttggaaatggatgacaacattaatcaaaacagagatgttgagatcaaatggtgaaaagacagttaactgtcttccagaagcattcagaccagcaaggagacagacataaataaataacttcagtgtaatatcatatagaaaacatgtttaagaaatagtcagtgatttggggaaaaagccacctaggtgtgtttgtttgaatctaggaagtcataacatcagaggtattatttgagttaagccttgagatctgctaaattgacgacagataagctgaaagaaggtgtttcagtaaagaaagcagtagcatgtgaggtaatggtgaaatatccaaatgcaaacgtctagctttggttaaatcaggagggagagctacattcaggaatcatctgagcagtggtgatacttgaagccaaaatactctaaagtagaatatcttgaagaaagactttaaggcatagaagg

SEQ ID NO: 2008 - DNA, 1822 bp, Homo sapiens
tgactgatagccaaagcacacatgggtattttttttagctttttatgttttcataccttgctttctgacatatatagaaaatttagaaacagtcatctattttatttttaaaaatagacttttactatgtaggagttacctataccaaaaaccaataaaacatttattatatctccagattcgtggaatttagatatgggttattttaaaaactagggacaagaaataaaagccatcatcctcctgggcacatgcatatcatttttcctatatatttaatttaacttaccactgctaaagtccattcattttaatactagaatggaaactctgagatcataaaattattttacttaaataatatttactatgaaataaactaccaaaacaaggaaaatgcaggaagtaatataaaactctaaaacaaatagaattttatgagcaatattctgattgaacagcttgtattaataccagacacagatttttataaaacagctaaaagcgcatcatccaagactgctgttaggactttgcatcagtgttgtcattgaagaacaaaaaacaccaaaatgctaatctaaattaaaacaaaaacagcttccttgtgtgtattctgccttggctcattgtggttcctataagattaaatcataagataaatcactgtttaccataagagaaagtggtctaaattagcatttaaaggaggcaactaaaagtttagtttttaaataaatataatttttttttaataaatacaaaagtattggcttcactgtcacttaaagcagggcaaggagccacatttcttaagtagtagactagctacgtcaggagtaaagaactggttttaaaaatacatttactgttatgttttctgaaaacattctcttatttaatattttctcacatatgttcagttttgaagcaaaagatccataaatctatgttacctcataaaactttctgtatatgttaaaattttcctaggccccaagagaatgttataaattagttatagaatacttacgtttaaatttaagtctttacttagttgtttttagaagagaaaaaaaagtcttctatgcgttgggttaattttattagtagcttttctcttcatagttgctatattgccagctagtagagagaagaaacgaaagtcaggatttgcctcctttcagatggtaaactcacagaggcatttaactggctgtgtcatgcactgaaaacagcatgaggcaatgaagttaaatttatgaagcattcaggatatgttagataaagaatttctagattgtgaaatatgttctgggaagagacttgagaacaatctaatcccctggatatatttaagaaaaggataaatagttatctgtgtaatttggggttcagattaaatgcctgccttaagacagcgtcagtaagaactgaggcttaatgaagtcctgcacttcccatagcatgcaacaacaaaaaagagagatgacagtatttcagatccactgttgcttggaaattttgttagaatttcttgtaaaatatgtgtttaacagaaatcctgccagcatttacagttttaaatctttaaggaaaggacacaaaagcaaagttggaaaaaattttagctttaccattatttgcttgttcaagattcttaaccattaatatctttaatttttacaaggctaaaggagccccaaatctaacaaacttaagtgtctttggtttaaggcatactattggtaacgagtaattttatctttaatagtttttataatgcatgtaaaaaaagctcccagatagaatattgaaggaa

SEQ ID NO: 2009 - DNA, 1050 bp, Homo sapiens
aagagcttatttctcttgaagcttcactcttttcttttagcttcatttgttactttttttaaaaagtttatttagctttattatcccatttgttcgcaagctttcaaattgaattttgcactttcacaaatattttttccaataaaaggtcgtgtttcaaaaatttatcgaagtgaaagactagattatttttcagtgttaatgcattacatagaaatattttttatcttcctttggtaatgattattaacttcctttttccagattttgacagtttttaaaaaattttgtagaacagaattagtcccagtaaatggctatagaaattctggaaaacatctaggaataatttttctaaatgcatctaaaattttactgatgtttgaaaatgcctttattgccatcttctctctcacaccataatagcaacactgtatttctgtaccaattttcagtctacaaaaagtttctacatggttacttacttgaaaatgtatgaagtcaatgaagaagctttttaagactggagttgtttcacaaatctgttgccctaggttgtttttcaagtttgatggtctgtgtcttatacttaccactatttttcccttctctctaattactgacatagaactcctacctaataaatacttaagttttgtccagtgagatgtagaacagatatcttaaaattcaaaatgtgagtaagtagctattagtcatttatctggctcaagaaacttactgaatttaaaagaatttaaagtttattagattgaaatgtaatctaagaaaattttgcacagtttatagaggatggcaaattttttgtgactactgtaaaattataatacaatatttattaaagctagtttttactttgctaaaagggtagacttagccagtgaagccatgaggtagttctgacattctgtaaattgacatatcatataatgccttcatttttgtaggaaagctaatgctattatactggtttttgttttcatgaggagctagaaccagagcagcccttccattacattgacatatatt

SEQ ID NO: 2010 - DNA, 1081 bp, Homo sapiens
gaattatctggttgcagggagctgagatcacaccactgcaccacagcctgggcaacagagtgagactgtctcaaaaaaaaaaaaaagaactctctgatagcactgctgatttattacatcatcagatttaagacagcatagctactaaaatgcaaatgtccttcctataaggagtagtacagtaattcagaaaaaaaacaacagattaatatatcatattcacaaacatgctctctgggaatagggaatagatcagttaggttttgatgcagagttgaagctgggaaggtctggaaagtaggagattatctgaagaaggcatgcctaggatgaaattcagcagtaaaaggccccaggctggctgagaccagcatgaagtcacaaatctcatctttcattaggagaaactgaaaatacactccctaacactgaagttttgctagaataaaccataaattttctgtttccgctaattatctttttttctctcagttcaaatcaacatccaataagaacgtatctgtgataggatggatggtgatgatggctgatgaccctgaacatcctgatctcttcctgctgactgactctgagaaaggtgaattgttagaataactggggcttacgatactgcgtatgtgtttgtgtatatgtatgtatgtatgtgtgtgtgtatacttgtcatatatataatgttttatgcatacatgaagaacttgatgagccaaaacctagtttcactggaatactcaagagagaaagtatttgtgtagttttatctattgggaaatacttctgtcccattatgtattttaataatatttgtggagcttattttctttgctccatgggcatatatgcttgaaaattaaaagcccagctaatccctagagacctaactaggaaaggagggagggaatttgagaatatataccccattgttacttcaaatttttagagacttgccatataggccatactgcttccttcatcaataccttgaaatggattgttattcttaagttctgaaagtggcagagttttcctttaaatatttattctatcacttttaattaaatta

SEQ ID NO: 2011 - DNA, 1048 bp, Homo sapiens
ctgctctgtctatggagtagccattctttattcctctactttcttagtaaacttgctttcactttactctgtggactggccctgcattctttattgcacaagatccaagggccctctcttggggtctggatcaggacccctttcctgtaacagttccatctggggcagatcacctaacctcccctgaagttccatgctgacttctgcaaaattggaacattaacagtgttttgactgcttgcaacagtgtagttactcgcaaaaggattatttgaaaacatccataattccctttccccctccctaacaataacaaaatattttgaaactacaaaaagaaaaaatggttttgtatttgaatgtgttaaatagggccatttcctctccagttcactacagtccccaccactcactatagccttctttttttttttttttttcactcttgttgaccaggctggagtgcaatggcacgatcgcagctcactgcaacctccacctcccgggttcaagtgattcttctgcctcagcatcctgagtagctgagattacaggcatgcagcaccacacctggctaatttttgtatttttagtagagacgaggtttcaccatgttggtcaggctggtctcgaactcctgagctcagatgatccacccgcctcagcctcccgaagtgctgggatgacaggcatgggccaccgcacccggcccctatagtcttttgactgatgtttctttaccaactcaggtgttgtcatgtgatgcctagaactgggcatcccatcttatgaccaagataaaggctggcccttgagcaaagctggtcctcagagaacagaagggaaagatggaaagaacctagccccataatgattttcttgtgctactgaactaaccctacaagagccttacttctggacttttaagaaagaaaaaagaaaaatgggagaaagatagggaagaagaaaaaaggagagaaaggagaaaaaagagaggagagggagggaggaaagaaggagggaaaaagaggaagaagaaagggggaaa

SEQ ID NO: 2012 - DNA, 1041 bp, Homo sapiens
attggcttagttatgttctacctgctcttctccaagttttagggtatgaactttgtaaccacttatttttgttgcccagggacgtttttgtttgtttgtttcttatcgttggtgtagatagtgaacgtgtgctctgtataggtgcatttatgttcctgtagttttctgtaaaaaaaaaaacaaaataatatggaagtacttactcgtgtgggttcttgtttcagaaagcactgccaataatacttgaagatctgatttcagccctgtcttgtatcatccttgggcagtgtgttagacaacctcctttcttccttttagcatttccaaattgtctttactcttaatcccagccgatactaggaaccaggttggcaatagcagtggccttgaaaggtggaagcaggatatacagaaggtggcaactttaaattgagtgtatataattggtatacatattcgctatttctgcatcttttatatactgtatacttgaattcattgtaggacttatttccccctgtctctgaaagaggcagtctttaaaccagagagttgccagtttagaagaaattcttataaccctaaaggtctttctcctttgcccttctctccttttattccacaaacacttatcagatgcctcttacaggccctgcacagtgctaagttacttggaagtacaaagcgtgagtaaaatctatcccatcctcaaaaaacacaatatattagaagagacagatgtgccaaaaaaaaaaaaaaatgtgtgtgtgtgtgtttgtgtgtgtgtgagttcatagtataacagagggatcatgcctggagccacctagccataatttcagcacagatctgtttgaggttctcctgcttctgagagtgatctcctgtgtgggctgtcagcttgacgtaccatagaacataaggctaaaaatgcgaggtctattgttgtataaagtttatgtggttttccaagaactgtagtgaattgaacactaaagatggaaagcatatgaaaagctgaaggaaaatgttataatattt

SEQ ID NO: 2013 - DNA, 1025 bp, Homo sapiens
gcggaggttgtagtgagccgagatcacgccattgcactccagcctgggcaacaggagcgaaactccgtctcaaaaaaaaagagatcctcatcacacctaccacttgtacactggagaattgaaggggagttgggacagcaggaagtgtgttagaagacagatattcccaagagcgtgcagtgttagaccaggtgctttgcaggataggcctgaaatgttcagacaagatataagtggtgggaggagaggccagactgatgagtaggggaggtagtaacagataatgcataaccttagtcacttcttgcttcatcttatatctcttactaccactgcagccttctcattacctccctcctccagaccatcctggaaaccacttccgttcttccccgttcttccccagaagacttattatcactatgttccccagctttaaaacatccagggacttcccattgcccaccagacaaaacccagcctccacagcctaaggtcaagcccctgactgtctggtcctcctctctatactcagccttatcttccttttgctctttgtttctgtcaaactctggccccctgctcccgcatcatctcctaaacagcctgtgtccactcccagcaacagggcactctcttctccaactcagcaaggttttttttggcccctgccataggtgctaactctcttagtcactgcacatactgacctgtgctgctttatatcaggaaatatcacaggctggggaaagtggttgtaagtttaagtgcttgcagaaattgactccagtccctaaacacccagcaaaatgctgttctgacccccagggcttcagaggctatttatttagtcctggtgtaagtgcaaattaatgtccttggtcatactctgatgtccttcagcagaaggataggaatgatttattggcagttactgtatgaattttgctgctctgtcagtgacttaagatggatcactctctggtaagagaagaatctaagtcctttctctgaaagccacttgt

SEQ ID NO: 2014 - DNA, 1034 bp, Homo sapiens
caaaagttttaattacacatttttcttcatttcttcaggtcagtctaataaacattttagtagacatttattaagcaccaactatgtgcttaacactgtgctggcaatacaaagacagtccttgccttccagaaaactaccttttatctgtactaaaactacatcaaaagccctttagtggggcaaaaatgacagcttccatgttttattcttagaatgattggtgacgtagatagagaattctagtttccttctctacctcatcttcattccatctaccggcaattcatgctaatccacagttgtttgcagggttgacagagaaggtgactatagcagaatcaggcttgctaatgggtgtattctaccacttgtgctgtcacctgttactggtgtaatccacgtatacatctgtgcttcccattcactttgcaggtatagccgagaccatgtggtggaaggggaaccgtatgctggttatgatagacacaatgcagaggtagcagcctttcacttggacaggtgcgtatgatcacagcagcttatgttcattttgtttgctttcaaaaatctttcttggagaggactcgtggactccttcagaaggatgcaacactaataaataacttgttatcgattttagatagctaattgactagttccattaaacttgtatgagtctcataatttggttggcaccaggaatactgaagtattttacttccatgcttctttaggtcatttcatttctggcctgctctgttattatcatcagtgaagatattcttggtaaataaactttgaacttaaatctctgaattgaactggtcgttaattgggtctagccatcctgttgttttgttatgtatttgttttaagtaagtaatgctgacttatttccatgtgctggaaacatatagcatgaaatatgagttttattattctttatacaaactatgcacagcttcaaaaaccagaataattacaaaaggaaagggccaggcgtagtggctcatgcctgtaatcccaacact

SEQ ID NO: 2015 - DNA, 1054 bp, Homo sapiens
gatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtcttttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttt

SEQ ID NO: 2016 - DNA, 1054 bp, Homo sapiens
aaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcatctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttatt

SEQ ID NO: 2017 - DNA, 1050 bp, Homo sapiens
cagccgccggtaccggctgtgggcgggggcagcctccgcggagcagggagccccatcaccgcccttgccccacccgcgtcccctgcgcacccccctggcgcccggcttcccgtcccccgcctcccctgatccctgcgctttccagattctctcgcaccgcctgtgccatctcccagcccaccctggcgttattcgaaggtgttgctcttgacagctctagggaacgtccgctgtggacatgcctggtgactgccgtctcccttgctgcttttggacgcagggcttgaggaccgacagtgggccgagtcggggctgggagttagaatctgagttctgggtgtccctctgtccctgacaagttgtgtggcaaggttgccgcatcactgtagagcaccggatggtctcctctcggtctcacagctcctccttttccaggctggcgccttcctctgttgggccagcggtacctggacctcctgaccacgtggtactgcagcttcaaagactgctgccctagaggggattgcagaatctccaacaactttacaggttggaccccgcatggcttcaaggggctagggatctgtggggaggggaggcagtccaggggaaatggttagatgcaagggacctttcgtcatcctgcccagcctcccgacaagcaggaactgccacagtctgactgaagttttgagggagtaccaaatgcttgagtcagggaagcccctttttagcctctagcttaatagcccaggcaaactgagctgtttgtcaggcccagagcaccttgtttcactctaaacagaaacagctacctctcagagggggctggaactatccagagagaactgatcagaaattctgggttgtgattaaaagtgtccctttcttttcttttttttttttgagacggaggcttgctctgtcacccacactggagtgcagtggtgcgatctcagctcactgcaccctccgcctcctgggttcaagcaattttcctgcctcagcctcccgagtagctgggattacaggtgcctgccaccacgtccg

SEQ ID NO: 2018 - DNA, 1065 bp, Homo sapiens
aaaattagctgggtatggtggtgggcacctgtaatcccagccactcgggaggctgaggcaggagaatcgcttgaaccagggaggcggaggttgcagtgagctgagattgcgccactgcactccagcctggtgacagagcaagactccatctcaaaaaaaaaaaaaaaaagaaagtagtccttgaatcccttctgctacaaagtctgccctctggcttcttattctaaggccaaacaggaggagtaactgattccacccgagagagattcagagttgcttggtttcttggctgttggctgttgtggtggatgggcctgtgtgtgccttttgctgtgactacctctttcctgtccttaggcttagagtgggacctgaatgtgcggctgcatggccagcatttggtccagcagctggtcctaagaacagtgaggggctacttagagacgccccagccagaaaaggcccttgctctgtcgttccacggctggtctggcacaggcaagaacttcgtggcacggatgctggtggagaacctgtatcgggacgggctgatgagtgactgtgtcaggatgttcatcgccacgttccactttcctcaccccaaatatgtggacctgtacaaggtgaggccgaccagggctggggtgaggcctctgtgctgggagggagacccttctgccagcccttccttgcaaggaaatgggctctggagaagcctggggaggtggggacaggtggcagaacctgtgacagagccactccgtccactcctcacagaggcccttagcatgtggaagagactggcgttccaaacaccaccccctgctctgtccccaaacagccacactcgagaggctggacactgcgcttaagcagggacgctgcatgttgatttttgttgtagaagtagtgaaatgtcacagactgcagtgtagaacagagaaaagcaaaaactgtcagactctccacacggacacacccttgtcagctaaggagaggtagcattttatgtgctgcctttggtgcggaacctttccccaggctctttgtcattgtaactacgtt

SEQ ID NO: 2019 - DNA, 1049 bp, Homo sapiens
gctggagtgcaatggtgctatctctgctcaccgcaacctccgcctcccaggtccaagcgattctcttgcctcaccctcccaggtagctgggattataggcatgcgccaccacgcctggctaattttgtatttttagtagagacggggtttccccatgttggtcaggctggtctcgaactcctgacctccggtgatctgcctgcctcggcctcccaaagtactgggattacaggtgtgagccaccgtgcctggccacacattgtatgtttataggacgacactgatcaggaatgtaactggtggcctagaaagtaagtagataagcttcccttaggccaaagcctattaaatacaatattgtcaagaaaagagagcatggcattaagaggcatctgactgagcttcaggcctcagaaaaatccaacaagtcttcatgcttcattcctttgcctggaataatgtttctagcatttgttcaccataatttttctttattatttgagactcagttcaaatattgactcctgcaaaagcctcctacacccctcattctcccacagcgctcctctgtattgtccttttccctatttgtagttttctcctgagatcctgaagggagggtttgccctgcatgtattgggtcctcagtgggcttttacttaatgcatgagtatataaattgagtaaattagttaccaatttaacaagcctggttatttgtctcttttcttctgtgtagctttggcggtagattgactatagtaatagaagtgtacgattgttagggagaaccctgtggaagcagcctaggtagaaaggcacagctccccaggactgctgagtggggcctgattgcactccacatttccgtttttgctaaagatatcactataatagtatggtacaacaatggatctctcttacttgttccgaagattatgtagggtaaagtacatttttgttttatttttttgtagagaatgggggggtctcactttgttgctcaggctggtctcaaactcctggcttcaagtgaccctcctgtctca

SEQ ID NO: 2020 - DNA, 1056 bp, Homo sapiens
ttttatttgccaaattgggcaaccaacaaagaactctgtgaaaagttagatgtgtagatagaggagctcttattaagtaaggaaaagtgtgaagaagttcgtcaagcattgagcaaaccttttagtctgaagggaagaggagtgagggaagtgataacatgagtgtgttgaaattagtggtttgaactgactgaatctcttaaggtcgcctcgaggtctaacatgcttgttaaaaaaggttttcagtatgtattttttatctaatgccagtggggtcatacaaacttgtgtaactctgagttatgaccttttgaaatccttagaattgtgttgtaacaagacttaaaagatcttagaacagtccaagggagattcatatgattaagtcccaaccaacttacattaacaattaaattacctttgcttttgttgttgttgtttttaacagaaacaaggtctcactatgttgcccaggctggtctcaaactcctcagctcaagtaataatcctcctgccttggcctcccaaagtgctgggattacaggagggatccaccatccctggcctagctttgctttaacattatgttaagctatttcttttggttgcaaataacagaagcctactttggtttatttaggcataaaagaaaatatattcaaatgatattaatatatctcacagaatcttaggagaagatgaacattcaagctctgtaaagagtaaggattttagtaggaagagtttagatactttagatatttcaatataataaagttcccactcactttctttcaaagctcagaacctcagatttattataagacagagaattgaattttggccggaaggacaaggtcatatagtacagccctggcctggacattacatgcctgtccttggctctgagaatagttttcagagaaaaatgaatatgttaagaagggcaaagggaatgtctttactaattggtatttgtcaaacttttattaatgtacacaactttatagagggaatgttaggtctcatgtgaatattaaaaggatgaaaaaaatt

SEQ ID NO: 2021 - DNA, 1050 bp, Homo sapiens
tctgccgcttctcccttccttccttctctccatccatctgtcatggtgctagggctgtcagagtccactggctgcatgaaattaatatcagtagatacgagattgaaaagataagcaaattagaaagactataacctcaacattattttcaggttactgataccagacattattcagatttattagtgatcacatactgagttctaattaacaagtttcatgtgatagaagtcagaaggcagaagtggactgtttcttgtactatatttcttaatattccctcttacaaagggagtaacaataataagcagttactcgttattgtcatcactgctaggatctgtgaaaggaggagattcaggaaatgtaagcgtccacagagcagagttctttcttccttgtgccccagtggcagcaccttctatcaactttaattcctcagagaaagaggagaagggcattaggaaatgaacattaggcatgtaattataatgccatgtaaaggaatgtggtaggtttagttaccttttaacaataaaaggactaaatgataggatttgcttaaattacaatttttattgtacattgttttattgttcctcataggttagctcagactgagggggagaggttggaacaatgaatacctggagagtgacaactgtgtcaggtgctatcctgtgtgttttcagttccagaccgttatccatgtgtaatagtttctatcctgccgagcttcatttatagaatcaaattgaaagggaaaacacctgtacaacctggccaatcagacagcctcacatatctttttcttcatagtatcttttaactaggatattcctcttctaaaaaaaaaaaaacaaagtcttggctgggcacagtggctcacacctgtaatcccagcactttgggaggctgaggtgggcggatcacttgaggccaggagttcaagaccagtctggccaacatagtgagaccacatctctatttaaaaaggtaaaagtttcaggcggggcacggtggctcacgtctgtaatcccagcactttgg

SEQ ID NO: 2022 - DNA, 1035 bp, Homo sapiens
attagccagatgtggtggtacatgcctgtagttccagctacttgggaggctgaggcaggagaattgcttgaaccctggaggcagaggttgcagtgagccgagatcgcgccactgcactccagcctgggtgacagagcaggactctgtctcaaaaaagaaaaaaaaaaaccagactgggtaatgtcatttgttgaacccactttgaaggaagttactgttttaaaattaagataattaactccaaaagtatatcatctctggaatgggtaaactggaataataacttatattttacaaaataatcccagctaaataaaatgatgtgatataattagttgcttggtatgtgagctatttggaaagactgttaatattgttaatcttatttttaggtgtgctgattctcttccttactttttttgcctttttgcactgctggctcaatgcctttgctgagatgttacgctttggtgacaggatgttctataaggtagtatatacttagacttagctttctttttacattttattaacttcttcattattagtattttgacattgttggctaatgtcaccagcctttcacacaaacattgtgaaataattttcttttctacaagttttgccagtattttctgaaattcggttacagatataactagcataaccttgtgttttcttctgtctctaatatctgctcccttaacataagcacatggtttctgctggatcctgcaaggatatattggtgattccagtaggaaactgtttgttcagagcacaccatgagacttccctgagtgttcattcatttgaaatggaccgtctagttctgtaggaatgacctcagcaaattattccatttaagacaattgagcagttcatgagggaaataacttttccctctttagttttgaaaggtgttaattttgcttcagatagtatccttatgcttctaaagttggaattaagctatagaattagagtcagaatggctcatagcattctttaaccctacctaaagctctctttgag

SEQ ID NO: 2023 - DNA, 1802 bp, Homo sapiens
acatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaat

SEQ ID NO: 2024 - DNA, 1024 bp, Homo sapiens
gttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctcagcctcctgagtagctgggattacagggccacgcctggctaatttttgtatttttagtagagatggggtttcaccctgttggtcaggctggtctcaaactcctgaccttgtgatctgcccacctcagcctcccaaagtgctgggaagacaggcgttagccaccgtgcccggcctctgtttcctgttattagtgattttcctgcccaagattgcaacaacaaatatgtagaactacagactgtttagaatgctgagactgttctaagaaactttcaaaaacagtagcacttcaaggaatggtcactttctatgaaagaaactggtttgatagccataatcttattgctagctgcttttagcaaaagtcttttcttgaaaccaccacctatactctttaaacaaataaaaactaaaatctcttgctaatgtttcaggaagatttattttttctattttgctattgtggcgaaaattattttcagttataggatacttttttccttctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaattta

SEQ ID NO: 2025 - DNA, 1036 bp, Homo sapiens
ctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaaggaataaagtgaatgttttgtttgtttgtttgttttgagacggagtctcagtcaccaggctggagtgcagtgctgtgatctcagctcactgcaacctctgcctcctgggttcaagcgattctcctgcctcagcctcccgagtagctggcattacaggtgcctgccaccatgtccagctaatttttgtgtttttagtagagatggggtttcaccatgatggtcaggctggtctcgaactcctgacctcatgatccgccagcctcagcctcccatagtgctgggattataggcatgagccatgctcccggccaaagtgaatgttttgggtgaagtttatataaggatttgacttttgtatcattattaaagtttctgtcaggtaatacagtgttggccctctgttgaaataaaatgttacatatcgctgggtgtagtggctcatgcctttaatcccagtactttgggaggccaaggcaggaggattgcttgagctca

SEQ ID NO: 2026 - DNA, 1031 bp, Homo sapiens
tggcacatggcaggcatgtctccagtgtaaccttcaatagtcccttcctgcttggtccagcattgccctatatacatacacaacagacccagagaaaacagtatagcatcttcccttgaggggcttatcttgagaaagcacaaaacctgcgcacatgaagcacagaaggaaaaatagactaacatttgctgaattcctattatatgccccgaaaagaaaaagcatactcatttctttcaggtagaagatagcctagaattgtgacatgtcgcagtgtataaaatctagatgctgggggtgtggagtattccttccagttcctttccttgtgatgactttatttcactgacttaacaagtaactttaatcctcctcatctctgtcccttcaattatcttgggtaaactggactcttctgttgcctggctacccggcaggtagtcccaaatgtcaaagaaaagctggccaaccttagaatttggccatggacgtcactgtgggaggacaaataaatatagaacatgaagagattattcatttagagcccagcttctccaacatctcactgtgattcaccagatcaattaaaggcgcagtaattcagtgcgtcaggaaggctgttgtgaagagaacacatccagcctcccctggtccacaactcccaccccccattcctcaccctggcaactgattagatttgctcctcccttgcctggtatataagttaccactgcttgtttccagaaaaccaattaagaaaccataaattgtggtcgactagaaaggtcactgcacaagctataaatacaggcatttctaaactgtgagtggaagtctctgaagcacattatctcctgtacacccacatcttccaactgaggttttctttgataaaatgagagaacatgaagacggagatcaaaaaggcattccctgggttttcgttctgtagcctgctctcttgggtgtagctgggaattctgagcctccagcagcccagcccacactccagctttggttttggtttgttg

SEQ ID NO: 2027 - DNA, 1054 bp, Homo sapiens
ttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctctatgtgttataaacttaatgatttatcatctttaaaaaaagaaatccaagtattttccttgaacaattgtagcaactctggctaggagaaacaaaaatcaaagaactggagccatttgcaagtacattggttagaagtggaatagccgtaactttccattttatctcggcacttagggtttttaaaaatacagttaagttagatattcctgacttagcaaaagaatctccacagcagcttttcttttttttttttttaagtagacatgggatctcgctat

SEQ ID NO: 2028 - DNA, 1040 bp, Homo sapiens
tcctattaagtagttgtggtaatttagtaataaaaatatttatttcaatttatacatatttatttttcgatctgctactaagttggtaggctataaatactttttaggttgtggactgaactacttagtaaatggaactgttaggtatttttttggcctaggggttccatgaaaaaaataactggcatactgaggggtctgtgaactgagaaagtttaggaacctcttgaacttttgaccaggacacctatatatattttccatgttctgtgctcccaaaggttgattttttacatttatctttattttttatttttttaaataaaaagaatagatgtgtgttatacgtgtatgtgtatacatataatgaatcaaaagtttcacttttcaaagttttactttaaacagcctcatggccaggcgcggtggctcatgcctataatgccagcactttggaaggccgaggtaggcagatcatttgaggtcaggagttcaagaccaacctggccaacgtggtgaaacaccatctctactaaaaatacaaaaaaattagctcggcgtggtggcgcgcacctgtaatcccagttactcagtaggctaaggcaggagaatcacttgaacctgggaggtgtaggttgcagtgagccgagatcgcgtcactgcactccagccagggcgacagagagactgtgtctcaaaaataaaataaaataaaataaagcgctcactaccttcaatacacttgatatttgcaaatcaatcctatttagttccattaaaaaaatgctagctccaatccacgatattgttttgttttgttttaatctactaacgggtcatgactacacacttgataatatgatgctggttgactcctaacgtccagctttaatacggtttgtttctctggttagttataaatgaagttagactacgctttagcttttattttagatttgggttgtgggggatacacgtgcaggttcgttacatgggtatattgcatcatgctgaggtttgggcttctgttgaacctatca

SEQ ID NO: 2029 - DNA, 1030 bp, Homo sapiens
ttgtttgtttgttttgttttgttttgagatggagtctcgctctgttgcccagactggagtgcagtggcgtgatctcggctcactgcaagctctgcctctcgggttcatgccattctcctgcctcagcctcccacgtagctgggaccacaggtgcctgccaccacgtctggctaattttttggtatttttagtagagacagagtttcaccatgttagccaggatggtctcgatctcctgaccttgtgatccgcctgccttggcctcccaaagtgctgggattacaggcgtgagccactgtgcctggcctatttttttctgtttaaatggagctcataacagcttctaatgctgccgtttgttcatctgttcattgaaggttctgttgatctctagatgggtaagaagatacagtccttaaggaccacacaaccttgtggggagactgatacatatatgctatttgtaactctattacagcactcattatattgtatactatttgtttatgtgtgtctctcctctacttgattgtgagccataagtgctcagtgaatgttcattgaatgaatgaattatgtatgatatatgtatgtgtgtatgtatatataatgacaagaactatgaaaaatgaacagaggccaaccatggtagctcatgcctgtattcccagtgcattgggaggccaaggcaggaggattgcttgaggccaggatttgaagaacagcctgagcaacaggagagatctgtctcttaaaaaaataagataaattcgttggacatggtggcgcatgcctgtagtcctagcaacacaggaggctgaggcaggtggatcgcttgagcccacgagtttcaggctacagtgagccatgattgcaccactgtactccagcctgggtgacagagcaagaccgtgtctctaaaaaagaaaaaaaaagaaaaggaaaaaatgaagagaatactataggaaacagagaagtactaattgaagtactaattttattaagagccagtttgggaaagatttatagg

SEQ ID NO: 2030 - DNA, 1024 bp, Homo sapiens
tgatgtagaactattaatatatcataaattattccaatttttaaaatacattgggatgcaaaaatctgaaggaaggctgggcgcagtgtctcacgcctgtaatcgcagcactttgggaggctgaggcacgtcaatcacttgagctcaggagttcgagatcaacctggacatttgggagcttattaaaattcagattctgaattttaaactccatctctacaaaaaaaaatacaaaaattagctgggcatggtggtgtacatctgtagtcccagctatttgggaggctgaggtgggaggatcgcttgagcccaggaggcagaggttgcagttagctgagatcatgtcactgcactccagcctgggtgacagagtgagaccctgtctcaaaaaaaaaaaaaaaaatctgaaggaagatatatcaaaattttatataaaatgtctatatgtgatggaattttgattttaatttcattttttatattgtttctgttttcctagttttttgttgtaagcatgtaatactttaccatttaggagaaaatgcttttcagtcattgagaactttggtggttataatcaaaagttgacttatattgcagagtgtgtatgtgaaacctgaattctatcttgcgaattttgtctttattgtgaaacttattttatagacataaaactgtaaaacactgtggctgtttgagtacctatagtcctaaattttggttcaggtaaataattctttcctcatttttgcgtgtaaaatgcacaggatatattgcataatggtatgtcacatataaagtcagataattggctgggcatagtggctcacgcctgtaatcccagcactttgggaggctgaggtgtgtggatcacctggggtcaggagatcgagaccagcctggccaacatgtggaaactccatctctactaaaactacaaaaattagcccggcgtggtggcgcacgcctgtaatcccagcctctagggaggctgagggagaatctcttgaacccgtgaggtgga

SEQ ID NO: 2031 - DNA, 1023 bp, Homo sapiens
tttcctaaagaggagaggagaaaaagagggttaaatgttgagcggtgggattaggtgatggtgaaaagttgagaaagacagaaatacgtttgcatagaactgccacacttccttttttttttttttgaaagtttttacagtttattaatcctcatgaaaaatctgcagttatcacagataaagtcattgcagaatctttactcctgtttttagcctttgcagtccctctgactttcttcattctgttcttgtgttccttttgctgtttccttggggtctttttttctctcatacaggccatgtcttgaaagtctgtgtttggtctcatttttcattgcataatccaaggaatcagaaatcatgctgaagccatttatcttgtcaccagcaaaatgggttctgaatccaaatacaaagatgacattggtgtggctttgtacatttgggctagttttccccaagtttctgtctttggtactgttccctttccagggtgaaggacatctacgactgtttgtgctccctgaggtagttgattggtcatgaacttcctagtacaaatagttattgtgtcattcatgatggcagtcagtcctcaggcagccaggcagaatcaccacacttttttaatggcaaactatattttgcaaaactgaacactatgtttataaattttttcccttatatagatatagatgtaatggtgtgttccttgccacaaatgtcgggtgaaattaaactgaggctattgtgcctaataactgaatagattatttactattagacatgtaattaatttaccagtatattttctcttatacttacaaagtactactaccagttttttactccagcctattctttacattgatttaattgtgcagttatgtatgggttgctaattctttgataagttgagcccatcttaagatacaaatctttatactactttggttatcatctttattcattattttgttgtttttgacaaaacaaagttcagtgtatttcttaaagaatagt

SEQ ID NO: 2032 - DNA, 1027 bp, Homo sapiens
ccgcctcctggattcaagtgattctcatgcctcagcctcctgagtagctgggattacaggcatgtgccaccacgcccagctaatttttgtatttttagtagaaatggggttttgccatgttggccaggatggtcttgaactcctggcctcaagcgatccgcctgccttagcctcccaaagttttgggattataggcgtgagccactcacccaggcaataattacatttttaaaaagtattgtgtttcatgtggcgttatgtaatactgttgtcagaagcatagtttgaaatgaagcacagggacccctaaaacttatgaacactgatcttggattgtatttatccagttttgtggtaggctaattctcatgtatgtactgtggcagtgagctagatagagagtcattaaatatgctaaagctgtattaatagtttatgtagtgaaattcctttttttttaaccaatgaccgtgtgtaactgttccagaaagttagaatttagaaataaccactcagcatattcagatgccaacatgtataaattactatccagtgtattcatggttgcttttgattcagaaaatcaggctgaaattgaagagaaacctgttctctcattttacataagaacatcaagtttcttataaatagattgagcagtatacgtaaaaccctttaaatattttaggtcaactgtataaggttaataacaaggtgcagaaacatttctaaagtaaacagcacacattaaaactcacctttttataattgatgtttttattaaaatgatacttccgtttaaacttataaattatagccctttttaaagaaactctaaatggaaagtcttttattataaatacaataaaatagcatcacagaaagctgggaaaatagaaaacagataaaaccactatccagacttaaataaagaactagtattactttgtatgtttccttacattcattttaaaattgtaatagtaggttatggtaatcactgtttatttaaatttttttgtatatg

SEQ ID NO: 2033 - DNA, 1035 bp, Homo sapiens
atccaacttctttgactcctgatgtctaacttattgcgtccactttcttgctacccagcttctgagctcccccattcccgttaatagttttagcataactttatgtttaaaagcatgttactttttgcttaaaatttggcatttcttttccttactctttatagcatattgtgttaactacctggaaaactccaggtttcatatctcaccttgaaaactgaagatccagcttaacaaacactttccttggctagcagagttaattgctgcttcatctataccctactgaactttttaaatctttgttttagtatttgtgatgtcttattttagctgtttgtttgtcatccctgctagatcttgagatcttaaagtgtaaggattaagcctttttatttgtttttaatttggagacagggtcttgctttttcacacaggctagagtgcagtggcacgatcatagcttactgcagcctcaacctcttggactcaagtgatcctcccacctcagcctcctaagtagctgtgactataggcatgcaccaccacgcctggctaattttattttgttttttatttttttggagatgaggagcttgctatgttgcccaggctggtcttgaacttctggcctcaagtgattgattcttctgcctcagcctcccaagtagctaggattacaggtgtgagctaccatgcccagctcaggattaactggattaagtatattcatttttgtctcctgtttctctaccatcaacatatcacctgctataaaattggcattctaaatacttgaatttaaagctcttggatttttattcatcaatatcttttatattataacttcccttgtattcctattactaccagcttagtttaggccccaatagcctcacactttgcatttgtaatagcctatattctaaggcatagaatctgtgctctagtctttcttccttcattctaatgacatgcttttcaacttattattaccctggttaccccccttcagatgacttattttaacccaat

SEQ ID NO: 2034 - DNA, 1033 bp, Homo sapiens
cataaaatattttattcgctttcagagatgtattttaagactcatatatggctccaattttattgctgtagagtgtctattttagaagactttgcttcatgctataatgagtgaatcatagtatatgtacactgtagagggaagagttcagtgctagtttaatcaagctactccctttccattgtatttagggcagggtttgtgccttgcttgttcaccactgtaattctagcaattagaggaatattcatagtcattcattcagcatagtgattatattaatgaataaatgcctaaatcacaactttttaaagctaatgttgatagtttttttatatgttgttcttttgaattatttagctggtttacaaagtacttttccttcctctaatgtttttgtggatcaaaacttctagtgtctcatcagataagggaagatctcagaaaactccaacttctcccctgtcaccaagttcccagaaatcattgcagtttgacgttgcaggaacttcttcagaaagatctaagtcgtcagtaatgcctccaactataacaggatttaagcctaatgcacctctcactgatctgaacccggcagccagcagaacaacgacagagaacatggctccaataccaggtaagtagattcatgcaattgtaatttttagaatacgatatgaaatttttttctctcaacattccttttctttgtttgagttgagtcatagagaaatattatttcaagtgaatatgattacttttcaagtattaaaaactgcaagaaattaaatattgaaaagcacgagaggttcagtaatgttgacttttttcccatcttgtcagccagcattagtcaaaacatatctgaaaaatatgtcccatatgtgcactcctgtttatatgtatatgcatgtatacacacatgtacgcatgcacacacatagaagtaaagtacattgtataggcataccttgttttattgtgcttggctttattgcatttcacagatactgcggggtttttttgtcttttt

SEQ ID NO: 2035 - DNA, 1038 bp, Homo sapiens
attctaagcccactgttgagacctactgcccagaaaaataaaagatttttttcaaagtgtttttttcagaatttgaaaaaatatttattcctgcttattgacaatgcacctggtcatccaagagctctgatggtcataaaaaaggagattaatgtttttatgtcccctaacacaaagtctattctgtacccatggatcaagtagtaatttcaacttttaagtcttattatttaagaaatgcattgtgtaaggctatagctgccatagatagtgattcctctgctgatttgggcaaagtaaattgatcaccttctggaaaggattcactgttctagatgccattaagaacagttgtgattcgtggaaggagatcaaactatgagcattaacaggagcttggaagaagttgattccagccctcgtggatgactttgaggggttcagaacttcagtggaggaaataactgcagatacggtggaaatagcaagagaactagaattataattggatcctgaagatgttactgaattgctgcagtctcatgacaaaagttgaatgaatgagtagttgcttcttatgcatgagcaaagaaagtggtttcttgagatggaatctactcctagtgaaatgacagtaattatgtaaatattacataaactttaattgataaagcagtggcagggtttgagaggattatctccagttttgaaagaggttctacagaaagtgggtcaaatgctaccaaacagcattacatgctccagagaaatcttttgtgaaagcaagagtcaatcgatgcagtaaacttcattattgtcttattttaagaagttgccacagtcactccaacctttagcaaccaccatgatcagtcagtagctatcaacattgaggtacgaccttccaccagcaaaaagattaggacttgctgaaggctaagatgatcattagcatttttttagcaatacagtatttttaaattaaagtatgtactttttttagacataatgctattgcacacttactagactacagta

SEQ ID NO: 2036 - DNA, 1026 bp, Homo sapiens
ggtaagcctcagtctacttctggtctgcattatccctaggttggggctctccagggattcactggaaacccagataatactttttactcagcacaagagactggggatttctgccctgcttttgagacttttctgggttaactccttagccctctatgtgctacttcagaacttgacaactgctttgaggagaatgtgagtttgagatctcctgagtctcctagttttgtcactgtggctctgtgtggatggttagagtgttgactggtgtaaccactttgagttgagagcaattgccactacctggttcagttgaggacatatataatatatgactcagcagttctgtcttggtatatatcctaaaaaagctttcacatatgttcaagggaaaatgaaaacaacttaatttcttcaataaaagaatagatgaaataaaacatattcttgcaagaaagtataatactgcaggaaactgaatgtgttagatatcaacactgtctgtagagatttctgaaatgatagtaattttctttatctgtgttgtccaatactgtagctactagccacatgtagctagaagctgtcatattggacagtgtagcatgagatcttcatttatcaaaaaccataatgttctttttaatagaaaagcaagatgcaaagaatatatacagtattataccagtcatataaatttttttaaagtaaccaattagtagtatatgttctgtggaaccactcatgcatcaaaagcaaaaaaccacatatagaaatgatacacttctggggaagagaggaaggaggaagagattggcatggagtttggtttcatctgtatttatctatttatagataataacatatttgaaacaaatgtgcaaactgttaaatatgtttaatgccagtcgtagggatatgagtgactactttttctttttgtaatacttaagaattttttaagtaaatatgcaaaatatactctttgatccaattggttacccctgaaaagttgccttatatgtt

SEQ ID NO: 2037 - DNA, 1047 bp, Homo sapiens
ggaataaaatgatttaaggtactaagtttttgtaagttttgttttgggaagagtaaaaagtagtgttttagtttagctaggtagtctcactagtttggggatacatagcattgcataaggattcactaataaagcagcaataattttcttcaaggtcagtacaaatagagcagtgattcttaactttttggggatcttgagttcgcttgtaaattagatgaatgttttggaaccttgcctcagaaaaatgtatgtacacacatatatacaactttacatgcaattccagggtatccatggactccttggtattccaatggagaaacaaatgataatggaagcacagtaacatcctaaacaaatatagaactgtaaatgtttcttctgtgaaggtattaagattttgttttcgatatcttttataatgaaaggatttttagacctaggagttccacttaaaatttagtttataattttattcaaattatagaatgattttataatctgttagaatgcaggcgacaattatatcagctcggtgggcaacaaaaggtctcatttaacgtcacatggtctagcagtcacacggtctggcagtcttttgaggtacaaaataagtggaaatattccaacggagaaagagtcataaaatgttaaaattggaagggctcttagggaagccataaaataaagtccctttgttttacatgaagaaattgaggcccacagagtttatgtaactttcctcaggtcacacacacacagcagaatggcagagctgaaactagaactctgttctccagagttcagctagctaaagtcaaagttaagttagcgtatctgctttcaacctcatagatttttttaaaacctaaattgatgacttaaagttatcttcattagaaactgatccttctaaatagtattttgttgaaattagcaaagtgctagatggctaattactggagttgaatagctgtacagagcaagttcagagtgtgaaagtgtgactttaaaagtgaattaaggccaggtgccgtggctcac

SEQ ID NO: 2038 - DNA, 1064 bp, Homo sapiens
cagagcacgactccatctcaaaaaaaaaaaaaaaaaaaaagtgaataaagccgggcacggtggctcatacctgtaatcccactactttgggaggccgaggagggtggatcacctgaggtcaggagttgaagaccagcctggcccacatggtaaaaccccatctctactaaaaatccaaaaaattagccgggcgtggtgatgcgcgcctgtaatcccagctactcaagaggctgaggcaggagaatctcttgaacccgggagacggagattgtagtgagctgaggtcgcaccattgcactctagtctgggcaacacgagtgaaactccatctcaaaaaaaaaaaaaaaaaaatttaaaaagtgaattaagctgtgcgcggtggctcaggcctgtaatcccagcactttgggaggccaaggcagatggatcacctgaggtcaggagttcaagaccagcctggccaacatggtgaaaccctgtctctactaaaaaaataaatacaaaaattagccgggcatggtggcaggtgcctttaaccccagctacttcagagactgaggcaagagagtcgctgaacctgggaggtggaggttgaagtgaactgagatggtgccactgcactccagcctgggcaacagagcaagactccgtctcaaaaaaaaaagagcgaattaagtactcattaattccttaagttcaaacattttagaaacataatgatttccatactagactaaatctgttgtatatcttattcttgtccagtgttccgttaccatcagaggacttgttggggaaatgccttgacatcaatcaaaagcattttgtattagtcggcatttatgtctccatcattcacaatttttatttctttcctgtgtagcatcttgaaggattattaattctattgtgaagtaatgctctttcatctcaactttattcaacgtttaaagagcactcctataaggaatgtatttatatttacactccttatataaggatgtatttatatttaataaggaacatgtttatggaaagaagttctaactttaagttaaactttt

SEQ ID NO: 2039 - DNA, 1028 bp, Homo sapiens
cagccctgctgttgaatatgtaccatccgagtctataggacaggagcagccagggagtccagatcacagtatacttactgaagaaatgatttgttcacaggaactagaatcttctacctctcctagtaaacatgtaagttaatgtatatttatatcttaaagattctctagaaaaaaaactgaaaggtatgttagcagttatattattgtaattaatgacagtgttaactgtcaccatacttgtaacatataggatataacatttgaatagaaataaagcttttcatttacaaatatatgaattttggcattagtgaaggttataaaatcatttgctatcaagtctgtgaatattgagggaataggaacttctaaagtctttatgaaaaacagtttgtaggaacaacacaagttctttctgaaatttgttttttcacataacaaaaacagtaagatcttaaaccacaccagagtacctttactgtaactgaattaataacttatgtataactcatagaataaaagtaatggtttagcctcttaaaggcagctctgaaacagttattgattttaaattaagatgatggccattattaaactaagattttctacattgtccttaatcgtgtactttatagaaaaaaaaactagctggtaaaaactcaagatagaaacttaactctttttttttttaatatagcaaataattagcataacaatattaaatatttagtatactgtggtatactaaagtatacacagatgttgttaaagcctctttatgtttaaaaaaagatctgcccaaattcagaatggaatattctttgttggagtcttccatttttattgtgatagaaagaattaattttgtttccccattgaaaagtcaatcaggttcatttgtgttacagcacctagaagatctagaagaaaaacatattttattcattgaagagcctattaaatattatgttaaaaaatatttcaatgtccttgtgcacatacttgaaatcagcatttttaggtta

SEQ ID NO: 2040 - DNA, 1372 bp, Homo sapiens
gtctcggcctcccaaagtgctgggattacaggcgtgagccactgcacccggcccactgtactgctttttgaattcagttttagttttgagagtaaacatttagtaaacgaaacatgaaaattgttattctttgggttttttttggtaattaattatgtgttgtacctttttgttttccatgtgtcagacaattataaatcatggaattttcctacacccatgtttacagctcttctttcttctttgagtaactatataatatttcaaagagtagatgtaccataatttatttaactgtttccctagtgatggctatttagattttcttaaatatttcacaattgcaaataatgctataataaacatctttatttaaagatttacacacacatatgtatgcagtcatgcatcacttaacgtccaggatatgctctgagaaatgtgtcattaagcaatttcatcattatatgaactgcgtagaatgaacttaggcaaacctagattgtgtagccttactgcactctcaggacatatggtatagcctcttgctcctaggctgtaatacctgtacagtatattactatactgaatgctatatgcagttgtaacacaatgttaagtatttgtatatctaaacatagaaaaggtgtagtaaaaatattatgactcacatgtgtatgtgatatcatatatcatttatgtgtgtgtttatcatgtataataaaaattctttttgtatatttcagtgtggaatagattcttaggaatagaatcattgagtcaggccagttgaagaaagttgtctcatatttctctgtggaaatttactaatgtttttatatatttgcttttatgtacgttggtgaaaaattacttccaagagaataacatgtcagtagacataaacttgaatacttggaaacatgggttcttatcctggatctcttacttaccggtgactttcttcaagtttctttgccaatactggattatctttttcatttgttagcaatggaataatgtttcaaccatccttgcatgagttatgcaccaaggattaataataacatttgtaagatactgttttattggtgacacttatttaagtaagaataaatggttttagaaaagtagctctgaggtttctaaactacagattcactacctattcaagatgacattatttatattcagtatttgtagaagtggtagatattaatgtagtagagttataatacctttacttaaatgatgggagagtttatcaaccaagctaatataatcagtgtgtgtcaaataatcagaaactcccgcctcagcctcctgagtagctgggactacaggcgcatgctgccacacctggctaattttt

SEQ ID NO: 2041 - DNA, 1037 bp, Homo sapiens
gacttaaaaactattaaattatgtattaataactaaggcaaaagacagttaaatatgattatcttgttaccagaagtaatttcttgcagaatatccaaatttcatcaatctaaaaatttctcaacttccagctgcatgtcttaccaagacagcgtatctcaagatttatttataatttcaagtagtacaattagaaagtgaaaataaataggaggaaccaagccaaaaataaagtgtatgtggcgggcggcggggagggtgggaattatagggatacattttagtaataaatcttcttccgaagctcatattttaattattagattggctttatttaaatggaatattacattacagctttttattagtagttactgagttaacattattcttaagtcaaaattataaataaaagattttgtatctctttcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagaggttagacataggaagaagggggtttagtatcaaggctaatgtgtatgtgacgtctaaaatgtttttaatgttgttaataaagtaatggattaggattcttcattattagtgtggtgccacattttattctcttaaaaaaaatctgagggtatccaaggacattcttgcttaaaacattaaattttattttatttatttatttttgagatggaatctcgctctgtcgcctaggctggagtgcagtggcgcgatctctgctcactgcaagatccgccccctgggttcacgccattctcctgcctcagccccctgagtagctgggactacaggcgtccgccactacgcccggctaattttttgtatatttagtagagacagtgtttcactgtgttagcgaggatggtctcgatctcctgacctcgtgatccccctgcctcggcctc

SEQ ID NO: 2042 - DNA, 1054 bp, Homo sapiens
ttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctca

SEQ ID NO: 2043 - DNA, 1032 bp, Homo sapiens
cgggttcaagcaattctcctgtctcagtctccggagtagctgggattagaggcgcatgccaccatgcctggctaatttttgtatttttagtagagatggggtttcaccatgttggccaggctggtctcaagctcctgacctcaggtgatccacctgtctcggcctcccaaagtgctgggattacaggcgggagccaccgcacctggccaaccccccacattttaacaagactataacaagggctatgggaattattagccatgttttaagtttttactaaaagaatgagcttattttgctctatgattttgttacacttttcacccattattggttatttttctaagtcttttacatgtttaattatgaaatatttttaaagtataaaaaagaatagaaaataatataggtgcattgtttctgcatccttttccttcattctgagctcggttgcatctacctaaagtacacacttagtatttcattaacttcaggcctttaatgtaaactctcagtctttaaaatgtctttatttcagctcttacttttgagttatattttagctgtatatagaattttaagttgatagctctttttacttaagcagtttgaagatatctcattataattttgaagcagcatcattgtctgcggtgaatacccagggttcgtcgtctcgagctgagaaaattaacgacacagacacacatacatgaagtgggttaaggagtggaaagtttaataggcagaagaaatgagagaggagagcagctctctcttttatgaaagagaggtgttccgaaaaaggaaaagcggtggaccgcagcagattttataggcaggctttaagaggtggtatctgatttacatagggcccacagattggttccaccaggtgtgatgtttactggtgtgtggggaaggctggtcaccccaccctaatcttattatgcaaatagattttctacttggccagtgccatcttgcctgctccttactgtgcatgtggcaaagagaagagaagatggagct

SEQ ID NO: 2044 - DNA, 1023 bp, Homo sapiens
gaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaatttcatgtcaggtctccattttttccctcctgagccaacttcagaaaattagtccccataaaatacatctgattgcttatttagtcatagggtgctgatgcttggacagtacaatcaggtaagctgtggataagagctatttacctgcacataaatgccatcagcacatacatttgagcagcctgggctttgctcccacactcattgattcagcagatagccactgagcaactttgtgttctgagtactgtgctgagtgctggaaacatagcaaaaaagacagacatggtccctgatctcaagaaacttaatgtctaatgaaagccaccaaaagatattttgaaaacctgtgtgacaagttctaacaagtgctgcacaggaagcatacataagatttgagaatatcttaataaaaggacccaacaagggtagagtgagtcag

SEQ ID NO: 2045 - DNA, 1032 bp, Homo sapiens
tgagttgaagagcacattaaagatcttggtaaccagtgcgtggggctgcctccccgcctgtgtgcagagggtgcactcactgtcaccacggtactttgctcagatatgtgctgctccctacgtgtgtgtgcgtgtgtgagtgtgtgtatgagtgtgtgtgtgacagtgtgtgtgagagtgtgtgtgggtgagtgttgtgtgagtgtgagagtgtgagtgttgtgtgtgagtgtgagtgagcgtgtgaatgtgtgttgactacaggaaggcaggggcagcaggtgacatgggtgcccggcaagtccttgatgtttgggtggaaggacagacctctggtccttcctctgagctttttgtgtactgctcttctttctcacaatcttcctgttgctttcccacctctgaccctcctctagtttccttttctctggcattcatgcaattccattccctctagccacatcctttcccagtgggcaacaggagtttgcctctattttccttcctctatgatgtcctggccaagcaccacagcagctgttacaggaccctgggtggagtgaatttccctgtgtttgtgtgtgtgtgtgtgtgtgtgtgtgcgcgcgtgggttgacatatgtacccgggtgcaaatgtgaacataatgtgtgtgtgaagagggcaggaagcggcaggtggcagggcctagccttggggtcgggtgagctgccctgcttctgtgatgaggtgtgtgcagatgtgtatgcctgcacctttggaaagccaagaggccacgcctccgcttgcccgtctcggggcagggtaggtgctggatgtccgagtcagacctcagaccccactggtttctggctggtccagtgtggcggctcagggaagcctgtggggtatgagcaaagcctggcagggccactgacccaggacttcatcgccagagggctgccttggaccccccagtgcttcctcagggccctgtctgatttttggaccctgagtggctggctatggtttggaaagagagggtggagagga

SEQ ID NO: 2046 - DNA, 1044 bp, Homo sapiens
gtccttcatatttggtccagttggttagacttctggttctctgtgtagcagccgggttcacagttttacctcgtgtggggccagggaattctaggcatgaccgtgtgtctcattattgcctgtcgcagggcaagtcatgtgacctgccaggctttggccttctcacctgtgactctggctattctaagatctgggaatggggacagtgtctccatcacagacacacccctgtaggatgccctgtattctagatacactggctctgactggagatggggtggagggtgatctgcagggctgggctgggccgggggagccttgtgggccaaggaggtgctgcatgcggctccctcggcaagggtcccgctggctgtgctccaggggaaaaggtaatgaggagccacttccacttcccttcagtataaatcccacaatcaggaaaattgcttcaattgctaaaaaacgctggtggggaagtccacttatttttcatttttcttgtgcacttgccaccctcatgcatgaatcactgtcggtatgtagattaaatttatacccccgttatctttcatgtctctggtgtgctggtgtcagctgggcctccggtgactgaaagccccctgcctgctttttagtgggagagagtgtggcccctgtggaggaggctgctgaagggtcttccctctgttccggggtctcctctcagccctcctctccttggatctctggttaggacacattctccagatttgcgtggtttgttgggagggttcgcaacaagcatgatgaaagccttgtttcattttaattaattaatttagagacagggtctcgctctgttgcccaggctggagtgcagtggcgtgatcttggctcactgtagcctcaacctccctgggctcaggtgatcctcccatctcagcctcccaggtagctgggactacaggtgcacaccactacacccggctaattttttgcattttttgtagaggcagggattcaccatattgcccaggctgggctcaagtgatcctcctgcctcag

SEQ ID NO: 2047 - DNA, 1052 bp, Homo sapiens
cttctagaggcaaccattatctgcagtgcctggctggtcgactttagagtaggaagctcttgaatccaggagcaaattagttaaaaccccaagttccagtggtaactggtataagcaaaatggaaactgaggggctatggaggaatctctgtttgttggaacgtaatgaaaccatggaggaaataccagatttaagggctaagaagctggcccgatgggtaaatcagtgttgggagtcaggttcttggcccttcaaggacttgctatgcaacctcaggcaaattcctctcagtctttgtgctttctctttcttgtctcatctgacagttatgaatataacgtaaaataaagatcaactatcattgataacactgttcctgcaaatgaatactgtgaaacatcagggaaagaggaaaaaattaagccacaagaaaaccatttggcagtgtccttaaactttttttgggggggggcagtgtaaaacatgaaacctagtaagataattgggccattagatcttcatcattaaactcactttgcaaggaagtgtaagaaatctgtaaaacaaaagacattcctatctcagaagctcaaactggtgatttccaactgcctctttacaggagggggctcaaggcttctgatgagcaaaggctgtgtgttgtatgacagtccactctctgcacctacacttccacgtgccacgactgacaacttggttataaccatgaaaataatgaccatacctccccagccagcagggtctggaaggcctgaggaggctcatttttaaacactgcactttaaaaattggaaaccgtgagatgaagaaaaattcaattaagcggaaatgagttttgttttattgcctgctgctgaagggctctgggcatgctgaaagctaaatgaaaagcacatcactggctctcttctttcttggattggtcaattggccctttttgcagtagttgctccaactgttctaaacagtgagtgactggagccaaaaagagagagctcagcaaagccatcccatccacactctgcttggt

SEQ ID NO: 2048 - DNA, 1034 bp, Homo sapiens
ttagcttcttagtttggattagtgctgatccatttcttaaaggttttatgaagcataaatatcaaaatggaaaaatatttgcacagttctttgtaaatataaacgtcttgtgtggattattgttgctacagtattaatattaactgcagtaacaacactgctgcttcccagacaggcggtagaaagcagctgtaggccaacaggagccagactgaagagatccagggaggtgcctccagcacgtacggcccacaaggggcggagtcttaagaagcgtacccaagccccaccccttacagcacccccttcgtcagggcggtgtaggcggttaccatggcgatgacgtccagagggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggtaccggcacggctggggtgtgggaggactcggaggggccaccatctcgccagtcctgacgtccaccgccgccttccgcttcagctggctccctgtgcccgggcagactttgacccgctgccgcggggagccactgcggcatccccgccgcggccggccgcctcccggctccgctgtccttcccctcccccgcagccccgctgccgccggggtaacggatatgcaggcggagggccgggaggaaaggcgctgcccgggccggggccggggccggggaacggtgggagggtgagctgcaggtgggggagtcacggtgcgagggcagccccgggtcgcggctgttccgcgctaatccccttctccccactcgccctgacctctcgtccccaccctgggcgagcgccccctcgccaa

SEQ ID NO: 2049 - DNA, 1057 bp, Homo sapiens
gcatttcttcttttgagaaatgtctgttcagatctttggtccatttcttaattggattattagattttttttcctatagagttattataggaaatattttttcccattctgtgggatgtctcttcattttgttgattgtttcctttgctgtgcagaagatttttaacttgatgtgatcccatttgtccattttgctttggttgcctgtgcttgtggggtattcaagaaatcttagcctagttcagtgtcctggagactttcctcagtgttttcttttagtagtttcataggttgaggttttagatttaagcctttaatccacttttatttgatttttgtatatggtgagagatggggtctagttttgttcttctgcatgggtatatccagttttcccagtaccacttactgaagagattgtcctttctccaatgtatgttcttggcacctttgttgaaaatgagttcagtttagatgtatggatttgtttctggattccttattcttttccattgttctgtgtgtctgtttttatgctagtaccatgctattttggtcactatagctctgtagtataatttgaagtcaggtgatgtgattcctccagttttctttttgctcaggattgctttggctattctgagtcttttatggtttcatataaattttaggattttttttctatttctgtgaagaatgtcattgatattttgatagagattgcattgaatctgtagattgctttgggtaatatggacattttaacaatattgattcttccaatccatgaacatggaatatctttccattttttgcatgtgtgtcctctttagtttctttcatcaatgttttatagttttcattgtagagatctatcacttctttggttaattcctaggtatttaattttatttgtagctattgtaaatgggattgctttcttgatttctttttcagatcgtttgctgttgacatacagaaatgctactgatttttgcatgtcgattttgtatcctgcaactttactgcatttgtttagcaattctaatagtctttt

SEQ ID NO: 2050 - DNA, 1206 bp, Homo sapiens
gggaatgctgctaaaaattctataatgcgcagagcagcccccacagcaaaaaaattatctagcccaaaatgctaatgttactgagtttgaggaatcctgctgtaggccaatatgggcatcaccagtctttagatggtatttcaagctttgaagctatggatatcctcatccactgaactgattttaccattttgatagatacagagaactatttctcattcttgttccccaatgacttattgagagattaaactgcagccatccagattacctaaatatggttgttagctaatctagagtgtggttttgggggaaaaaacaaaaacaaaaacaaactattactataaagtaaaccgatactgtctttatagtcctaaacccttagggaagactttccagatcatcactgaaaaatgctttaggacattggtctgggaaaagatttcatgagtaagaactcaaaatcacaggcaacaaaagaaaaaaaataaatgggtttatgtcaaactacaaagcttctggacagcaaaggaaacagagtgaaaaaagaacctataaaatgagagaaaatatctggacactactcacactacaggggattaatatctagaatatacaaggaactcaaacatcttaacagcaaaaaaaaattgatttaaaaatgggcaagtgatctgaacagacatttctcaaaagacgtacaagtggctaacaaataaagaaaatgcttaacatcactcatcatcaaagaaatacaaatcaaaaccacagtgaggtatcatctcaccccagttaggctgttatcaaaacgacaaaaaacaaaacaaaacaaaacaaaaacaataaaaatgctagtaaggatgcagagaaaaaagaagtcttatactcggtgggaatgtaaactagtacagctactatggagaacagtatggagattcctcaaataactacaaatagaacctttttttttttttttttttttttttgtgaggtggagtctcgctctgtcgccagactgggatgcagtggtgcgatcttgggtcattgcaacctctgcctcccgggttcaagcgattctcctgtctcagcctcccgagtagctgggactacaggcacatgccccacacccagctaatttttgtatttttagtagagacggggtttcaccatgttggccaggatggtctcgatcttttgacctcgtga

SEQ ID NO: 2051 - DNA, 1026 bp, Homo sapiens
aacaatatgtcgtctttctataagactataatttccacttaaggaaaactatgatatgattcactcttgacatggcaaaaaaaagttaggttaataaatttacagcaaagaagaatttttaacaatacaaaagtaacacaatatattaggtagatatcctcagaagcagtttattcgcaatggccatgaaagaatcttcctaaaagtagtagtaagagaatgactaatggagaaaaagggatttgaactggatcttgaagcatggttaacatttagatagccttaggagagggccttctaagcacagagaagcaacaagacgaaaccaaaagaatgcacatttctaagacattcagggaagatttagtagaacacttaaaatgaagcatggagggttatcactggagaatagttagctgtatggataaagccagcttcccaaggagcttaaataatttaaaaagttggactttatttggtagactagtgtattctaagatttggagttactagtttaatgcagactggatttatagaccttcgtgggttccttgttctgattcagaagtatccataaaaatataggctttgtgctgtcttgaactgattaagtctaaggaatgcaggcttcaggtatggtcccattgagtttccggctctactttttaaaatgattcttacagctgtgtcattatccatgttggagttctccaggtatctgtcagcaacaattagagccatatgctcccttcttcaggaatactggaaaaaatagatgcatgattttcaattagctgtatgacccagaatatgcatagaaatactgtctttttcatgtgaaaattcacataacacaaaataaccattttgattgcatttagtacattcactgttgtacaacatctacatctatcaagacacagaagctttttttttttttccccgaggcagagtctcgcactgtcacccaggctggagtgcagtggcatgatctctgctcactgcaacctccgccttccgagttca

SEQ ID NO: 2052 - DNA, 1040 bp, Homo sapiens
tcagatgatcagcccacctcagcctcccaaagtgctgggattacaggtgtaagtcaccgtacccggctgagaagttgttttaatgaaagcttcttgagctatgtatgtggctctcaattcttggaggtagccatcaagggagtggacaatccctagagtggaatgtcatataatagatagatccatgtatcagataaactttgggctatatcagctacagagttttggggggttttttgtttgtttgttggagccagggtctcactctgtcacccaggctggagttcagtggcgctgcctcgaactactgggcacaagtgatacaagtgggtgccaccatgcctggctagttttttttttctttttgtagtgatgggtctcactatgttgcccagactggtcttgaactcctcgcctcaggtgatcctcctgcctcagccttgcagagttctaggattataaacatgagccactgcatggcctcagaatatttaccgtctaattttcaagcctgtctgatcttgtcaaactaacctgttttggtatcatcacttttctttattgtttacctattttgtattttattgatatccactctttattatttccttgctctgtgctctttgggtttaatttatcctgccttttctggtttttaaaagtataagcttttgtctctgctaaaatctctgttgctttatttttggctcttaccatcagccctctgcaggtataaatttcaggttctaaacttcacacctgattgtcaaattggtaatgttctaggctaagtgtcttcagaaagtaagttcacctctcttaagattcttcccctctggaattaggtcttttacctctagtttttgctctttcagcagctatttgctaccttgaaacaaatgacttaggtatattattcagttttctgtttgtttaacttgtaggtggtagttggcctccaggtcctccttcttgcctggaagtgaaccctccttaaatggattatttttcaatattcagtaatctgctcgtcttctaga

SEQ ID NO: 2053 - DNA, 1030 bp, Homo sapiens
gggattataatatacatacttcactttaaacagtctatttaggattaatattttacaattttgtatagaacatagaaccctttacaccaaataggtctctttccctttcctcttaagctgtgattgtcttatgttgacatccacatacattgaaaactccattagacaagattatactttttgctttcagttgacaaagattttatagaactcaagaagaatagttcattatatatatatacccagatatttgctgcttctgttgattttccttcattcctgatgaggttttgagtttcctgattattatttctcagctatccaaagaaattcctttaacaatttttttagagtagtctactggctacaaattctcttagattttctttctctgagattatctttatttcaccttcattcctgaaggatgttttcaatggatatgtattctgggctgacagttcttttcttgttgcactttaaaaattttgatctacctccatgtctggacattttgatgaaaatttcacagttgttaaaataagcaatgagttgtttttctctggctactttcaagagttaattttgtctttagtattttacagtttgattatgatccatctggccttggacttctttggatttatctcatttggagtttactcagcttcttgaatatgtaggtttatgtctttcaccaaatttgggatgtttttaactattatgtcttaagattttttatgtactgcattctatttcttttcctttgggaacttggttgacatgaatgttagactttttgcagtccctcaagtcactgagatcctccctcttcctctccccatcatttattcctctgtggcttagattgaataatttctgttgatctgtcttcaggtgtactcactctttgctctgtcatctctattctgtttgctggacccatttggtgagtttttattttatttgttaaatttttcagttctaacttttttatttagaactttttttaatttagaatttattttta

SEQ ID NO: 2054 - DNA, 1036 bp, Homo sapiens
ggcttctgtgttttgtgtaatattaagaaggccttccccatgtggaattattgaaatgttctattttttatagtattttatatcatctctttaactccattttgagtttcttctaaattgatggctggttcacccagccctattgatgtataattcattcttttctcactgagatttgaagcctcctttattgtaatctaaatttgtatacattatgcagatttacttctagactctgtattctgttctttttgctgtgtttttctcatttatttactaaaagtatacttttaattacagtagtttaccaagtcttttgaaatctgagaaaacaaaaacattgtccttcatttagcttattttgcacacaattcttgctgttttatttatattttttcgcctgttagtttttttcgtgtgtgtgtgtttgtgtgtgtgtgtgtgtgtgtgtgtgtgtgtgtgttactataaccttactctaccttcttctgattaatggctattttatgtctgaactagaaaactaaacaaactgccagtattttagataaaacaatctctctctctcttttttgtttccttttgagatggagtcttgctctgtcacccaggctggagtccagtggtgggatctcagctcactgcaacctccacctcctcccaggttcaagcaattctcctgcctcagcctcccgagtagctaggattacaggcacgagccaccatgcccaactaatttttgtatttttagcagagacaggacagggtttcaccatgttggtcaggctggtctcgaactcctgacctcaggtgatccctctgccttggtctcccaaaatgctgggattacaggcatgagccaccacacccagccagataaaacaatctttaaagcaaagaaataaattcttaggagactgattcatgggtagaatattcatgctttaacacatgaagtttatgtatattttagtttctcagaggcctggattttttgtttctgaattcttggtgatactataaatagttgatgttg

SEQ ID NO: 2055 - DNA, 1076 bp, Homo sapiens
atatacagataaatgtttgttttatatatgtttgtatgcatctatatgtgtgtgactacacaatatatttaaataatttaagatattttttcatgaaacagtacatctttagtacttgtagtatattgttttctatatttttctattctatttgattttttaaatgctaattatgatccactaaattggttttatgacctcatattgggttgcaaccttcagtttgaaacatgatttctttaagttaggtcgcttctcaaaaataattttaggctagctactattaaaaattttggtgctgtaatttgatgacttcctgttttgtgtgtgtattggcagggccagtgaggcacgtctcttgatgtcctcactggtacaaattggtagtctctagagtgactcctgccagatcaggaagtggtaggtaatacgaagaaatgattcacagaaatagaatttgtttctggtcctcaacagtatcttttttccctcatttagccaccttctccccagaagattgtagactgcagttgtcagacactagggcacaagaaaaactataaacaatatggggtgagttgagcttaataactcacctccacccacttatatctcacacattaaatagctaaaaatgctccatttttaagtgagatatttttgactaaaacctttcaatgtccctaaacaaattgctatattttattttgtctgtttctagtcatatcaaaaaggccaaacaatcaaaatatagcatgaatgctgctaaaatttggaatttttttcttgccgatgctatttactgtttaaccttcctaggcttccacacacttgcttataaaacaaacagattgattcccaaccctctagggttccacatgttaggatcagaagctattttcaatattcagaaaacctgatgtaagttactttgttagtctttattgtttattatgtatctttggttaaaaaattgacatttatttagatttatagataaaatcagtatttgaagatcataggaagagaagggaattgtgaaagggaggggtcctttgtggtaaaaacattgctaa

SEQ ID NO: 2056 - DNA, 1122 bp, Homo sapiens
aataaaaatatatatctaatatgattaaaaatgtaaaggagagcatgaaaaccataaacaaagaagaaatcattaaaattgactaggcattttttttaaaggaccaattagatcttttacaaatgaaaatataatcacggaagttagtatcttaatagatcaatcaaactgtagatttaggtagacttaaagggacaatttataaactggaagatagagctgaaaatttactcagaatgcaacacaaatcgataaagagaagaaaatatgagagttgtaagagacaaagtaaaaaggtcaaggggttataattggtatctttattttcccaagacccgttccatatttcctttgccctcagccagaaccccaactggttattaggtgagatgacctagactttaattcctagaggatctgaatctcagtagttcttttattaattgctgtagggtttttttgtttttgtttttgagacacagtctcactctgtcacccaggctggagtgtgtggtggcacaatctcggctcactgcaacctccacctcctgagttcaagtgaatctcatgcctcagccttctgagcacctggaatcacaggcgtgcagcaccacaccctgctaatttttgtaatcttggtagagatctgattttaccatgttggtcaggctgttctccaactactggcctcaagtgatccacctgcctcagcctcccagagtgttgggattacaggtgtgagccaccatgcccggcctgttgtagttttccattaacatatattattggtcatggaagtaatgggaggtgttccagaatctcctgggttccagagcttgttgctcctattatgtttcagcagttcacttttcccttggtaatcaggatcagtcaaggggtttacttttagccagtaaaccccttctttgccattgtttcattagtacaaagaacccaaaatggccaggtgacagtttcatcttccaattcagtagaaccattgttgtattcctctgatggaagcattttccccttgagaactaaccaacagtcagagtttaagttgtagattgggaagcaaaaattatgtgagtggattattacttacagtattgagaggaa

SEQ ID NO: 2057 - DNA, 1020 bp, Homo sapiens
gttaattttgtagaataaacataactaataaacatgaaaaattttccactttggtaataaaaacagaaatataaattaaaataatatttaatcaaagaagtgatgatgcctatcactggcaagggtacggagagatgaaaactcattctgttggtagagtataaatttgtaagcaatttgggaattctctcgaatcttaaaatcattcataccttttgacctagtaagtacctttccacaactttttcctaaatagagaattgggcaaaaatgaatgtatctttgtaacattatatagtaaaaaactgaaataatctaacaaatgttcagcaataggagaatagcttacttacagtaactgcatagtatatgaaatattatacagtggcttgttaaaagtcacacagtggacctgcaaatagtagatgaagaataatgactgtgtgtgtgtgtgtctgttttcacagatggtcttgctctgtcacccaggctggagtgcagtgagtagcttggtcatatctcactgtagcctcaaactcctaggctcatgggatcctcccacctcagcctcctgagtagctgggactacagggtcgtgctaccatgcccagctaatttttattattgtttttagatacagggtctcactactgttgcccaggctagtctcaaactcagtcttccaaagctgacctgagcctgctgacacacttaaattaagagcaatgtggactcggccaaaatacgaaaataatttctctctgccagaaaatcgaaagtcattcttgaattggagggaaacaaaactaacatattaatgttgtttcaagtgatggcagaatcatttgacatgattaatttgcttagtgttgtatccttttttaggtcttaagaaatatcaagggggctgggcacggtggctcacgcctgtaatcctagcactttgggaggccaaggcaggcagattacctgaggttgggagttcaagaccagcctagccaacatggcaaaaccctgtct

SEQ ID NO: 2058 - DNA, 1050 bp, Homo sapiens
actaagaactattgcaggaatagggaaagttgtctttgaagtgtcagaccacagttttttcacaagtgaaactttgtaaaacctttcaaaccttcaaggaatggtttgtgccatttaaaccgtttggaaacgtagaaggaaagcatcttatttctctttacaaaactagcataattctgaaaaatatcacactcaataaagctgtagtctaatgttacttattaatatacatacaaaaattctttaaaaaaattgatacaagataattatacatatttatagggtacatagtgatgttctgtatatgtgatcagatcaaagtaattaggatatccatctcaaacatttatcatttgtgttggtaacactcactatccttctagctatttgaaactgtatattattgttaactgtagtcatcctactgtggtatagaacactagaacttattgctcctatctagatgtaattttgaatcctttaacaaatctctccctatccttctctcccctatgcttcccagcttcttgtaacctctgttggactttgtacttctatgagattaacatttttagcttctacatatgagtgagaccatgtggtgtttaactttctgtgcctggcttatttcacataatgtaatgtactccagttccatctgttttgctgggaattacaggatttcattcttttttatggctgaatagtatgccattgtgtatatacaccacattttctttatccatttatctgtggttggacacttatgttgatttttttatcttggctattgtgaatagtgctgcagtaaacatgggactgcagatgtctctttgttatactgatttctttttctttggactgaaatgccaagtagtggaattgctagatcacgtggtagttcctatatgcagctttctgaggaacctccatactgctctccatagtgactatactagtttacattcccaccaacattataaaaagtcttaataaaatgtttgcagctagaactgagcagtatattaaaagaataatataccatgacta

SEQ ID NO: 2059 - DNA, 1085 bp, Homo sapiens
aagggataaatgttagtaatgtatttttttttttgagacagagtcttgctctgtcacccaggctagagtgcagtggtgtgatctcagctcactgtaacctctgcctccctagttcaagcgattgtcctgcttcagcctcccaaagtgctgggattacaggcatgcaccaccacgtctggctaacttttgtatttttagtagagacggggtttcaccatgttgaccaggctggtctcaaactcctgacctccggtgatccacctgccttggcctcccaaagtgctgggattacaggcgtgagccactgcccccggcctagtatgtacttctcaaccatgttgttttaaccctgtcttcccttttagaaaccatcatttgttcttggcgatgggaactaatgatggaaagcctgaattgctcctccaaggtgactgggttttctttatggcaccaaataacctttccattccttctactcatcactgattggatttgggagtgtgaagtgagaggaaatgggtcatttgacaactttggtggaaagcttctcagaataaagatgtcagaaatattgggaatgaaattaataattataaaactgttccatcttatcactgggttagtctgagtctctcttactgcaacttactaggcatgataacctagcctcagatcctgtgtgatggggtcgacaggctaatcccactgtgatatggcatttgatggacatttatttccttgtacttttttaaaaaaaagtagagttagttcagttcactgaataaccaaaggatttctgatctcttgccctaaatattttattcttctcctgtttgtgaattttttattcttctagacttccttttatcccagcagtccctgaaaaaagacaggaatgaaaagaaacgctgatccaacctttccgtgactatgaaagaggccattactatgaggtgcagtgctccggtggggagggaggcctgcttcccaggattcctggcactctttccagtaatgagcagtttgtctctcagcctttgaaccattgttcaaatttaaaattcaacccagtggaaagccttggg

SEQ ID NO: 2060 - DNA, 1041 bp, Homo sapiens
tgtagcacaataccaaaaccagaaaattgacactggtgcaatccatagagcttcagatttcaccagtttcacatacactcatttgtgtgtgtagttccatgtaattttatcacgtgtaaatttgcataaccactgccacaatcaagatacagaactgtcctatcaccataagaccccttgtgctaccctttatagccacatctactatcctctacccttgccaacacattcttctaattttgtcatttcaagaatgttaaataaatggaatcataggatagaaaactttttgaaattgacctttcttcacttagcataattgccttgaagtctatccaggttttccatgtatcagttgttcattcctttttatttctgaatagtattccatggtatggatataccacggtttgtttccatgcactccttggaggacatgtgaatttttttcagtttgggttactacaagtaaggctgctatgaagaacatttgtgtacaggtttttgtgtgaacataaattttcctttctctgggaaaaaatgctcaagagtgcagtcgctgggccatatggtaagtgcatgtttagttttataagaaactgcctacctgtcttccagagtggctgttccattttacattcttgctagcaatgcatgagacttctggtttttccatattcttacctgtgggcttagaaaattaaataatatacaatgaacattaataagtatcttattaattaacaaatttatctcgaagttataagacaataatgtagacccaggctgggcatggtgactcatgcctgtaatcccagcactttgagaggttgaggcaggaggattgcttgagcccaggagtttgagactagcctgggcaacaacgcgagactcagtctcttttaaaaaaaaaaattagctgggtgtggtggcatgtgcctgtagtcccagctattcaggaggctgaagcaggaggatcacttgaacccaggaggtcgaggctgcagtgagctgtgtttgtgccactacattccagcctgg

SEQ ID NO: 2061 - DNA, 1099 bp, Homo sapiens
aacttccaatctgcttttagtctcatgtttgaactaggaaatacagagcaaagctacatgcaggacttggtcttgattttaggagcaactcttgctgagaacatgtctgtttgcaaggaaagtatcgtgttgtctttctactgaaaacagtcagtgtttctcaagggcttacctgagccaagactcttggggaagaaaaatagaagatatggtctctgtacttcagaagtttattctcctatttgggaagataagatgaacaattagaagagcaaacaaaacaagatagcttataactaagtactacattatgtgggttagatttaagtatagtgggcattgcatttttgaatgtgccagtaatgtcagaactatagcataacccttcttgttggtcacctacagacatcactttatttgctacaagaccactatcttttgtagaattgtcatcaaatactatctgattatattttattttcattttcaattgttagacattaaatttgtggtctgaaattgcatttgtggctttttatgtcttatagctcaaaaaacaataatgcttctagaactagcaaatgtcagagctgtgagttgaaccaggtggtctgcctatggaactgaggctgttaaccagtctgctctgttgcttcttgtggcccatccagagtcttttacactgattatgggcaggtacactctctgccagatggtgagagatcctttggccccaaatgagtggtgtgagttggactcttccagcagtgcgctacccatctgtggaagccatcatccagtcacagtctgaacacctcgttcagtcacccacatattcttcgctcttgaattgaacacctggtgtcaagcagagggctcactgcagagagcaaaggcaaatgaaacatccctgtcctgggagcctgctgtagtggggaagagggaggtgaatatgcagtctacatggttaactagaactaggaaaactggacaaaactgggcaaaattaggatataaaaagataggtaaatctgaaggtagttatgtaaatcatgatgaaaccttaagacaggcttgttttaggtgagattctaagaat

SEQ ID NO: 2062 - DNA, 1045 bp, Homo sapiens
tatatgtggttttttggagagactcacctccacatctttctgcacatctctttatttctcttctctctctctgtatccagatgggctttctctgctttagcatgcacatggccagtcatggctgcccaagcgtggcatctcgggacatcattagatagcactacctaggcaagtgtccatgtcaggtccaaccagaagcatgtggcccaatgcctacttagcaaaagacaggcaattcaattagcatgtccactgcacatgttaacctgattcataagaatatgcttccaagcagattgaatgaaatttttgcattaactgaaaggtaccaggggagcaaaataacatttataacatgtcttggtgagcctggctgtgaggaagagtgactgagttgaataatataaatggcttgttcaccaagccaagatggcctatgacagccattgtaacttcaggggtatttctactgaggaaatttgaatgtgtatttgttgaccatatgtattaattcattctcacatcgctataaagaaatatctgagaaatttataagaaaagaagtttaattggctcacagttctgcaggctgtacaggaagcatggcagcgtgtgcttggcttctgaaggaaactttcaatcatggcggaaggctaagcaggcacatcttacatggccagagcaggagggagaggaagtgaggtgccacacgcttttaaataactggatctcacgagaactcactatcgcgacaacagcacaaaggaggatgtgttaaaccatgagaaactgcccctgtaatccaatcacctcccaccagccccacctccagcactggggattacatttcaacctgagatttaggcagggacatagatccaaaccatatcaccattaaacctttttccgcctggaaattctttcttttttggctcctgctttttgtcctccatactaggcattttaattctgtcaacataatctataagcaaagtacatttggttagacttcgtttctccctagttataatcacctttctgtcta

SEQ ID NO: 2063 - DNA, 1647 bp, Homo sapiens
gaatttaggcctccacggtgggtgacttggaagttacttttttaaatcttagtttcttacttcctgaaaagacaatgatagtacccaccatatctgtgtgccattgttgtgaggatgaactgagttaaatatataaggtgcccgttgtagaatatagggccttatataaaatactttgtaagaaaagataaaaatcactcttagtccccaaagataaccattttagggggtatttctttccagtcttgatcatgtatatgtacttttcatgaagttcaaatcataccgttttgtatcctttttcttacaacatataaacgttccaattatgtcgttaaaatttatggggagtcttaatagcaacatgatagaatatcctatgtttaacccagattcagtaatctagataattggttcctcccagtttttgctattataaatgctgtttttaactgacttttgttttcttagatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggtactgaagaatacagtttgcatttatgtgatttatgaggttcattttggggttaaaagaaaaatgttttctgtttggagatgttaatgtgttgcacattaggaaacgacagttctttattgtgacttgactgctattgtaaatcattttcaagtcagcattacttttaaaacaatctgacaggtaaattattctaattagagcctatatcttcctcagcttcctcagtaccagtagtggggatgggaaaagttggatcaactgtttgcagttttataagcacgtttagaaagcagagcaattcttgattgcttcaaatcaaagtgcttaaatacaaatggagagcttgttcatggatattacagaatcagattttaatgtgaaccttctgttatatgagaaaaaaaaatctgagccacttaaattatttttggatacaacacaatttaagctttttcagtagctcatgcattctcttatttttatatttatatttatagagtatatttcctaaagttagctgtttgttgtctcttaatggactactgaattacgactttttaaaatctcagaattacccaggtcagtctcttagtacttttttttttttttaaaggttcaggtggaaggttataattacactggcatgggaaattccaccaataaaaaagatgcacaaagcaatgctgccagagactttgttaactatttggttcgaataaatgaaataaagagtgaagaagttccagcttttggggtaagtacctatggcgaagcacttgagatgtatgttgtaaagttgtacaaactcaatatgcgtaagagactcaagatagtaatttttcactgttttcagatatatcgtgtttcgtaatgaaatttggcatcttgttttgtctcagcactggacaaaatttctgaagatgtggattgcatccttattatatacctgtcttaggggcttgagaaattccattaatctttgtgtcttatggctttatttcatgtatttatacaccagaaatttcagagtctgttatgtt

SEQ ID NO: 2064 - DNA, 1027 bp, Homo sapiens
agtcttgctctgttacctagggtggagtgcagtgctcactgcaacctccacctcctgggttcaagcagttctcctgcctcagtctcctaagtagctgggattacaggcacctgccaacatgcccagctaaattttgtatttttagtagagacggggttttaccattttttgccaggctggtctcgaactcctgacctcggcctcccaaagtgctgggattacaggtgggagctacggcgcctggcccacgcccagctaatttttgtgtttttagtagagacagattttcaccatgttggccaggcttgtcttgaactcctgacctcaagtgatccgcccccttcagcctcccaaagtgctgggattacaggtgtgagccactgtgcccagcctgtctatgccagttttaacagggtcctgttactgaatttttgtattctgccttgtttatgacagtattctgactcgttatgaaagaaatcttatttccttccattcctttgactaagaactcgatagacttactttccggtagattaactgctgggtaattatagtatcttacagtctttaattttattggtttgcctatctgtaaaatgaagggattgggcaagatcatcttaaaaatgccttctggtagagaaaacagttttgcaaatgtcttttacatgtttgaagtctccctctattctttatcttttaggctcttctctatggtcttgtagatctgctagtgacaaattctcttattctctttctgaaaatatttttattttaccttctttaagaatattttcactggatgtagaattctggggtaccagatatttttttccctcttttggtatgtaagtggaaaaaaaaaaaaacaattttcctcttctctcataccacaacaatcaacaaagaagatttctgtgactaaatgtggggtggaggtgggggactttttccacacaccccaagcaagcaatcagttctgcagcagtcactagcagggtatcctccagttcaactctgacac

SEQ ID NO: 2065 - DNA, 1027 bp, Homo sapiens
tatgacactgtctacttgctgttttctgtaagaagtcagctataatcaaatcactctctcccatatgtaatgtggtagtctgtgtttttaagatcttttcctgttatttttggtttttagtattttgtgttgtgaccgggcatgggtttttttgtatgtgtgtgttctaacttgttcaaggtttgctgagattattgaatccatagatttatgtatttcaccaactttgagagacttagctattatttaagatattttttgttttattttttcttctttcctcttggtgtttatatttataaagacttgatatcccacaggtccctgaggctctcttttttttttcctatcattttttccactgtttctcaaattgaataatttttattgattatcttcagattctttgatagttttttctgtcccttccattttgctaagcccacccagtgtatttcagacactacctttttcacttttaaaatctccagcttattcttttctgtatgttttctctggtggcatttcttttcattcgttataagtgtatgtttgtaatataaatatggatttcttttatgtcatgaagcttaattctaatagctgctttaaaatccttgcctactactactaacatctgagtcatctcagggttggattctcttgataggtatattttcttgaggttggatcacattttcctctttgtgtatcaaataattttttattgcattctgggcattggaatattatgctgtggagactctgaataatgttatactcctccaaagagcattgatttggtttttttgttttgttttgttttgtttttaatcaggcatttaatttaactggactcaaactgcaaatgctgtcttttggatgttaactcagatctcacctcagttttctgatcatttaggacagccatggaagagtccttcaggtctcctttgctgggcagcttggaatctgccctgtacatgagtggttttcaagggttagccagagatttcaatatacagaa

SEQ ID NO: 2066 - DNA, 1055 bp, Homo sapiens
gatccagttacttctcaccaggccctacctccaacattgaggattaaaatttgacatgacatttgggcagcgatacgtaaccaaactgttaccagctaccatctttatcttacctcctcattctagggaaatcctttttcataatcacttatttcatctggaacttaccctttcatgccataaattgcatttgccaaaagtgagcatgtagaggatattttaaaattttttttgctgtggacaattgtagatgtgtataaaagaataatatagtgaaactccatgtttccgtcatctggctgcaacactttcaattttactcatttctaactactcccctttcttagattattttggagcatcccagacatcttattcatctgttaatatttcagtttttaactaaaacataattctttttttaaaaaaagtattataatcaaacctaaaagaaaaatttaagaatagtgtcaatataatgagatatccaattaatgtttacattttcctgatttggtaatgtctggagatgtttgaacttgaaggaggtgtgttgatggcgtctagtgggtggaagccaaggatgttaaaaactatggtattcagaacagctttctgcaacaaataattacctggttgaaatgtcagtggtgctaatgttgagaaacattggtctgtaacctcaccactggttttagataccttagtattcttttaatttgctttttaaaattatgagtgaagtcaaacatcttttgggctttaaggatcatttacatatatatttctctgtactgcctctacatatatcttccctttttttttaattggattcttggtcttttcctctgtgtttgttaatatattagcaatattaactccttacctgtgatgtgtcacaaatattttttctcagtttgcccattataactttatttttacttgtgttttttgccatatcaaaaaaactggttcattgtaaagtgtacacacgtaccccccccccttttttttttaatttcatcagcgttcagctttattgataacatcctcca

SEQ ID NO: 2067 - DNA, 1487 bp, Homo sapiens
gtaataccaacacttcgggagatagaggcaggaggatctcttgagtccagaagttcaagaccagcctcagcaacatagaccccatctctacaaaaataaaatagaaatattaggtgggaatggtggtggctgcccgtagtcccatctactcgagaggctgaagtgggaggatcacttgagcccaacaggttggggctgcagtgatctgtcattgcaccattgcactccagcctgggtgatgcagtgagaccctgtctcaaaaaaaaaaaaaaaggttttaaatgggaacagattgtgagaatagaaaaagaaataaatggactatagcattgccaatgttgctaaaatctgtgtatttttgtttagatagttacatgtgtattttaatgtgataaaatatatattgtgtatactattttataacctacttgaaaaagtattttctcacattgctgactcttccttaggcagagccaagattatgcactgtgacactttcaatactcttatacctcacctattttaattgattttgaaatgttaaaaaaggaaatcctccccatcactggaaaatagaagttacatcagacacctcaattctcatacgttaggaattttcttttaggttggtgtagatagagagtgaggtggaggggaatttgaggtcctggagtggcaaggtggtagaaagaggaggacaagttagcattgtggtgccaggactgcccagtgaatttttcctgtgccttggttattagggctgacccttgaataggttctactttgtctccataaccccaaccttggaggaacactatccttcaaggtataagctctctagaagaaagcagaaaagaaaaaaattcacaatgtactaataacacaacattagacatgttgctatatatattggcagaagcaaagtggtaatgtgaaaaagtaacaaagcgcccaaaaaaccctaagagacaattggaaatttgaatttagatctaagtgaaaattttaaattatgatcatagactatttagataagtgtctggcaaaactctggagtggtcagaggaacaatcatttattcaaaataataatagttatactattgcacaaaaaacagctttttgaatgaattagctttcatctcagaatgaaacaggagaaattaatagcgataaaatcagaaattgctgaattagaaagtaaaaataagtcaaatttttaaatgttctttgcaaacagaaatagttcatcccatctagttaaggaaaaggttgtatagatctcagttcttcatcctaaaacccatgtggttagatgggtttaagaattcagaattttccttagtttagaaaaccaatatattttatgtaacagcacatctgaggcaaaaccctgtaattaaactttcttaatacgtagtactaatgatcttataagagaaaaatatctattccgtgatcatcttaataaaggcttttgaaaaagta

SEQ ID NO: 2068 - DNA, 2546 bp, Homo sapiens
tgttgcatcctaaggctgatgataccttaggcttgaaaaaatatgataaattgacatttttctgggaaaggattcctagcttgttcacaaaattttctttgattttccgactcacccctaaaactggctatggattttttgacttacagtgaaggctgcagccccagatgtcatcatactccaataaaatattcttactcttaattcttacctcatctttcaggaagaacattgttcaagagtgcaattttacagaagagaagccttgagctcagctctgctctgctcttctcttcccttcctctcccttctaccactatccatttctaatctcaaaagcagttgtggcatatagcagaaagaagcagaatttaacaagcgagctgtgaagacaggagtctcaagttgtctgcatgtcataaatagagtaaaaattcctgcccaagtgagaagtgctttgtctcactgtcttttaaaatgttcagtggcatggaaatgtattagcaaacctgtgtcttctgatttggggtgaattacttataactcatattgcatctacattctgtggcttgcatgtttttgtcctagcgtttgtcccaaaatcagtctcatacctcttacctgtaacaagtcttcaaaattttaaaaacctatattgtgtcctagtatgtacttagtttgaaagtctcaactaaacatttatagttcagccatgaaggtacagtaagtctaagatttaaacacactcaaattcatcagcacctacctgtaatatgaaaagtaggcctgagcatgctgattggttattacagaatacagttttttattatttttgtttttaatatactgtacttcttttggcacagtctgagatagcattagttatttttgtagtactaccactgttgaatcatttttccattatcttgcacttgtagccatctataggaaaccacatgaagtcatcagttaagtattagaaagtttttttatgttcctgattttaagtgtattatctcagttcacagagcacaagtttagagttatggactggcgtataacagaatgagtagctcaaaccatgacatcagccttagtgtaaattctcaaccaaactcactgaattttatccttcggtctatccatactcaagccacttaaaacctgtgggctgtatgcagaaaattttaagtaggaaatagttgtcttctacctttaaagttatttgaaagagatgaattgtaattgtaggatgtaaatcaagcatattaatgtaattttatcaatcctgtacttaccccatagtaccatcatttcaggataagaacggttctttgtataaaataaattcagaaccttagaagatagagatagtggagcctgatacattttgtagtatctagtgcattaggaatcttgacattttgtggcagcttagtcatgttactgtgtatataacgcttagatgtgaaaaagcaaagttgggaccttttagaacttcagttttgaaagatggaagaaattgctgtagttctgagtaaatggcaagaggtgtacattaaaggtatggattctagaatactacaaaataacagtttgggagagatctccaacctcttatggtatagaaagtgttagttacccagtacctggtacatagtaatttcagtgactgcttagtacatattattagagctacttcagttaaagcagacagaagtgtggggaagaggttagcacttgaaattacctactactatggctggactccaggcaagagtagtaaaattctaaagagaaaatgagataagcagatgtatgcaatgaaaattaaaagcacatatctggaggacagttggaactattcttccagctttctgttggaaaaatattatcctttgctttcatcactggtactttctaactagtctcacttttgtcggttattgttttatttttaacatatttagtaatccaagtgtaacatagttaaaataataaaaagtaaaataattggagaaaggattatattgggagtaaaggaaatttgaagtcttaagtcatttatgtgtccttaggcaaaataacctttttgaacttgtgtttttaatctactagaatgcagcaggaaaagattttactagtattctgaagcataaataaggcatatttgctgccatggtttttactgttatattacacaaatacgatttctagatgtctctgtgttcttggttcttatttatatttgagtaatatagaatatgtatatattccttataatagaagtggccgtgcaggtatagatagaacttgttttacctatgagccttgccttgtatttattcactgtggcagaatatataaaataattattgaagcacagaagatcaagggaaaagtgatagattatttaagggataagtagagcatcttcatacgctgtacagtggcatgcagtctgagaaaggtttaaatagtcattgatacgctcacgttaggcattgttttcccacacaaaatgcctgtcctgtgaatatttctag

SEQ ID NO: 2069 - DNA, 1580 bp, Homo sapiens
tcgttgcctccagcattcctcctgccttggcctcccaaaatgttggaattcactggctagctaccataccgggcttaaagattttttctgatattttgatatgtgtgctgggatgaacatacttgtatacgcctttgatcaattggattaaattcctagacatagaattgttgggtcagagggtatgcatattttaactttcgtgcattttgccacactcccctgaagaaaaatgacagatttctagtcaaatcaactagggatgaaaaacacttgtattttaaatgttttttgtttaagtcaagggctattgaggaaactggaagttggtaaatcagagaagcatataaaatatgggaaagagattgcggggtcatttatttctttgctgttgaaatagttgtcatgatattaatgttctagtcgtacttagagaaattcagcaaaaaagtgcttctgatcatggtttcttagcacctcctgtattagtatttaaaacctctatcatgtcttccttgggatttaagacgtttgtgttttatgggtagttaagaactaaaatagataactgcttgagaaactgaccatctcctgcgcatattcagtttaggagtgatctggaaaccacaaggatcgtagacttgaaaataaccccaaggtgacaaagcaatctctgagtaccagtagcatgtgaacacacctcagaagagtcaaatatcctaatattttaagtctttctagaagccagctgttagtagaagtgttagaaaagaaaaaaagaaaaactatagggaagacagtagtagaaaagggggacgataggttgtagaatacaagcaacttttggaaaggacgcagaaaacttggtggttacattttgtacctttagtgaaataacattttcacattccttaactcaagtatgtagaattctcttgatggacagatacagagctcatactttcatgtaacgctatttttcagggtaactgaggtgcagagcactgtgtctgtatctcattttattctcactaattaaatctctggatgaaagtgcgtgtatatataatgtgttgatatttaaacagctgatctgacttacaggagttgaaccttcagaactttggtaatttctatgaaatacagagaaattcaagaaaatggtgacataggtggaaaaatccttatccattgctaaataagattattaaaaggattgtttagtaaaaagaagatagtgatcagtaagagctaccaaaattctacacagtatgtttaacaaagtagctttcaatcttttatctttatgggcaggataaatatgagccaggtgatagtatacacaagcaaggaactgaaatctagcctgtcatcaggaacttatagacagaatcaaatccaaggcaccttaaaagcatgcagtatataaatcttcgtgtacctctgtagctatacattaggcatgtcctcatagtatccaccaagtaaagatcgtttttgtacttagaagacatggaacacttcagaagagttttcataaaaagatccaacacttaaacattaatctatagcattcccct

SEQ ID NO: 2070 - DNA, 1036 bp, Homo sapiens
tcggctcactgcagcctctccttcctgggttcaagtgattatcctgcctcagtctcctgagtacctgggattacaggcatgtgccaccacactgggctaattttgtatttttagtcgagacaggatttctccatgttggtcaggctggtctcgaactcccgacctcagattatctgcccgccttgacctccaaaaatactgggattacaggtgtgagccactgggcctggccaatagcactcatttctaatcacaactattaggctacaactgttctcaaaaattgttattgttatcttaaaaattgataaaagatccattgtggtcctttatcttggcacttctgtgagtcatctaagaaactgaatttaattgatgtcttatggctgtataactcttttaggcatagcttgttatataaacttaatgtaatttcaaaaattttgtgtttgttttttaatagactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaaggtaatattgtgggggtggtataggaacatcttttgtgcaatagggtttgtattttcttaatcctggagattggagttacaatttaaagaatacttaaaatacaggacaaattatagtatcaaatgtatcatagcatttttgaggagtttctcttctgttattttatacagtagtgagtacagtctgagaagtgagaccaggtttcatttactacttgagtagtttgcatatgcagtaagtttccaggcctttacttataaagccaaacttttaaaaattataaagtatagtcaaagggaaatcactgtggtgtataggtaattatgggaattactgttaaaagtttaagcagccaggatcaaattaagaatcctttttagagcctgagcaactagattttgaattaagattaaagg

SEQ ID NO: 2071 - DNA, 1140 bp, Homo sapiens
tatatattcccgactatttcttagttctcgtgaacactggtctagttcccagaatgagtactttgctgataaccttatagtggtttgcaaagtaatttattagcatttagacttgaagtaaattctaccacattaaattttaaatgactttaatttatactttcggtgtacagatgattaaaggactttatgacatctaacatagaaaaaaaccaacccatgtttcttgatgagctgtagtacttttcttttccaactaggttaaaatatagaattacttcctaaaacattgagaactggaatgcataaccagaaataagactgttgagagacagaaggtagttgggcaagatggtaaatttttaaaggctgtaattggaataactaaacaaagtagtgagtggttctcttctgtcataagccagccgaaattttagtttttcctcaaaattataagaaagggaaaacttcatgtgctagaatcttgagatgaattttacaggtaatgaaacaggcaccaaggtataaattgtctttaattcatccaattaggaggctataagactagaactcgtttgtctagaacaaaatatgtctgtgctttcagcggttgactgtcatgctttccagtcagtagctaagtactcaaagtgtagactgggtaaaaacgtcagccttcattccagtaggtgtcctcttagattatctccatcttctctacaactaacagctatttaagagtagcagataaatactttgtggtcctatcagtcaagctcttattctcagagtagatggttgattgggggactttaaaaagtaatcaccccggccgggcgcagtggctcacacctgtaatcccagcgctttgggaggccgagtcaggtggatcacgaggtcaggagatcgagaccatcctggctaacacggtgaaacccgtctctactaaaactacaaaaaattagccgggcgtggtggcgggtgcctgtagtcccagctacttgggaggctgaggcaggagaatggcatgaacccgggaggcagagcttgcagtgagcagagatggcgccactgcactccagcctgggcgacagagcgagactcgtctcaaaaaaaaaaaaaaaaagtaatcaccccaag

SEQ ID NO: 2072 - DNA, 1042 bp, Homo sapiens
gctgctaatctaacttaattatatactaattatatctaacttaattatatactatatacttaatcttaaattgataccagtagaagcaaatgcattaggaatttgagccatgtctaccactaggcacaccaccactatggaatcagaatctaagtgaagcttgagtaccctttcacatactctgtatattgattcaaaactagtggtaagcactgggcaaaaatggaatagagcttaatggacagccagtaggctcagccatcatattcttgaaaacctagaaaatgccagtattctgggtctcttaaattcattattttaaagtctggatgatctggctgggtgcggcacatcacttgggctcaggaagttcaagatcagcctggacaacatggtgaaacctgtctctacgaaaaatccaaaaaaattagccccgtgtggtagcgcacacctgtagtcccagctattctggaggctgaggcaggagaatcacttgaacctgggagttggaggttgcaatgagctatcacgccactgcactccagcgagggcaacagagcaagactctgtctcaaaaaaaaagaaagtctgaatgatccatattgctggactttgttttttgtttattatatattgcatatatttttattatattttatttggcttgatagactttttggcttaagactcctgctcatagctagcagtgaattttaagaagctagtgctgattataactactcttcatatctgtgtttgcctaagtttggggccattataagtagtttttttttttaatattaatgcttaagaagttaaatttattctataatgtgccatgtgtgaagttgagagataatggtctttttctacatatactccctctcttatttttaatgtatttcgccactttaggattaaactgcaaatatctcatgaagctgctgcctgtatcactggtctccgggcagccatggaggctttggttgttgaagtaaccaaacaacctgctatcatcagccagttggaccccgtaaatgaa

SEQ ID NO: 2073 - DNA, 1082 bp, Homo sapiens
agaacttcagaaaaacagatggatacaattgatgactgttttagaatagcagatcaattttatttcaatttctatttgtgcatttggcttcattccctttattaaattttcaaatataactaaatgtgtacatttggtaagtcgttgggaaataataagaatgctttgctaaagtgatggttttgtgcttttcctaggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaatacttgccgtgtagtttgtttgttgacctcgtatgttagaaaattttacaatgccagctacatctgttgattttaaatgtcagagaagttgtaccctgtttcaaaagtatactaagtgatactacttgtaatagaataaatcatcttggaattgaattgttaccttttgaagtaaatactggcaagtgcacaagccacataaacctgaataaaacttt

SEQ ID NO: 2074 - DNA, 1057 bp, Homo sapiens
gctttcctgttctttctgacttaacgggattctggctctctgattattctgcatttcggctgttaggattgtgatttcccccttttttttctgaagcgttaatcagaaactcccatccccacttttctctttgctagcaaggtcatcacagcgcattcttggatcggaaacaagaaggtccgccttaaacactttcgcctttaaaatgtttagatgtccttccagggctgagggtgattgctctgttgagttaagggggaatttgaggggagcaaatgccttcgctgcctatattgcctatgtgtaattaaaacataaattcacttttgaagttattgttctttatagctgctcagccttaattaagaaccacaaagcgatttgactgctaatcctggtgcagaatgaacaaaaggaagtgcactcactgtaattgctgggcatagccttgtccctgggtaaaaaggctctcctttactgtcttcccttttgctttcattcaaagcaactgtagaaacacgtgtaagtgatgtttcagaaatcaggaaagggatgtgtagaaaacttcatggcagggcagtggattgaggatggacatatgtatctggaagcaccaaaaataatgttcggtctagctaaggttttcttcatcattgagatacgtaaataggcagaaagtttcattattgtgtttaacagaggaatctatgtgtgagaaacacgtttgacttaacacttcactccccattgccttggaaggcttgattattaccagtagctggtactaatgaacttccagagagaacagactgcctcaagccattcttctgtcaagggagggtaattttgtaaggctaatatcacttaggggtgttggaaaggaacatgttgtaggcaaatggttcttttgatcatgattttgctgctctccggtacactaaactttatgtaagtatcaggattccagagaaagaattggacttaacaaaaagtactttgaaaagtgggattaaattattgtgtgtggaataagtgttagaaaagcagaattatttaa

SEQ ID NO: 2075 - DNA, 1025 bp, Homo sapiens
agctccatgccctagagaccacccttcacaatttcttacattaatatgaccctctagaaatttttcatgcatacacatgtgtatataaaattataggatcattttaactgatactttttgggaggctgaggcgtattttaacagatggcaaatacaaatctgattattgtgcctgtatcatcacttgctgtacaaaagccaggaaaatcagtgttgattctgaaaacagcgctctcttaagcaccatacacagtcatccagggtgcagggtgcagtgcatcctcggataaaaagagttaaagttgctatgggaaccagaattgcactttctgcttgttgtggggagaaatctccaccagccacttttctaagaagaagtcttttttgtttcaccttcaacttctggatggattattcagttgctgttaaaaagtttgggttttatgtcttataagttatagtaagtttttatcagtaccagtggggtagtagttgatactaagattgtagctaaggatttgccttttatcaaacagccccattaattaatttgataatcattgtggatggaaacttggcagacaggatcctaatcttgagaaaggtagcttttcctctttctaaaaacaattagattaaggaaaagagtgcttataaaaccaacccaatcaaagtttatgaaactcctaaaattaacactgaaaccagattagtttccaagctcctcataaactgtaggaaccaatagtgattaaatgaagcttttaaatctgcatctgcatatcttttttgtgtgtttaagttagaataattgatatataaggctattgccttttattctctttggtcctctgctgagtgtgtatgtatttaacatggaacaaatggcaatttttccccccaggaaaacctttgcaaggtgggttctgactatgtcagggaatagctcactgtggtgacttcactgtggtatttgtgcaccctgaggggacactattttagtttgtctcacaaaggcctgattt

SEQ ID NO: 2076 - DNA, 1050 bp, Homo sapiens
aattggcaacttgccaattgaaaaaaaagttcagtatatttttgaagtgtagctgtagttcattcatttgcattcctgtctagttaagattatactacacctaagcttttgattatcctgctgatggattttttgttgttgttgttgttttacgaatagaacgcttctatgggcattctcacacatgtctcctgatgcctatgtgtgagattctctctacctgggttgctgggtcataatacatgagtttttcaatgttataaaataatgcaaattgtttcccagagtgatcgtgctagtttagatgctcaactagcagtgttaataggcctgttgatccacattgggtattgtgagaattctcaaattttgatcatttggtggtataaaattgtatcttagtggttttatttataaaggagagtatcttttcatgtgtttattggtctttcatatttcctctccgcaaaatgtctcatcatgttttctttcccttattgatttgtagaattcttcatatattctttatactaatcctttgtcagttatgtgttttccttatcttccagtgtgtccagtgtataatttgtcttttacattttttctgtgatatcttttgaacaaaatgtcttaattttaatgcgatcacatttgtgggtactttttctgttagcccttttgagtcttatgtaagaagtctttccttatattttcttttaaggatcttctgaagttttgcctttctacatttaagtttatctggagtcgattcatgtgcattgtctttatctgctaggacaatttcctttccaacttattcttctattttagaaatatcttagctatgtttaggcctgtgcttatccatgtaaaatttagaatcaggttgtcaagttcctcagtaagctgtttgcatctcgattgaagttgcattgagtttgtgtatccatttggattgaattgacatctttattattgatttttttctccatgaacatggtataatttatatcttctctgtttaactccaataatatttaatagttttct

SEQ ID NO: 2077 - DNA, 1028 bp, Homo sapiens
tgggactacaggcacccgctaccatgcctggctaatttttttgtatttttagtagagaaggggtttcaccacgttagccaggatggtctcgatctcctgacctcgtgatctgcccgcctcggcctcccaaagtgctgggattacaggcgtgagccaccgtgcctggcctctcagattcttaaagatagaatcactgggccaggctcggtggctcacgcctgtaatcccagcactttgggaggctgaggctggtggatcacatgaggtcaggagttcgagaccagcctgaccaacatggtgaaaccccgtctctactaaaaatacaaaattagctgagtctggtggtgcatgcctgttatctcaggtacctgggaggctgaggcaggagaatcgcttgaacctgggaggtggaggttgcaatgagccaagatcgtgctgttgcattccagcctgggcaacaggagtgaaactccatctcaaaaaaaaaaaaaaaaaaaagaattactgaattaaaagacgtggatatttttaaggcctttagatgttacagtcctaaattctgagttagcaggttatgagaatatctgttcctctgagaattacctttcctcttctcctttcaaattatttttttatctgaggtgtttacttttcaatattcaatagttaataagtcacagctgtctaggatgcaactctgattttgattgttatgatggattaaagatgaccacagatgctttgacactcctccttttgtgtgtggactgggctgtgactgctttaaccaatatgggacagtatgtgtgatgatatggcagttctaggcttagcctttgagaggatgggcagcttccacctgccttttggatcctgaactgccttctagaagttcaactatcctgagaccaccatatttgacaggacatgagcaggcatttctggtgagcattcctagctctgtccagcctttcctccatccccatcaaggcaccaggcagatgagcccacctggcagctgagtacca

SEQ ID NO: 2078 - DNA, 1048 bp, Homo sapiens
ctctcaaaatcatgagataaaaatggtggttgttttaagccactgagctttggagtagcttgttgtgcagcagtagataactggaacacttactgagtctctgggattattgagttggagtgcctatgctgctcttcccaaggggaatcagccttttttccttcctggaatggttgcttagaagaacctgtagacacccagaggaagttacacttttctttggctttaactagagagccatgggagaggagccagaaatatcccgaggctatgcatttctgagttctaactgaagcctggcagaaatttcaaaccaagttatcacagggatcttgtgtctgagagagcagactgtcttctggtcagtatccttgtgtgtctaatgaagggaagacaggtgcagggatccatcttcagggtgttctccaggagagccataaatgtaacagtaggaaaacaagctatgttcatattcttggtttctgcttatttctctgataaaaaatcattcctttcattggtttctgcttgttcatctgataaaaaaatcattccttttgttacctgtcaaaacatacagccccctgattgcaactcaaggtgctctgcactgcgtatccaagagtaaccatcacttctgcttcccctgttttgttgcatgtgttggctagctacctatccatttttgtgttctcatccctttttctttctgttctgtctttcacaattaccctactttccattcctcttcccatctctcccaaactctgctaattgatattctggtcatactaaaaggctaatctatctatctttcttttgttctttcttttcttttttttttgacacagtctcactctgtcgcccaggctgagtgcagtggcatgatctcggctcaatgcaacctctgcctcctgggttcaagcagttctcatgcttcagcctcccgagtagctgggattacaggcatgcgccaccacgcccagctaatttttatatttttagtagaggtggagtttcaccatgttggccaggctggtctcttaac

SEQ ID NO: 2079 - DNA, 1031 bp, Homo sapiens
agttactgttggattaaaaagtgtcttgtgtatggaataagaatcaagtggcatttttatatttttatatttcagtcctctttctttagtaaagatggagtagaactggcccagtcccctctgctgctgcccagtgctgctgaaagggcagtgtggtgcagtggttagagcatgggctgtggaggcagatggatctcaggccagccatgcttcagctgcctgctgccatgtgtcaggcctccttggatataaagttccataatttcctcaggtattaaaagtgagccatagtgtttcccttatgggattgtaaggtttaaatagaatggtgaacatagagcagccagtgcagcacccaccccatggtcgatccaccctctgcttccttttcattttctctgatacttgacgcttgccatatatgggctcctcttgctcccagtttctgtttcttccctgtatgaccttaccaaatctggtgtgtttattatccaccagtcacgtcccactgtctttcaaggcctgacctgagccatcttcatccttgaagagttcttccaccctcctccccccatccccccgttcaccaattcattgatctgtcctgaatttctccagtaatacctgtttggcacttaactagtccatgagggggcataaagggacctcgtagaccttggaagtcatttagtcgaccacgctcattatacaggtgaggaagctgaggtccagggagatagcaattgcttaagatcaggtttcccatttctagactagagctttctccaccaccctatgtaccgtttctgtttttaagcctgtaaaacaacaaacaccacaataaacaccaaaacctggaaataggagattatgtatgcagacttgtacttcatgggacagagagctgcttctgggtttgtactctgctcagaaggtgtatgctttattttactttagttggtaggtatactatatgagtaattctcttttctttaaaattgtaacacatgaattaataaacatacatttac

SEQ ID NO: 2080 - DNA, 1023 bp, Homo sapiens
cccagcccccatactcccttcaaaaataaagtcctttccattttagtctttggttattagtgtgtgaaaactctgcctaaatcctgaactttctactctgatttgtcagaggaacagttctttcagttttaatttttgtctttagattttttggttggtgttttttttttcttcccctaggctcatctgtataggactgtgagcccagaaggaaagttgggaaataatttgtcagtattctttggcatttacaagatgttcctatagtctcattataacatggtttcctgacattttgttatggttgttgttgatagtgctttttggaaaacaacatctatatctttttttcttttttaaaaagtgcttatatcttttaagttttatgttactttgagatattactgtaagttcttttgttcatagattatgaaaaatgtcaaaaggaattctaatcagaaatcagttttgctctgtgaatttgtacattgaaatttaaatgattctagttaatacattctgtctcttattttcatttaatgttgaggtgaatacacacatgtaaggccatataagaagagaataactaatgagtgcctattctgtccagtcttgggcttcacagacatcatttatattgaatgctcataatacctgataaagtaaatattaataatctagtaaggcaattaagactttgggcaattaaattctcactgtacgtcattgggacatggcagagaaggaagcctatgtctttttctgactatagtgccagttgactctgcacgtttgcatacagcagttctcagatcttcttagtaacagaatcctttatcccatgaaatcagactcccaatatataaaacaggtaagaatagtgttcagttatatacgtttattgtatttggtacgttaaatttaaggtggaaatctatgtttcaatcttcacttggtttcatcttaaaacttatttctatatattttgtttgcaaaattaaaaaagttcaaagtttcaaagat

SEQ ID NO: 2081 - DNA, 1435 bp, Homo sapiens
gaaacattgttatgcagtgcatgactgtatgtatagcgagggagacagagactgtatatatatagaaagagatttaagtaattgacttatgtgattgtaggggctggcaagtccaaaatctgtggggcaggccagcaggctgcaaatttggataagaattgatgttgcaatcttgagtccaaaagctggaaactcaaccagaatttctaggttgcagtttggaagcagaattccttcttctggaacttaagtctgctattaaggcctatgacacattggatgaggcccacccatattatggatttgttttactcagagcctactgatttaaataggttaatcacatctaaaaatgctttaaaagcaatggctagactggtgtttgatcaagcagctggataccgtagcctagccaagatgacacatgagattaattgtcacgtgtatatttttgattataatttttgaaacattaatattttaaaattaagtttgattcagtgtgaatatgtctttggaagtctggagctctgagaagaatgacaagtagttgtttactttgagaggcaaatggtattgaaagagccagtgatttgcagctgggtgatttgggttcaaataaattccagctatgccatttacagtttgtgtgactttggtcaggtttcttgaacttgagtctcaatttccatgttaataaaataaggtattactttatcaagctactttaataagcgagagaatgcttgtaaaactcccactgaagtgactggcatatagtggcatttaatacatgataacgcattattgtcatagtgattatcattataagcttaggtttatattacaaagttttttatttccctttatatcttttaaactatatccttttaccaagtgtactgtactttctgtagtttgtgggaaaaattgaatcaaaatctagcattctcaactttagagttcttttttctaagaatgttgtaattgaacaactaaaagagacaattgacattatgccatcagagggttggacgaaggttaactgaggtatcctgaaaagcatctgccatgctggagaggatgtggggaaataggaatgcttttacactgttgatgggagtgtaaattagttcaaccattgtggaagacagtgtggtgattcctcaaggatctagaaccagaaataccatttgactcagcaatcccattactgggtatatacccaaaggattataaatcattctactataaagacacatgcacacatacgtttattgcagcactgttcacaatagcaaggacttggaaccaacccaaatgtccgtcagtgatagactggataaaggaaatgtggcacataaacaccatggaatactatgcagccataaaaaaggatgagttcatgtcatttgcagggacatggatgaagctg

SEQ ID NO: 2082 - DNA, 1025 bp, Homo sapiens
atcctacggagaagtcctgaccttcttggatcttacacatgaacagggtaggcaatgtatgaatatgtgaaaactgaaatacttgtaatcacctgtttttaaaaaatagataaagcagcagtagaaaagatgccacatatcaagaatgatccaaaactgccaggctagagaagcagatggcatctaagctgggtcttgaaagctttggataaggaaggagaggatgccttggttggatgcaagaggatggacatgttgtaagcagaagtttagagacgggagagtataaacccatttaactgaaggaaaatctcttaaatttgtagagttgtaaaccagaaagatagtttcgtggccagagaccttaaacagcaggtgaagaatcttggacttacctcccctgtgttagaccatgagatcccaaaagcagaaaacttatttttgtttacattgtttccggtatgggattggtgcttagtgaaagttgatgggaactgtacccaatgagaaatcaggcagaatttttggagtaggactctggtaagaaaacagtgggccaggaggattaatgtgcaaacagggtaaaaatagtatacaattgagggaatttatattcctgttatgatgctggattaggcaacaaatacatgacattaagctggtggcagcagaatggaaaggaacatatagatgcattttattgtgaaggaaatgttaccaggacttcagtcaaaggtccttttatttagtgatcaggagaatggttggtaccattaacaaaataaagaagatgagctaaactgaagagtttggttatacatatgtaaaatttcaggtcatgggggacatcaaagtttgtgcagcagtcaaggataagagcttgagagaagatgagagctggagatctaaatttgggacttgtcctgccacactatcaatgattctgaagtattttagtgtatcagtgaatggtagttgaagctatgagactgattgctgtcattaaggaagcaagtgaggggaac

SEQ ID NO: 2083 - DNA, 1087 bp, Homo sapiens
cattgtcatcatccctgttttacaggcgaggcacagaggttaagttacactggtaagtgacagggaagggtttcaaacccaggcagcctggcttcagagtccatgcttttctgaaccactatattctgctacctcttgacacacaggtttgacttcaggaattgatcctacaggtagcctcagaaattgttagggactttcttttcatacctggttaatccctacccctgttaagtaaagctaccttgtttaattttttttatccttaaaaattcagacatccattacttaatcttgctcagttccccagtttacacttttgaatggtaaaacttacttctttgtgtacatagtttttctgtgtgcatttctgggactttgcagctgttccattttttggagtatctcttctctccccagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgcgtgagtgccccatgacgtcagtctgtcagttgtcttaaggacttccaagggtggaagaaggaatgggtgactttcttttattcctccttgaaaggaaagctctgaaaggccagctttttgtgtaatttgagtagtattcaagtcagaggaaagtcatagatgagggcaattcactgtaaaggcaaactgagggttttgtgtttccttcatgaacacatgtcccagagttggagcagcatctgcaaggtttagaaatttgtttggatccaaatactgggccagtgtagtctactccggaatatggtttctctagtcgtatttgttcccctttaaaatactattatttttatcaatgctcaggcatccaaggtaattaacatgtatcaaatataatgagttctaggctaagagggccattccaagattatttcttttttcttttctttttttttttttgagactgagtctcactctgtcagctaggctggagtgagtgatct

SEQ ID NO: 2084 - DNA, 1024 bp, Homo sapiens
tttattgacatcctgttgggttttgttggtggtggttttttgtttgtttgtttttgagacagagttttagctcttgtcgcccaggctggtgcccagtggcgtgatctcagctcactgcaacctccgcctctcaggctcaagcgattctcttgcctcagcctaccaagtggctgggattacaggcatctgctaccacacccggctaattttttgtatttttagtagagatggggtttcaccgtgttggccaggctggtctcaaactcatgacctcaggtgatctgcctgcctcagccttccaaagtgctgggattataggcatgagccactgcacctgaccttcttgttgttgttaatgaacagtgcatctggtaatcattcttagtctaccaccatctgtctgtctcagagatgtgggaaattatgtttggttttaagtcttaaaatgctcttcttaaaggtacccagatctgatgtaactcgtgtgttttgactgacagcctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggtaagtgacaggaagatggattgaaagacaaaatgatagttccgtggacccccggaaaggaaagctttgtttccaaggcatttggacaactaaatgtggagatgtatacattattgtaacacagaaatcagtcaagatctgtctctaccccatgcctccaccttttttaaccaagttgaactttcagatgagtttctggtgtgtaagaggggggtggtggcctgagtaatggttctgcaaataattagcagcaggatcatagagacaatttgaactttgactgtaaaaggttaactgctttgtgagttcttccttgttgatgattttgtttagtc

SEQ ID NO: 2085 - DNA, 1855 bp, Homo sapiens
tgattttcaacattgatgagtaaattcatcttagcatgtgtctagaaacttaaaatgccatgacttaaagggtcatgattttgagaaagttctgatttaaaatttggtttttattacctttgtgaccatcaggagattgcatactggttctcaggcattgcttttaattaccagttatctttctttaacacattgattttacttacgtatctggccgaatttttgtttgacaataggcattttacattttaggctctctaagcacacagtgtgatagttacggcagatgcagctgtaagccaggagtgatgggggacaaatgtgaccgttgccagcctggattccattctctcactgaagcaggatgcaggtaaaatattttcaaagccagaagaagggggcagaatctatatatagtcaacacatattaatagatcttatggcttattggcagcagggtaaacatttttcctgtaataattgtcaacaagactgaggactagctgtaatggtgagccacaaggggtttggcttgtacagagagtaagcagagttttaatgggatgactatcttaaactgaaaccaaatataaaaatgactttaggctcacacctgtaatcccaacactttgggaggccaaggtggctggatcacgaggtcaggagatcaagaccatggtgaaaccccgtctatactaaaaatacaaaaaaaattagccaggcgtggtggcgggcagcagtagtcccagctactcgggaggctgaggcaggagaatggcgtgaacctgggaggtggagcttgcagtgagccgagatcgcgccactgcactccagcgtgggtgacagagcgagactctgtctcaaaaaaaaaaaaaatgactttagggtccattttgttctatgtgtatttcttttaaaaaagtctgttggctgggcgcctgtggctcacgcctgtaatcccagcactttgggaagccgaggcaggcggatcacaaggtcaagagatcaagaccatcctggccaacattttgaaaccctgtctctactaaaaatacaaaaattagctgggtgtggtggcgtgcgcctgtagtcccagctactcaggaggctgaggcaggagaatctcttgaaccctggaggcggaggttgcagtgagctgagatggcgccactgcactccatcctgggcgacagtgtgagactctgtctcaaaaaaaaaaaaatctgttaacatgtaaaacaaagggctgacttgaagagtggaagttttctcccttctctgattgttttatccatttttcattgaataggccatgctcttgtgatccctctggcagcatagatgaatgtaatattgaaacaggaagatgtgtttgcaaagacaatgtcgaaggcttcaattgtgaaaggtagtgcattctttctctagctgcattgtgttttctgttaccatatttcaagtaaaaaaaaagtaactgattgtgtcttaatctttttcagatgcaaacctggattttttaatctggaatcatctaatcctcggggttgcacaccctgcttctgctttgggcattcttctgtctgtacaaacgctgttggctacagtgtttattctatctcctctacctttcagattggtaatttagacctcatcccccaacctgttagaactgtgagattacacttaaaatatttttaaaaataaaatcagtgactctttgagggctttttgatggttggcaacactttgtattatttagcatgcatagtttttgtagtttggccttttaatttaatgaaaatgtacttttggctttagaatttatctcaatgaatggtgattacaaatgttatat

SEQ ID NO: 2086 - DNA, 1092 bp, Homo sapiens
gacagaagggatttgctttgagggttcatcctctcatctgccatgtgtttgcagaccgcagaccaactcctagcccgagctgatgctgccaaggccctcgctgaagaagctgcaaagaagggacgggataccttacaagaagctaatgacattctcaacaacctgaaaggtagaaaaggctgagataacaggggcaaatgcttccgccactagagtgatttttttttttaatcatgacttttaccatatttattacttcatccccaactccctactttttttatgctaaagtatttcaaagggaaatcccagagctcctgtcattttatccctgcatacttcagtatggatttttttttaaagatgttttcttattaggcaaactcacataaccaagatgcctatttagagaacttatataggtaaatggagattatctttcattttctctgccagtggcatctgattctttgttgttgtttttttttcttcaccccagatagaagagaaatgtgaccaattcactgagcaactgtgaattcttgtctgataaaacagtcataggttctataaatagagaagctttacaggatgctttacagggtactagttgaaaatatgggccaggcacggtggcctgtaatcccaacacttcgggaggaaggatcactggaggccaggagttgaacaccagttcctcactggggaatatagtgagaccccatctctataaaaaaaaattttttttttaattagccgggcatgctggcacatacctgtagtcctagctacttgagaggctgaggtgggaggatcccttgggctcaggaggtcaaggctgcactaagcagtgattgtgccactgcattccagccagggtgacagagtgaaaccttgtctctcaaaaaaaaaaaaaaaaaaagtagtagttcaaaatatggactctggtgtcagtgggccttggttcaaaaccctgcaccctgcaccacaggtcatgtaacttctttaatcctcaattttcttataaaaatgatacagcctattttatgtcaaagacacaaagctcttaactcagtacccgacacacagtaa

SEQ ID NO: 2087 - DNA, 1002 bp, Homo sapiens
atttaaattttacctcagcgaaagcatctaatcaatatgatgtcgtagaaagtgtatgccattaaatgtttatcatttgctgtctgtatgaccccaactaaaaatagcaataatagaacagaagtttccaggattaaagaagaggatacaaatgaaagtgctagataaaatacaaaatgttattatgtgggtagtaattttttttatgattatttataacccaaattgataatgtaagtcatgagatagtataaatcaatatattattatttctggattatatttttaagacattttataaattataaaaggagcgggagcatacttgagaaaaaggaaagcttttttaaaaaaagtacaattttcttttgtgcctagaatgccaccagcaccaaggcagaagctgaaagaacttttgcagaagttacagatctggataatgaggtgaacaatatgttgaagcaactgcaggaagcagaaaaagagctaaagagaaaacaagatgacgctgaccaggacatgatgatggcagggatggtaagaggttttggtatatttgctcattggcagaaagtgaacagtgtttaataataaagatcccccacttgttgagaagagtcttttttatattgacttctgtttttcatcacattgtctcgtcaagaattgggttagtagcttacatagaagacaaagaatttggatcttctgccaggtaattttgttgcacaattgtcctgtcccaaagttactcagttaaaagtaaaacattgctttacacgtttgaggttttaggacattaaaagtatgtgtttatatttttcactgggtaattcataaatgttaataaaaaaggaatgcaatgaagttaattttcttcttattcttgttctcccagcacctttagagacaaagacaagtttcttgtatataagaaatttttgaagatggcattgtctaccaccccaccaaaacatatgaaacttacatctagtttaattt

SEQ ID NO: 2088 - DNA, 1050 bp, Homo sapiens
tggctttcacttccttaaactcatttatctggtattgttggccttccataaaatgacctgcacctacctctgcctcatgatatcttcttactccctgatagaaaccaactgccttagccagagtaatctcattgttttctaatcatggcatatgcattcctgcttaaatctctcttcccatgtcatttcccatgtgggaagtgccacactgtactagcttagcttaaacttcaccttcttttgtgaagacttccttgtgtactctggtgatttctgcattctttaaactttgtagcatttcctgtatcttagtcatttggtacttgtaatttcttaattttgtaatgatctctttttttatatgtgacttatctctgcagctagactaagtatggttgagaccatgtttcagcatcttttaaatgtacagtgtacataattggtgttaaataaaattgtcatgcttttgttttgtttttgcaaaacatttaggactatttaccgtatgccagtgctaggctctgagaatataaaaatgaaccgatacttactctttaggatagtggctcctgagggagacagatgtggcacaaatatttcaatataatgtagtaaatacagtgtgaaatgttttcaaggaattccatgagtgtactaagggaagtggaacttttcctgcataggaggtttagggaaagcttctggagttgaacaccagagttcagttttacttatttttttatttttctcagagacaggatttcgctctgttgcccaggctggttttgaactcctggccttaagtgatcctcttgcctcaagtgatcctcttgcctcagcctcccaagttgcttagatttatagccatgagccaccattccctgtgggctgaattttaaaaggatgagcaggattagccaggtaaaaaagaagagtatagcaggcaaagaacaaaatgagtaaatgcctcagtgcagtgtgtttgaagaactctaaaagaatcctgatactaggaatgactgagtttggttgatgtaaacattatgatca

SEQ ID NO: 2089 - DNA, 1034 bp, Homo sapiens
agcctgtgaagacactttgcagaaccttgattgtgtcagttactttgcatccctgatcctaacaccactcatgctggccctattggaaattggatgtgcttgctgctgctatccagaatggattagccacagtccccactttctctcattagttcacacttaaatgtggggttgatgtgtttgttgatggagcctgaattatgtgtctgtacactagctgcaaatgaagctggtaaatatataatgggaagcaggttctgctttataaattgtggggatttctcaaaaataggaagagaaattcagatgctgggcttgaataccaaccagagagaacatataagtacagttgagagtcattggtataaggattccattcgtttgacaaactgtaccagagatacacagatggatgagatacatttctgtttctgttggtgctagccagagcaagagtggaaagccgtgttcatatgtcagtagcctaacataaatcagtactatttctctgagactctgataggaagccagctctgttatgtgaaggcttttcacttagtgtgtttttcatctgttcaccaaaaattgctattggctgtacttttgcctttcaaatggtgacatgagaatagttgatagaggaaggtgggtaggttttgaggtttttctctttcactccagaaggttatcagttaaagtggtattgatgtataactgtgctgtccaatatggtacccactggccacatatggctatttaaatgcatttaaataaaatgaaatttaagatccagtttctcagatggtgacatgagaatagttgatagaggaaggtgggaaggttttgtggcttttctcttttcactccagtaggttatcagtaacagtggtattgatatataactgtgctgtccagtgtggtagccactggccacatgtggccatttaaatagaatgaaatttaagatctagtttctcagttacactaagcatgtgtcaagtgctcatgtggctagtgactgccatattggatag

SEQ ID NO: 2090 - DNA, 1059 bp, Homo sapiens
catacagaaaattgaagcttaaaaaaaaaagttcaatcaacagagttagacagggcttgaattttatttaattctactcaatccaatataaaatacctaaggtgctaagtactgtgttaaatagtaagatactaaaaagctagctgctctgcccaggtctggtcctcattctcgggttcttgtcagatctttctgcttgggctgggcaagggaggacaagtggaataactttgtgaagggcaagtgtggtttctttgaaattggttacagagtgctctggctgttgtacatctaactcctaggtcctacagcttgggctgggacctcacctccctaaggatggttagatgtgaagaatgagtgggagagagattgattcatcgatgatattgatgttgaccatagagaaatagtagcgcttttaatggaaatgaggaataaaagggaatatttaatgaatatctatggtgagatgccagatagacaattggaataggaccatggctgggttagaattattgcctttgtattgtcttcaataatggtgagacttgaatctacaagctgggaagtatgaattaaagaagtataagggcattagggccagcttcttagggaacaagtaccagatagtaataaagatcaacttctattctcaatggttttgttactctacctatttaggtggaaggagaaagaagaaacaagaagtgacctatcgaaaacgtgagagggactaggaaagactgagcagaaaagttttaatgaaggggttgctctaatgcaatagtttgcaaaatgtggtccccagatgagcatcatcagcatcacctgggaacttactagaaacacaaatttttgagccccatctcagaccagctgaatcagaacctcttgggatatggcccagcaatctgggtgatccagggctagtttttgaaaaaacactggtaaagtatggtattgagtactgagagtttgggaaatacaaggactgagaaaaagctcttagattggtcagggaaggtcattggtaacacttgagcaaatttgctacaa

SEQ ID NO: 2091 - DNA, 1031 bp, Homo sapiens
tttggtgtgccgttacttacattaacactacttttaattctagtatctactcatatttttgctttcattttggtatccttcttgtttggaattctgttaaccttttatctgtatgtgcaagcatctgattactttgttatgtcttctaaggtggtcttatctgaccatttatatattgagatactaattttaatctgtttattatttcaagaaggtacaggggttgttgcaaaaaaaggactatttttaaaaaggcattgggttcattgctttggaaagcattgttttggcataccttgtttaatgtaaaaattgagatgaggggaaatagctttcctgttgtttatggcttaacctactttgcttgtttcattcatttgggttgtgagcttatgttctgtttgaagttatagattttatatttatattatgttctgtttgaagttttagaaatatttaatgttctgtatatattatatagattccactacgatgaaaacaaagtgtgaatttcagagagccaagtaaatgattatgtatttatctgattgactgtataaaatggtaggttttcttaagaaaaaggatgttattcctggttctcagatggaaaacctttcagattgtttttggtgaagacttttaaaactattgtcaggttttagaaaccttgagtttttaggatctttaccttttattgagaaactgtttagtccaaattaacctgaatttatttgagcaacttgtatgctgtgcactatgtgaggcactacatatgcgtaattgaataggacagtttctagtgaaggaaatgtgtacacaaataactttattgtagtcctgtgagtccaataatagatgtgggcattaagatgcactgggagtactcagccaaactaagacctgcttttaggagttactgagtttaaaatacaagaatgggttaaccaaacaaggagggaagtgggagggcattctaggatgagtgaaaaagcatgaataaggatactgaggggcaaaacaacaagaaa

SEQ ID NO: 2092 - DNA, 1034 bp, Homo sapiens
ttttttacataattgttttgttttacatattttttcttcagtaaggagtccatctgcttctgtgttctacagggcattctcatcctggtcttaaaagagccctgcttggtaaccggtatctgtttgtcctgtagtgatcactcagttttcagacagtgaggaacattagaataacattttggtctataactagaatctgttagaaatatatgagacagaatttttaaatgtttgttctaagaaacattaaacaaaaaaagaaaaaggctttgacatttttcctttacctttcacatgaagtcatttcaaataaagataaaataattttcttcataggggttctctgttattgtgggttaactcatattttcctcctctcctctatctagaatgtcttaaaccattctaccttatgagaaattggatgttcttgcagatagtcattgtgggagaaaacgtttcatttaagtcccagatgaggaccgaaaacttgaaatcagaggagcatctgaaatcaagtaatattaggtaggatgaaaattacaagggatttctacatgtttttattccttttggagatgtgtattattcatactctgtgaatactaataaaattagaaacttcctgaaacatttgattttggccaagatcgggatggggcatgctaaagttttattatttatgtgacttcttgagaaccttggcttatgtttatactttgtcttgagcatttttatcttgtggtccaaggaagcttttgaaaattttactgaagtaaatttttaaaaattttgttttatatgaggtctctgaatatttatgataaacgtagggacacatgatttatacctcatcctttagaatgaaagtttctgtggtttttttacatacttagtaaatcatgtgagtgcaggtaacatcagcttgcagttctgtatgtcagcgtggatgcaatcaagcctcccaagtgcctgtagaaataggtgtatgatagtatgctagagaagccctcttgtacatgtgaattagtaac

SEQ ID NO: 2093 - DNA, 1030 bp, Homo sapiens
aatagaaatgacttggactttgtggagtcatttaagaacaaaatttgtacctaattgtacctgactgctttgtgactggaagaattattttacatctcggagcttcagtttttccatttataaaacaggaataagtatagctatcccgtagggttgttatattttccatttagctgtctttatcaattcaatttagcaaggttacttttaaaaagaaagctaataattgtcattattagaaagctaataaaagtaattaacttgtgcttctttcagaacctaggaaagaactgcccagaaatgagcgcctctacccttgttatactgaggaatcaaagctggaatttcaaaatattttaacttttatgtcagtttttgtgacatttttatatttctattagtgcttgactttttagttttacggtttttcttggacagattatagcatggtaaaaataacagagtaaaattttagatctgtgtttatcaatggaagcctgctccagagtctgcaagaactatagttcatcacctgacagcttataagaaaagcagattgtttgtaaattacattactattatataccccatataatctttgactggaagttggtaacatcattaggtggatgttagcatactgaaatgttacttgttcatctttacaaaacaaatcatgtttggaatgagaaaacaacctttagatgcagtatatatcctgaacatacttgagtataaatttttagctaacatagggaagcatagtaaagtatatcctttgtaacttcgcaactcaaggacaaaatgaaaggtcattcattgaatctagtaaaggtacataattaaccctagctttctcactataaggtttataaattagtactctccaataggatttttcaggggaggagcgacatttgtgacattggtaggatagggtacatggtatgctttattaaattgtataaacttaggttttaaaggcataagccaacagctttgcaaatatgtatttttttttaatggcaaa

SEQ ID NO: 2094 - DNA, 1116 bp, Homo sapiens
gtgaagagtagtggaagtagagttcagagactgtcgaatgttgtaggacagtttagattttgttctttaccctcagagtagtgggaagtcattaaagtgttttaaagggacaattgatagatcagatttgcatttttaaaagattcctctgacagctgttgggagaacagaatgaaatggggcaagaatgaagtggaggaaacaaagccaagggatggttcttgaatgagagtggctgaagaagaaataaagagaaatcaacagattcaagatatagttagtagataacattttttggagttgatagatgttaggggtttgggagaaagttgtcatggaggacttccaggtttcttccttccacaattggaaagctatgatgcatttgctaagatgaaacaaccttacaaagagaactagagataggggatgggaatgggtcctgagttcagttttggacctcttgaacacaggcaattcttgatgaatttgagaggggaaaaaagaggcagcagctagaggggaacgtggggcagaaggtttttaaaatgtgtgagatacttggacatgttaaaatgctgaagagaaggaaagatccaaatgaagtgagggaagtctcaaaattggtgcaagggaaggggtaaatcaaaggaacagtccttaagaagggttagcaagaacatacctaagtggaattattgttcttaaatattaaataagaggtgcaatacctctagtgttttaacaagagaaagtaagaagcaagctgtataaatgtagtacatatttagtaagtgggaattgttttccctgaggtatggaactgtcatttggaggtgaggaagggacataggaatcagtagcttgagaagaggggaaatttgaaatagttatggtgactagtgaattgagaaacatagtaggtttttttggcagcattgagagaatttttaaaaagttaatatcatttaatattatcttaagtaaatcacatgtgaaggaaaacagcaagaaagtggactctacttagcagaagaggtcacttaacttttaagtggtccttaaacttttaagtattggcattaatttgccaagaccttgtgctaccctgatgtt

SEQ ID NO: 2095 - DNA, 1033 bp, Homo sapiens
aagttgaaagtcatttgaaatatagtagtataaaacttctgcagcattctatggaatatatttagagcaggttttgccttggggatagagcaggaaggagtcactggtgtggtataatggttttaactgctggggtttatctatctaccgttatgtttttgtttttgttactcagattctaagctgggtccagctgaagtctggacatccaggcaggctctgcaggacctgtaccagaaaatgctagttaccgatttggaatacgctttagacaagaaagtagaacaggatctgtaagtattacctatcatttgagaagtccctgtaagatcaagaatttcaccgagactttaaaacagtttggttcgttatttatttttcaacctgttgcagaataaactttttcaatggaaagtaattctagtatttgtgatatttggccattggtattatttcaaatacagtctttggaggaggtaagaagagaaatgtttagagttgaattctattaaggtcattacggcagctcttttagggcctgtcaaaaaaaacaaatatatctatttcaaatactaagagtgtttggattgtctgtggtcagtcttataattaagccgcgatttaaaaaaaaaatacaagaataggctttagaaaaatctttctttgttaaacgtgattctataatttccctgtcaggaaaatgtatttgcattgtaaggaaagttccttcttttaattaaataagttggtagtatttcctcccctacccccaataaaatgaaaaattttgtgtatttagacttttccgcttcttctttctataaggggcaaaatggcagataaccagattcccaagtgagtaattgtcttttgtggaaggctttgccttacaaattggaacagggacattagcctgatagaaatttaaaaatcaattaagagtactttgtctactaatgtccgttaccctaagttttggtgaagattagttttttctatcatttacatctgccttagatactttatattttta

SEQ ID NO: 2096 - DNA, 1026 bp, Homo sapiens
aaaaggctactatttgtaaggcacgatactagatgctgaggatatggaggtaaattagacagaatctttaccttcaaagaaatatctagactaaatgaaaagatggatacattagtaagtatatttgttttcttttctgattgtaaaaataatgcataccaatttcaagaaatttgtgaattatacaaagtcccaaaaagttcattaatcctcccattctggataaattgccactttaatatatactcttcttgtgtttctatacttttttgcatatttaagaccacactatatatccatttttgtatctgttttataaacataatgtaagcttttccttgttaacagtttagcatttttgtgtataaagcattttctctaatactgtattatttcctgaggaccagttgttcaaattgaaatcattagaaagtttaaagtgaaagtttaaatactgttgacaccattttgtcgttttcccaaaagttcatcatttataacatttttcactagtttcttctgttgtcctttcattttatttagagttgtttgaagtacagaagttaccaggatttttttttttttgcaataccttttcctttgtccatagatcagtgcatatttaataatgagggaaataatcacatttaaggaaacaaatagatattataattcaaatcttaacatttggaaacaacaccaatgttctacaagagaataatagttaaattatggcataactgtagaatggaaacacaaaatgattacaggttgatatttatcaagattttataagatgaaaagattgttttgttgttgttaagtgaaaatcatataaaattatatatatataatttgattctacatgttaattgagtagtctcagttcagtgggatattaatgaaaatggtaacttttttttcaatcactgctttcaactatgctctgttggattcccagattcccatcatttcttggacagattctataacattctggttgctttccatttttgaagcataatt

SEQ ID NO: 2097 - DNA, 1050 bp, Homo sapiens
gaaactactactacttttgatggtttgtgtattcttagatatgattatgttacctgctttatagatattggcattctccaaaccaagttcattatttttattgtgcttgcattcatcaggattgtggtagtttgaatgaaaggaatgagagtttcatttaacagggatatattttactaatttgaagagataacattaaccttcattctatttatatatgtgaaaatgatcttttattagtatgttaagatattagcagtttaaatgtataatgcataaaataaggagaaagtcaaaagtattaactttttttcagttcatgtattcaaataaatatttgactactcatcggtcattgttttaggcactgtgttaaacagtaaatgacaatttcaaagaacattttatatttcttggttatttctaggtatctatatacttgggtaattgtgtataactgcttcatagtatttctgtaagttctttataagtcaggcattttaagagattgtagaacttggacagttaaggtgtcacttagccaaaaatagtcaatgcgaaatagtttttacaggtaatcgctttttggttgatactttctatgtgcaagatattagaatagataattataaatagcaatagtttgttttgttttaaaatatacttagcctgtgacatatgatgtataaggttgggtgtgtgaaaggaacagctaactttgtcatgtcctaggctgttcagcctggaaaagaacaaacaagtctaaatagttttcatagtaagtattcagacatgtgaaggattatttgaaaagaacatacctgtatctttcctgaagtcaaaactaaaatcttaaattttaagttgaaatctatagggggctgaccgtgggatgttgtggattctccattttggagagcttaacagtcagattgacagccatctttcttggattatttaagtgcagtcctactaaataggggattggactagaaaacttcttgagattgcttccagctctggttctgtgaaatactctctaaattggtg

SEQ ID NO: 2098 - DNA, 1057 bp, Homo sapiens
acagaagctactcacagaacactgattacttcagtggatagaggaaaaatatcaagtctatttttagttcttcaaatcaagttaaagattgacaacatgactaatctcttttgtgatgtgttagaagactccctctacctacctgttaaaaaaaaaatgactttttttgcaattttttgctgtttccttaaaactaaagctgtgttcttctgttttgaagggtttccgcccccaacatatgttatccccccgcctgtggcattttctatgggctcaggttacaccttcccagctggtgtttctgtcccaggaacctttcttcagcctacagctcactctccagcaggaaaccaggtgcaagctgggaaacagtcccacattccttacagccagcaacggccctctggaccagggccaatgaaccagggacctcaacaatcacagccaccttcccagcaaccccttacatctttaccagctcagccaacagcacagtctacaagccagctgcaggttcaagctctaactcagcaacaacaatcccctacaaaagctgtgccggctttggggaaaagcccgcctcaccactctggattccagcaggtaagttacagttgtgtgtactatccagctgaatgaaataaggggaaatgctgaaagattcaatgttagaaatgctcattaaactttgacatacttcttgcttagatttatagtgattatgggaaaacaaaagtattgtctctactgtttatgaaagttcaaatgttttccttactcttgtaaaggataaaatactagatcttaagtaccattcttggctgctactaagtgtccattttattgaaaatggattttctgcaaataattctcctataggaacataaactactagggaaatagaatcacagtcttgatgaggtgctaagacagatgtgacaccaatcttaaatgttgtcgttggaagcacagcacttgaagcagaaaggggaaacaaacactcttatgcaaatatattcattcattcattaaacctcttaaatagttgaattaaaag

SEQ ID NO: 2099 - DNA, 1060 bp, Homo sapiens
cctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcggtatcaaatctattgggagggaggggaacgtgtccgggcaggcgctggggtcgggtggcaaaactggggtgaatttgtagaatttgggaaagggtcattgacatcttaaaataggtggtcgtttggagcaagaatgctcgaaaggggtgagggtaggttaggctctctagtgctgggggaaaacaaaatgtggaaggattggtggaaaccagacctttaagatttatattatgatttgagatttatatgattccatctaggccagatttaaaaaaatatttgacatccccatttctggaatgtaggagataaaggcactaagacgaaggaaatggtagttgtgctgtgtgtattacactgaagaacaaatatttgcaggataaaattaatttggacatttggctggacactgctcggtatgggtccagtttagttggacctcgagcagaagactggctgttgccctgttgtgtaccacaatctttggtttccagtgctgtgttgaaaagagcactaggcttagaatcagaaaactcaggcttaagtgttgactcttccactcataatgtttgaacgagacatgtcacttaaaattctgtctcagattcctcatcactgaaatggagctaataatgtgcactttacaagattgttcttaggattatatatcacgaaagtgtttccaagctctaaaattctacataaatgtaaaatgcatgttgcttgtaccattggttttgggactagtcttataaatttcttaatgatatatggtgttttatctccttcctagaagagatggaaagattctgaagggcagaaacagtttttcttttgtatcttccttccatatgacaaaaagctaagcatgcagaagggactcgatacatgcttgatgaatgaatgaaatgtgaaag

SEQ ID NO: 2100 - DNA, 1045 bp, Homo sapiens
tcagggttgtgaaataattttaattggttatgaccatcattaaaagagaagaaaaaggccagatgtggtggctcatgcctgtgatcccagtgctttgagaggctgaggcaggagggtcacttgagcccaggagtttgagaccagcctcggcaacgtaatgagcacaggtctctacagaataatttaaaaattagcttggcatggtgatgtgtatctgttgtcccaactactcaggaggctgaggtgggaggatggcttgagcccagaaggtcaaggttgcaataagctgtgattgcactgctgcactctggcctgggtgacagagactctgtctctaaaaacaaataataataaataaataaaaggagaagaagaacaaatagaacagaatgagagtagaacaaaatagaaaatatcagagtatatcacaagtagtaaagttttcatgaaacctttgtcttgattttatgtttatttaattatataattaactatgtatgtgcactgtatctcaatggtcaaaagagtttgaaagctgctgaatagaacatgtctcacttttcttccctatgccacccacatagttgagccattctcatgccccatcaagtcttttcttccctacacgaagcatttccatttctttccactcatccatatgtatcacagtctcacatttccttgccacactgaacacagttcaatgaatctagtttgtatgaaaaattgggacctggaatcaaaaacaatgtccctagctatgttctaactgaaacaggggcaagtagaactaccctgttcttggttagcagaatgcacttcactgcattttaatgcagcctgaagtgattagatcgatgaggatgtgtcacagagactccagagccagaggcccctgggctgtgtctcatagtgatgaaatacacagcccaggggcctctggctttggagtctctgtttagtcagtgtaagcctgcagataagctgaagagtaaccaagggcaagttacttctctatgcctcaatttcctcatctgtaatataa

SEQ ID NO: 2101 - DNA, 1021 bp, Homo sapiens
gttaatccatcacatacaatgggtgccttagggctttgtcttaatgtttcttcacataacctcagttgacaaaggttgccagcctcaatccacaaacattaggcatctgatgcattttcatgaccttaactccatctatatattgacaactcccaaatttatatctccagcccaggcctctatctgaacacaagataatgttctctccaatttgatgcaacctcttgtaaatatctgacatctcaaacttctcatgttcaaaaacaaaacccgatctttcccccaaaaactgttccactcagagttgtcatctctcaggccccaaattttagtcatccctgaacttctggtctttctctcacatctttcatccaatcctttggcaaatcctactgtacctatgtttcaaatacatccagaatctgaccaattcttgccacctttacttctaccaccctgacctaagccacatcattctctagagcttgaactattctagttgcctcctaattggcctccctgctttcattgttggacctctacagtctatttcaaacacagcagccaaattgatccagtcctttgctcaaaattctccagtagctcccaattacaatatgtatggtaaaagctggaaaccttacaatggcctacgtgatctgtagtgcctctttcctgactgctgcagtctttttgctgttcttacaatacattgagcaacttccacccagggcactttcccctgctcccgccccaaacccccatggcttactgctcatttctttcaagtctttgcttagatgataccttatcagtgaggcctttccctcccaaccttttaaaaattgtaacggccctaatcactcactatccccattccattgcttatttctccctattgtgtttattattttctaatattttacatggtttgcttatttatttttattgtcttccttttctactagtgtgcagtttcctcaagggcagagattttgtccatcttgtccactactatatg

SEQ ID NO: 2102 - DNA, 1055 bp, Homo sapiens
tacactgtgcctgtgtcttggtttagctcccttgcctacttttactttaagacacttatcacaatgatgatggtattatttatgtgatcatttatgtaatgactatctctgtcactagattaaagacctcatagggtcagggtctgtgactatttcattcaccattgtgattcagcatctgtggattgcagttgcaagcatggatagggatgaaattagtcaaagagaaaatttggagtgaggaaagaaagtcaagacagaacactagggaataccaatatttatggagctggacatgaaggcagatcccacagagaagtctgtggaggagcactggagaaggtaagagaacagggcagaacagtgtcatggaagtcaatgatggagaggattccaagaagaaggagagaacacttaatagtctgggaccaaaaaaaaaaaaaaagataaatgaacttgaaggcatagcaatagaacctatccaaaatgaagcttacacacagagataaaaaagaccaagaaaaataagagagacctggaggcaataacatgttgactgacatatgtaaatgggaggcttcagaagagaagagagtaaaagagaacagagataatatttaaagaaataatgaccaaacatctttcatattttatgaaaggtataaactcacagagctaagaaactcggaacatgaagcaagatacctactagggaaaccacaccaagaacttcattatcaaattacagcaagttactaattctgacaaaaatcttaaaattagagaaaaaagggcacattccatacagggaacaacataaaaataattacaacagagttttcggaaactatgcatgtcagaagacaatggagtaacatctttaaaatgctggaacaaattttgtcaatctaaaattctagacccagagaaaacacctttcaaacatgaaacatgtctttccttagacaaagaaaagttgtgagagttggccagcacacctgcagtacaaggcttgttaaaggaagttcttcaggcagaaggaaaatgatacctga

SEQ ID NO: 2103 - DNA, 1039 bp, Homo sapiens
atggttctgcaagctgtacacaagaagcatgacgccaacatctgcatctgttgagggcctcaagccactttagttcatggcagaaggggaaggtgaggcagcgcatgcagagatcacatggtgagagaggaggcaagagagagatgggggtcatactccttgtaacaatcagctctcactggaactaataaagtgagaactcacacaataccttgaggatggtaccaagctattaatgggggatttgcctccatgatccagacacctcccattaggccctacctccaacactggggattaaatttcaacataagattatgaggggtcaaacaaaccaaactatagcaattttctttaaggagttttatagtttcaggtcttatgtttaagtctgcaatccattttgaattgatttttgtgtatggtgtaaaataaatgtccaatttcattcttttacatgtgatctagtttttgtacaaatgttttcccagcaccatttgttggagagattatcttttccttgttgtatattcttggcatccttattgaagatcagttgaccacatatgcttgggtttatttctgggctttctgttctgttccattgatctgtgtgtctgtctttatgccggtaccataaagttttgattactgtggctttgtaatatgttttcaaatcaagaagcatgagatctccagctttactcttctttttcaagattgctttgattattcaggatccttcgtagttccatttgaattttaaggttatttttgctatttctgtcaaaaatacacttgggatttcggaagggattgcattgaatatgcagaaagttttggataatatggacattttaacatattaagtctttcaacccgtaaacacgggatgtctttctatttaggtgtatcagcaaaaaaaaaaaaaaaaaaaaacccttataaactaataaacaaattcagtcaattgcaaaataaagaattaatgtgtttctatatactaacaacaaacaatctaaaagtgaaatttacaaag

SEQ ID NO: 2104 - DNA, 1043 bp, Homo sapiens
aattcagaacctcttagaaacatcttgaggtctttggcaaatagattgggggtggagtggcagaaaatgacacacagaatacaggcccagagagcagcactctcttagacaagagccataagcagctttgcccagaagccacccttgtctctctctgccctcccccaattgatgctgtcagcgtctgccttgctcctatatctctaggaggtacccagattgctcaggagacagagcattccaagtctgcatcctttgaggggtggtagatttcctattgtgatctcttttctatatcttgggaggaggcaaatggatgcttagtacccactactttgtgtgtagagtggtgggcctttggaaaaatgctgcttctgtaaacaggactcttttccactgagattgtaaaatattgggtgaggtcatgcaagtttgtaggtatcacctagtagatccttcaacacatcccaaataaagcgaatatgagaaatggaaagctcagcgacaggatcactacttgggcaaatgtcaaacatgtggaagaatgaagggattcttgatctggaaggagaagtagttctcagaccaggcggtgagaggcgacccaaaaagccttgagaaagaaaataatggttggctgaatagagggggtggagtgtgatttcacctggctggccttattttagccgatgggcttcagagtgttgaagatttatgcacttgcatcccatctttagcggcttggagtctctgaaaattcagaatattttgagcagcattcaaaggtggagtgtgaaggaggataggacacaaaattgcacagggcctcctgttaagagtagtggtaacgtgtgacttgtaactccagggagtttaaggcaggatggtggcccatggccggcagcaatcacttcctctgccatgagtctgctgacacaggcattcattgctttgggcttccccagctgcttcagctcaggcctttcctgctactgtactttgggccaaggtatcacccatgagggccagaaattgttaatgac

SEQ ID NO: 2105 - DNA, 1082 bp, Homo sapiens
attatatcatttgaaatcacaactgatcagtgtcaggtagatgaagaaggtgttattatatctcttccccagagaggggggtcagtggagttaactgacctatccaggcttccttagttccccggtgggacagccaggatgaaagatagagttttctttctccaggtctccaagcgtcctgtcttggtctgtgtacagaaccaagtggcttctgtagtctaacagacataccagacctgtaaatttgtgacttcaaaccagaatttcccttcagctgtaagattctttacatccccccactctgttctggttaatatataagttagatcttaggactggagccaggctgggtaagaccgaaaagccattggccagtaatcctgtttttcttttcatcattattttgcgatgttgctttcttttttgaaatcttaaaagtttcgcatttgtatctgcttctaaatctatcaagaacggaaagtttcttcccaggactggcacacacaaagctactgtgagccttgggcatgtgtccaggcctttccagaaagcttccctgcctggtgtgctgagaaacgctctgccgatgaggagggcagggctctgcctcgtgttctattgtgctgtttgtgtatgtctttccctttctctgtttcttcgtcctcctcccccttcattcctcttttgtgtgaaaatgcttttttctggctgattgagtatctgagtttgtggtgaactttcaaagccttcttaggctaagctacaggaaggtcactgtcacaaagagtaaaaaaatgtatagatcgccagagttcattaaaaacatcagattgaggaacacaaaatgtccacctaagggcaagtctaatgtggacgaaggctcctctttagaactctcctagttcttctgaggctgcagctctccatagaggtaagtgctgtgtgcccatcagaaatacccacacgagcatgcagagatggaggcaaggatgcacatattttgtagttgtgacaacctgaaaataacttaaatacctgccttccagtagaagaatacttaattatggtgtgtccacatcatg

SEQ ID NO: 2106 - DNA, 1089 bp, Homo sapiens
tagttccaaatgctttaacgttccacattagtgaaacaatgatctacaccataatgaaaacagtaacacatttattttctttctgtttgtacttcaattccaaaagttaagcattaaattggctttagtcatacttatgctttgatgatagtccagcttcttggtgtgaaatcaagatgtgaagaaagttagacacacctgtgaaagcccagccttcactttcacatatgtgggtaataacttagtccagttatagtttgttaactaaaaaaacaatttctttgaagtataattaggtgataatgataattttaaaatgtgctaaaaaattctttttggctgaaaaattttggtaaagtgtttagttaagatgaggtgttgtgtctctgtcaataaaagatgcatggattaatgtatagtccctgtcatcttctccagccttcagcagtgactattccgggaccgtatggggtaactggttgctaggcaggcagagtgttctgttctgttctccttgtctgtggcatgtgattgagtcaggagtgttggtaaagtcttctttgaagatgaagcatagaataatagcatgcaaaacattttatcctttttatccttcagctatttgtctctagccttcagtgagtgggtgccccaacctaaagacaacatgctgtgttattactaacatactggagggagctgtgcacatacaaatgaccctgtctctttttgtgccctggaaccttgtcttcccctaggtggactctgtgacccacagagccatcagaagaaatcacctttgcttatcaagtttttgttctttatcttttaaagacataacttctctacctactgtttctgctacttgaaacatattcctctcattgtaatttgagaaacaaaaggataattttatgaggacattttcagtgttcatgctgaagccctggtgatccttgtcaacttgaatttatgcatttatctttccacactcaggcacttcctttcatcagatggatttctggcctaccggcagtcagttatttcctaacatattaggtggcagattttgtgggatttaatttgagc

SEQ ID NO: 2107 - DNA, 1762 bp, Homo sapiens
gtttttagtgtctgcttcccacttactttcccaggctttagacctggtggttttgtttacatactttctggcaagagtgtcgacagattccattacagggtgaatgtgtatttgaatgactgtgagtgaatgcattactttgagcacaagtacgttttgtgtttagcattttctgtaaagcagttatatatgatatgtgatcacagttaaaacactttgtcatatttttcaagtttcagaaggtcttgtgtgtaatagtccttatgaaaatattgatttaatgttatttcctgatctgtaatgggggaataaaattgataaagtgcccatttctgattatctagtgggaaaattttgctgatggagtatgaagtaattaattgctagtgtttcttgtttctctcatctaaaaatacttcctaaagctaatgtaaaataatttttagtttgcattataatgccatattaagttgtatatttgcatggtatccatatggacagtactctagattgtttctttgctaaattgaatctaaggaatacatgaagcaactttggtaaatgactgtagaggtacagtttgctcagacaaagcaatggtataaaatcatattcatagatacacagagatgaaagagatctgatggatttaaagatgagacaacaagaggaatactaactaaaactagtgacctatctttttcagtgctaagattgcaaatgaagtcaaatttatgttcagatagcctgattagcttcactttggaccaccttgggtccattggtatttattgagtaccctaaatggtaaaagtatactatactgaaattaggataatagtattacaattttctgtaatagtagtagtactacaggtagttgcaaatgggaaaatatcttaagtgacttatacagggactcaaattataagggaacaaaatggttttctagtctttaactactggtagggttttttttgtttgtttttttttccccctcatagacccaatgtcacctcccaattctaatgtaaattttgtttcttcagtaagatacaagaggtgggaaaaccttagttgacatattttaaactcatctgtggttatatgtaaattaaaaaaaagctgagcgaagtgaaatgtcttatacaattataaaatccaggcacagttaagatacagctttctgaaactattaatctccttttctttccccaaaggattgtagttccttccttagtaatacgtgaatcattcatcctttcaaacctgactaaattgtaaatggttctttcttctcagtgtcagagaagaatagtggatgggagaatggagcctctcccatcaccattttgttcccctaggacctcaaatagtggcatttcttttgttgttattgtttcgtggcagttggtaacctttctaaattgaatacactcagccatcttatctgagacaaaaatatttcaaaagttcttcttggcatctgcatattacttgggaagtttagaaaaaagatgtaaacattccatataccaaattgctcctttgcaagcttagctaccatgaagctaaaagtctaagagcttttaaaagttggtttgaataaaattattttggcaagagtattgtacaattaaaggaatttatgccttaagagaagtgaaaataattctgtgcacattagaaatgaatgtcagagccaaagttaggattcctagcctgtggtgatttgcttaatctgatgcttagcttattaatg

SEQ ID NO: 2108 - DNA, 1029 bp, Homo sapiens
atttttgacagtgatttctctcaactctgaaaacaaaaccccttttacaactctgagttagttttcaaatgttagggtttcctgcatgggtatttggggtaagtatgaaaatgttttgctgcttaaatcaaagaactctggaaacagatataaattgagaatggaaaaagagtagtgaataagatggaaatttctattctaaatttcactatatgggctacaattcccatatagttttccttagtgaacaccaccccccaacacacacatacaaacacaccttctgatttaaataacattatatcttcagaaatggaaaatgtgttaaagttgtgttaacaggcttccttcttgtctgtgtcccattctcatcacagtctaccagttagggatgtttagagaaatttatcttgtggcattgaagtggctttatgtgcattatatattgggttttatgtatattgcatactgtgaagtaatcatgatacatgctgacaacaaaagatgtagataagttaaaattttagttgatccattgtctgtttcttctttgccatctttgtagaaaaaaattaattcaagatggacagcctataaaaatgtatctttttctattattattaatttagatattggcgtgccacttttgaagaaggaaaatacttagctacattaaaagatttgcattgaagaagcaattgtgatatgctgccttttatcacagtgtgacttcccatcagtgctgagtaatgaagtttctgattaatatctatcgttgctttatcagaatatctttctctaaagtaaatcattcttgtgaataagaatctagctagttgtaatgcagttcagcataggtggaaataattttttaaggactaagtcaatttctgggattcagactgtttcagaaaagaaacattttctgtatttccactaatggcacagtgtaccttagtatgtttgggttagtattcagttttagcaataatcatggaggcaggggtatctataaatattatatcccaa

SEQ ID NO: 2109 - DNA, 1024 bp, Homo sapiens
aataaatgaaatatcaaaatcattcatgagggtactagatagcatgcggaaaaaacagtcattatttccagtgctcaaagttaaacattaaaaaaaaaatcaaatgcaagaaggaagtaggtgagggagaaaataggaggaaaatgtatggaattcaatgggtttcatgtgcatttcccttggatgttattgagctctaggtcaggtttgtagaagagaagcgatgcttccccatcatgctccccagtcctccaccctccaccctatcctgtggggcagagttgctatagattgatgacactctaggacactggaccatgtttgccagtagaatggttgctgcccactaaaaggtcatgcataatgtccacacaaagacctgtacatgaggtttataacagctttattcataacagtcagactagaaataacctgaatattcatcaatgggtaaatgtataaacaaacagtagtaatctttacaatgggatactactcagcaataaaaagaacaagctactgacatacaccacaacatgggtgactcacaaaacactctgctgaatgagggaagtcaaaacccaaagcatttatgctatatgaatttatatgaaacttgagaaaaggcaaatttaatctataatgacaaaatagatctatggttttttgaggcttgggatggagggtatgtaacacaaaagggcatgaaggaattcaggcaaaagatgatggaaatgatctatatgttgattgtggtggtgtttccatgtctggttatagttttgaaactcatcaaacttaggcttaaaatgggtgcatattctttcatgtaaattatacctcagtagagttgatataaacaaaaaggtcacgtacaaagatgtattatctcctgtccctctttcatgtgtgctatagaagcagtctaaagacctaactctcttttcttctcctttcttcctccatgtggcctgaatggggagaaagccagggctctcttgcttaggatgtgcccagccaaaat

SEQ ID NO: 2110 - DNA, 1042 bp, Homo sapiens
ctgatgttccattttctataaaacagaagagacgcttgtattttttaactcccaatgtgggtaatgctagataagtgtggaagttctttgacaaccagccagaaagtcctatagatatctaaggattcattactttgtattgtggttgctatgatgatgatgtggcaggattcttgtacttaaaatatgagacatgcaacagctgctctggggtgaggctactccaatgggctaaattcaaatgtctcatgcagtggagttgcgtttcaatgagtcatctgatatgctgatgtgccagggaatcagatacttcacagtcagaaggcagcaggaatcatgtgtgttgtggatgtgatgtgactgacgtggtgacagatacattcaaagcatcagcaggctctctaaacaaagctccttctaggaaaactgatcactgtggcaggctccctccaatgactgcaggctgggaattgaccataacagatcatgatgtaggttctagaacaagactgaggggtggaacaggagtcaggtggtcttcagagtgattttattgacattagcccaaccaaggctccaccatgctttgggcaatcagcacatctcagggcttggggttctggatgttggaatacattgcataactggtgcagtagcaggacatgaaggccaaggcagaaatttcatccgtactttatgtaaacccagtagactggtggtctcaaactccagagaaactaaaatccaactgttgggtactacgctcactatctgggtgatgggattattcatatcccaaacctcagcatcatgcagtatactcatgtaataaacctacacgtgtacccctgaatctaagtaaaagttgaaattatttaaaaaacaattgttcaaattcagatttctggtcttcattcccagagttcactattccactggtttggggtgggggccaataatctacattcaacaagccctttaagtgattttgatgcggataatgtacaatttccattttcaggaaataaaatgtagtagatac

SEQ ID NO: 2111 - DNA, 1070 bp, Homo sapiens
taagtgtgagccattgcctgctctggggcggggggagctggcggtgcagcccgccccggctcggctacccgggcatccccgggtgggcagggagggaggcctgcggggtgtctgccgcacggaagggatgggagccgcggtcgtggcgctgcctgcgcggggcccgggccggggctgctgctggtgcggggctggcggggttgctgccagggacggaagctggggtgggggagccgcgaggggcgtctgccggcctgggcggaggggctgggatgtggtcggggctgctgacgactttcgtcacatcgaggcctgggtggctggtgttagacacccctcccttcccacccgcaccctgccgccctcagccttcctgctctcctctagctttgcatgtagccaccgtactttgcaagccagagcttgaaaggaaaaacacaatttaggatcctttgctaagtatccaagtcccttctctcgctccgactgattgatgtgtttgtgtgggtggtttgacccccgggatttctgaagttttgacctttttggggtggctcgtttcgttgcatctgtttgcccacctcggtgtatttattattcgtgcccatgcgaggcagccagagggtgcttggttattgtacacgaaacagatttcactctcctctgcaggcagttcgcgaagtgccgccgccgcggctgcctttggtctgctggttaatgtcctttccctatcatccaccctgctccctccctctacggagggttagtttttgtttttgtttttgttttttcctttccacttactgtttgtgtgagagaagtcctgggcttaagggctctcagcactcgttcatttctcttctaaagctctgaatggctcaggcatgtcggtaaaatttggggtggtcctctttgctccaagagttgcatggccaaagataaaaatatgcacacataaacacgcattaattctgagagacggcaagcagtttgagagagaaataatttgttttcaataggaagtcggtgacctatgggatctcttccattgccggtgggttaggaaaatt

SEQ ID NO: 2112 - DNA, 1023 bp, Homo sapiens
taatttgtatgtgaaagttgatttgcctccagttttttaggaacatattgactacgtaaatctacttatacatctagtcaatcagaattcactcagagatattgggtcgatcagtcttcatgaaaatatacatctcctaaaaatactattttggaaatggatatagtgaagcctccctcccaaggtgagggaagggttacatgatatataatacaggttggaggaccctacacaatgtacgtggtgggtactcagatgacctttttttttccagctttactgtgtaaagatacttttatgaataggcttttagcaaacaaatacatctttggccactttatggtccttctttgagcctcaattttaaaagtcccgtagcatgcagtaaataaaaattatgcttaattgggttcttcataaaacacaaaaagcagattgcaatagaccagtataaagtactgcttagaaaactgaaaaaacagggatagggcttgtgtacaagaaagattgcgacagtgaaactatattttaaataatggtgacagttttgacttccagagatcataattcaagagcttatctgaagtggcatgtaaattacatacatacatattttttaaagtaggcaattatttagcttgactgtctcggttctgaagtttaattttacaagttatagttgcaacaagaaacaacatgacatgctgtggttatgcaattatgacaagagtggttggaggtaaactgggctaggataaacatagaaatgagcacacaacagtgtctccagtcaccaggtattaagaagtttctttgcttttttgttaactatattactagaaaatgtatttcccaggttgtaggctaatcacctaaactaatgattgctttctcttacatttgtgaaaggagatgcagcttccccagtctaaaatggaagctgagaagactaattggccaagctactggaaggctaggcccttttgctcatctcagcaacccccatagcagctagcacactac

SEQ ID NO: 2113 - DNA, 1048 bp, Homo sapiens
taaaccacatgttagaatatattttactttgcctggtgacttatggtttttcccacctgaactgggtgaggaaaggcgattgagaagttgattgttttcactgaagtgtgggaacctttttcatacccatcatcatagatacaagtgctaagggatgtactctcaacaaaccatgacatgcatgcatatcatagccattcctaaaagcttcttcctgaattccacagttgacaaggaggtctagtagagcccctgtattagcactatgtccttttacatgagacaattgaaaggccaggtgtaaagtaaggagatgctgcgggctgccaggctgtgatttgcaggaaacttctcaaagacacagatagtcagggtgacttcagtggttctatctcaaagttctgccaaaagcagtttttctaagataattttgttaacagttcttgcaattaataggttataaggaataagcaacatatatctcattatatgtttcaggtggataatattttgatgaaggaagtgagaatccaggaacatctcttgagttgcttagtagttgctgaaaattcagatattctggtttgtgccaggaatccatgacagtctagatgcgactcccaaaacaaattttatgcctcccttccatggcctccccaacacccacccctgcctcaccctgggatatccttcttcccctctactgtgtctcttgagatccaagatatttctcaaatctcacttcaaatcccacctcctccaaggagccctttttctgctataagagtggtttctcccttaccttccatgaactgctgtaatacttattttaggcttaatttattttattattagttttgatttttattatatatatttttgtccccagccaaatgtaaacccttctattgtgcccactgggccttaaaagtagattggtctaaataagtagttattgattgattgacagcttgtcattgatcctgaggctcacagtttctgtctatgaagaccttgctcccgtttgaagccttctttaatataatga

SEQ ID NO: 2114 - DNA, 1127 bp, Homo sapiens
tgtaatattatgtattagcttatgctgcatgcaaagtttaatgttttatcactttgttagttttgtatgtttggaatctgagtttagccttgtataacttatgcgagcacccaatgtagtaaaaatttggagccatggtttgggatgatgttgaaagtgccagtgtttaatcattgtgaatttataagtgtgtgcgttaatttgtaaggggattaaaaatacatgggtatttacatcctaccagatgaatagccatcaattgtaagaacactttaagttacagcaaatgattgctatttgattccagaagtggaggctgagaagcagtgtcattaaaggtttgtagtataaatagggaagcttattgcagagtatgtttgttactcattctcggactccactgagagggtcaaggagaggtaggtgaggcatcataatgtagcgggaagaatgtgggctatggattcagcggattctatcctagtttcgccacctcctaactccagattagtgatcttgaatgacaacggcaataattgacaatagtaataatgaaagctaacatgtactgagtgatgactctgtgcctaggtactgtgctgagtacacgacatgcactgttcctttaatgcttgcagcaactctatgaggaacccactactgttacctcttcttcacagacagagaatgactaagcctcagtgtgtttaggatcttgattaggtcttgtagctaatagtggtggtgctaagactggaatccgagcgctcctactttaaagtcagacttttaattgtcaactcccagccagttctgttttctctgcccccttcctcgtacactcctttcttctcatttactggttctttatgaagcaaatcagacattgtattatctgctctgtacataatagattgtcatttaaccacacaggtatattctaagaaatgtgtctttagatgatttcatcattgtgcatacatcatagagtgtacttacacaaacctagatggtatagcttgctgcacacctaggctataggatatagcctattgctcctaggctatagacctgtacaatacatctctgtactgaatactatgggcagttgtaacaaaatggtattt

SEQ ID NO: 2115 - DNA, 1037 bp, Homo sapiens
taaataggaaacagtttgaaaaggtcccatggtctggtttctgcacagcatggccatataaacttcattgcagatgggctaatggatgccaggtgagaaaggaagccctaaccttccacatcagggttttagaaaccatcaggtgggccacagacagtctgagttctcattttcactttttattaacctggcctctatttttgttacctaagatgatcgacataagacagagcagctggagaattaataactcaataatactgagattaggcagctaagaatgagaaaagtgtcctaaatagaaattgcagcaattcagtatttcctcgctgagtaggtagatgactcaatacacttggtaaaacattaaaattgctctattaagactggaatgttgtgttaatattgttacatcacagtggggaatggtttatttttgttgagggtggtttatttgcaaatcaaacataaagcctgaaaggaaacattacttttcattaaatagacggccagccgaatgaacagagaaggtgagtgaatttattctgctgcagcagcccagggcttggagggtttgtgcttgtaggaaaattctgcccccaaagagactttcatattccatcccatcagtgagaaatcactgttctactgggcttttcattgccttgcttttttttcccattattttgaatccagatcaacaaaggttattatttgggtcatttgttagggcctggagctttgtttgctaaattgagctataagttaaactgtttaccatcaaggagggatttttatctgtgttgagtctttgtgaggagagaggaatctctgataagctgctaactagatagaaagtgaaggcaattcccctgaaggctttacaccccttggggatagtctgacctttgaagaggcagttgtgaggccgatcaggtttcaccgccttttctccagcatcccaatctgatgaagtctcatgcataataaaaatggcacattagggtccttttatttaattctcacaatgcttcccc

SEQ ID NO: 2116 - DNA, 1953 bp, Homo sapiens
cagaaaactatgtttctgaaaaacgcccaggaacccgaggcattgagtctgtagatacagcggctggctgtctcactgtggggactcttggagcgggatataggaaatgaagtgacaagactgtcagctttgccgttactcctggagccttgtgaagaagtgtctctaccatgaaaatacggtccctgtgtggtggggttatcttcaggcctcttttcccatttatagtttgctgggaagtcaaaaggaaaaggaggaaggagattctcaaaatcagagaggaggagcaaggaaaggtcactctgccttaaatttgccagttttcctgaaaataatttttctttgtatacatattgcagttgcttcctccttcatctcaggtaaacctattgaccattgtgccttcttgtgtgatttacaataacataatatttatgtatacacagagagcttttgcaatagaaggtgtgccttgagaactgcagagtgcgtcttccctgaacctaacaccggaccagagttaagagttgctcaataaatgcatgttgaattaatttcactttttctttttctagaggatctctattgctcaggctggagtggtggggtacaaccatggctcaccgtggcctcgactcccaggctcaagcgatcctccctcttcagcctcccaagtagctgggaccacaggcatgccaacatgcctggctaattttttaattttttgttgagacaaagtcttgctatgttgcccgggctggtcttgaactcctgggctcaagcatttctcctgcctcggcgtttcaaagtgtgagatgataggtgtaagtcactatgctcggccggatttgattttagaccctggggaacccatctttggactgtttctcaaagagagggcagatattattcagcagaatcctcattgagcattggtcttactgtgagaattactgtgtttgtgtacaccaaagcttgactatgtaaacctgaactaagtgtaagagcccttctggtaggaaaaaaaaaaaatgacactgtattagaaagacaaaatcagacagcctaaccaaactatgtttttgtcaataaatgttcaaattccatggtctatttttattttcttacatagctttatttaaaatcctagattgacttgttttttgttgatactgttcctttgttaaaatcttggaaaaccatttgttgagttttatgacttaggagctaaaactgatgggtctcatgaccagtttattggttcttttggccacctttaggtcaattatgtaatgttttcttcttacttttgtgtggggggaaagcaagccacctttgctttcatgattttgtttttcaacgtttgagattgttagaggtacgtgtgatgaaggtcaatacttaataaacagtgcattggttgttggattggccacatgtgtagttttgggctgctatcttcttggaactttcattttaaaaatgatgagacataccttcctttggttcctcctgaccctcactcaacatgacattgttccaggcactggagcgtggccgttgagtaaagttgtggggtgttgcattggagatgggcataggtagcccaagtttatgtgtttaaagaacactaaccaggaagccaggaggcaaggacctctcctgttggctttactactaattaggaatgtgacagtaaaaaatcacttagcctctttggaccttcttcttttgactccttactcggtaagtgtctagactagttttcaaacttaagtgcacatcagaatcatctaggaagataattgaagcaacagttcctgggttttactaacagataatctgttcagtaggtctgggatggagccctgaaatttgcttattttgcgtgttctgttctgatggaggtggtctgtgagccacattgccaaaaacacatggcgtaggtcagtg

SEQ ID NO: 2117 - DNA, 1043 bp, Homo sapiens
gagcattcttggaagaagtccgatgggatggctttggctgatggataagatttcagtgggtcaagatggctagagaaagagtatcaggcagaaaaaggaataagcaatagtgcagcatcagggccgtgtggatgttcccgttgctgatcctatcctctcccgctcatttccctttcgaaactcagctcgaatatcaccttgtcctaggtgtgttcctgaggaaggctttgtttgaaatgcttgcagattttggaatcaaacacttgccttcctcttggtcaagtagcttaataataagcaaaatttgtgtaacactgtaagccaggcagcattcttagcaccttgcataggtctggtcatttaatcataacaacatccctaatgaggtaggagctattattattctcattttacaggtggagaactgaggtgtagaaagggtaagtaactcgcttcaggacacacagctagaaagtagaagtacaaagagtagaacactggttctttgagttcagaaactatgctcttaaccactccactagaaccttgctaggcggcagtttatttgtaaagccttgtgaaaaaattttcagcacactattcagcatgcggtagataattggaagtcttttctattgttaatatttcctgtctcctcagtttgattgataggattttcttcccgtacatatctctctgagagcattgttgcactttgccataactgttgaattgtctatttcacatgttagacagaaagcttcttgaggtcactctacgtacagaacttgtcccccaatggcttggtaagtgttgatggactgaacgaataaaatgttttgtctggcacagattgacttgctgcagggaaagcagtcctgtggagtggttcatacgcaagacgttaaggcatgtactactaggttttaatccagcccctaccatccattggcattatgtcttgtgtaaactatttatcctcccttaagcctccacttccttgtttacttaatggggacaatgagttgttataaagagccaag

SEQ ID NO: 2118 - DNA, 2051 bp, Homo sapiens
gagtaaagcttcatgaaaaacttaatatgttgcccttattttttacactttgcagaggactgacgttagtttccatactggcatgtgggaagctgtcactgacttatgacttgtccattcattctaataaagtcacctcacagatgtgtttataaatgcattaaaatcaggcatgttttcagagaaagtttttagaatataaaatgttataatgtaaaaccacgcccttttttcagacctctctctctctctctctctctctctctctcgcaaggagctgctctccttctcctttcttctgtctattaaactttccactctttacccccccacccaaccccataaaaaaaggaaaaacctattaatttatctggacctttttttttttacctgattcgactacactttaaattaaaacgtgctttgtttttagagctggagtttgttgctaacgaaagggtaattatagttcacaggaacactcaactcattggaacatacttgctgtagatattgaaaaaaaaatttgttcttttgaggcagggacaggagaaaagccaaagacaatgagacaggttttctggagagagctggttaatgcaatgcatgtggcccttaggagggcattagttagcagagccatgtttctcataggtgcattttgtaaaatgaaagttttagttcctatgaaaaaaatgttacatagggataatggtgaagattaattaaaagggcataatcataacctctctttattaccattttatcataacaattacattaacataatattattggctaaatatttcccttgccaagtagaaggatgtgattgtatggaccctgtgtttagaggacaaaatagttacccatatgggtgatatggtagagacttctatgaattttctcgggagattaactctttaaacacagaaaattttaattttgacaattttaatgatagactttagaattcaggaaatgcttcacactttggatcaaagtaaatgcaaagcaatttagtcttttcttcttcatgcctttaggattattgcgatggatgtcagttattatctcaaatgccatcgagagatgctcagggctgcttgaattggttccagagcttggtgcttcagagtagagtatacagtcactttttatatttttctgtctctctcctcactgtctactatattttatttctattccttttcctattcttcagcctcaccttttttactggcttctttcccaagcggcaagtatgatttgtcagctctatcttttaagaaatcctacttttgtgtcgtctgatcgagctcaacactccctataaattattcttgccaaaatattgaacctgaatttgatcaaatcactatatccaagtgccaatctgcaggatatagaagaattaaatgaacatgttaaatgatacttcaatgatacaatcagcaaagttccaaaacaaacagaactttacaggacaaataaccaaggggaaaagaaagacagacagacgtgtaatggatacctatagatcagaagagactaaagacacttgtcagccagtttcagtgtatggagcttacttgggtcctgagtgaaaaaaaaaacaaaacaatatgaaaaaatatgaggccactgggggaagttgaacactaatcagatatttgatgattttaaggacttattgttaattttttaaggtgtgatagtggtagtatggttatgattttttcgtggttttttttttttttttttggagacaggtactgatatttcgggatgaaacgatgacttgataattgaagtttcatcgtgggtataagagactgcattatactgttttctctactttgagtatgttgaaattttccataagaaaatattaaaaagcaacaacaacaaattaattatctgttttgagactcagtcctgtctatctgtactgcccattacttcacaaacatttctagatagagtggcttctaatcactgtagaggctctaatttttctgggctgttcttacagtttcttcttctgtgtg

SEQ ID NO: 2119 - DNA, 1034 bp, Homo sapiens
ctgaactaggtggatctcaagagtgggctctccttcctcgacagtttttgagatttcagaacattagtaaacttacaggtactttaagagtatgtatggcaagcagtagtgcccaaatacgtatttgaataaatacgtatttttggtatctcctcaaaaagttcactccttggccatgtgttgcatagggacatgcctttccatcttgctttctgagtgggaaatcaagtgagaatgggccacgctgcacatggttcttctgtgcccaccacaacaccagtgcgatgggtgggtctgtgcatgacttctagtatactgcagggcacagcacaccaacatagtgaggcttgtgttttgctgcagtcactgcccattctaatctagctttcttttcttgcaggtgcacacatcttgaccaactcagcagcaaggtggattttctttgtgtttaaagaaaaaaaatgtccctgtgtctgtagagatgatttgcagttcagcccggctgaagctgaccgaatgagactatgggctgtgcctccgccaagcatgttgccactgttcaaaatgaagaggaagcccagaaagggaaaaactaccagaacggagatgtgtttggcggtgagtcctatcaaacttgactcttgacccattgattctaggcctttcacttttttttattgatacataatatttgtacatatttatggggtgcttgtgatattttgttacatgcctagaatgtgtaacgatcaagtcggtatttaggatatctatcacctcgagcatttattgtttctgtgtgttgggaacatttcaaaacgtatctttgagctatttggaaacatacagtacattatttttaactatagtcaccctactctgttatggaacattagatcttattccctctaagcctttcatttttgtgacagtgaataattacagtgattattgggttataccgtctgaggtgaaagggtgatgagacctaatggaaatcaatgtggatctttactttggatcatctacatcat

SEQ ID NO: 2120 - DNA, 1052 bp, Homo sapiens
atggtggcagatgagtgatagtgataggcccactttttaaccatttgtaacccattatttctgtggtctcttattgtgtaacaaataccccaaacatagtaccttgaaacataaccagcttattattcctcacgattctgggggatggctggagttcatctgttgttctctcccgggctcagtcatgcagctgcatacagctgggatctcagctgaactcagctatcccagatggatttgggcttctgtccacaaggccactctttccagctgggtagccaaacttttcagcccggcttccaagagaaaaagtggaagctgccaggcctcttaggacctgagcttgaaagttcaagaatgctacatttgctgccttctgttgatgaaagcaagtcataagaccagcctagagttgagggaatagagtctctccacctcttgagaatgtgcccgtagaaagaggaggaattgttgggagccgtctttggagaccaacgcccattgcaagaggaaattatgactccatgactgggatatatttcaacctggacaattatattctgctttctaaaatacccctctgtttttcaccgaataaagtgaccttatttatgctttaaaagctaaacatttaaaatgttttaaatgttattaccacatgttgttgaagatgtgacaaagtctgtgaagggtggcatatttggggatggctctgaagtatgtgtctctgagtgtgtgtacacacacatttgatccttttcctaaaggtgttaatttaatttcaaagcttctgaagacatcctcaggagctttgatgcccaatgtgtttatacaaatggtaatttccatttttttgaagcagtttgggcgccatgatgtcttggttatttaggagctccaccacaacaaatgtgtgtgacagaatttctgtagcatgttccaccatgcagaattaaatgctaaatgggcatcttgactcctagatttcagaaaatttaggaaatcattgacaaggaacttcaccagtgatatttacttacatattttctttc

SEQ ID NO: 2121 - DNA, 1031 bp, Homo sapiens
tgagcctgaaggtgagaaagcttgaagtgtgtggagttgtatctctgcttccaccttggctggctggtttgtaaatttatctttcatccactgatgcttaaattggtgctgtgcagctgctgctagtcagtgaaggattccatttgttggctttctgtttaaaggtttgtggtagaagtcagggtagggtagattggtcctgttgtttgaaaaggataatgaaatatctaatagaagacagttataaacaaaatctaggccaaaaggagaacatttaatttcccaggttgctgattttctcaagagctactgtactatgatctgatcactctgagagtgtggttttgtttattaacttatatagctgtactctgttggtccagccagactataatagggcaagaagaagtaaaaatttacagaaagtcagattctaaaggattatatttctgtggctataatattaagtatatataaaattctctaaaatgtaactcacaacacatgtttaaactatgaataaaaatggtctttgacagttttttaaaggttacataattaaagtttcttggttggaacagccatagctggggaagatgcctgctggagaggacacaggccgtgaggaatacaatgtttatagtcagctttcttcatagtaataatctgtgctggaagctataatataaatgtacatttacattttatctaaaaataattttaaaagtttatgtacatggctataagcattgaaggtaaaagagtaagggtgaagtgaaaaatcatgatgttaaatagcacatctttgaagctaattaattccttcaaattgcaaaacagtcacacgagtacaaatctttatttagactacgtttgattttcatttgaaaaccacattcaagacaagctaaattacatttaaattcccttccagctatagatatgcatgcctcactgtataaatgtcactgttgattttgatctataaccaaagaagaaattgtcaaattatgtatgaaataggattttat

SEQ ID NO: 2122 - DNA, 1043 bp, Homo sapiens
gtcttcggttcctgtagccctatcagccttttcttgttacacctgtcttacctcctggaattcttcatgtctgccatgttgcatgacttgctgttccccccatttgctgtgctccctttggctttggaattcactgaccccttgcccgaaagctccttcccacacataggagctgtgttccttaggactccactgagatatatcacgtcctccaagactccgcttaaccttgattaggggtctcttctttctattcttataaccaccacccccacatgtgcttttcatggccataaaaactgtacacactactttcttattttcttacatcctctcctactcgccattaactcctttagaacagggactgactgcttcctttcctagacatattcccagggctgagtgttgtctctggcacacagtaggtgctttataaatattgttgaagtaaagaagaaacacagaaaggatagcaggggatagtgcccagcacttgactcaaggacagaaagcagatagtttcttccatctttatgtctggactaaaatcaagaggtatttttgctcagacctttttgggccagaagtgtccccataaaatggtgtgatttgtgggagttcatagaagtcaataagaaaaacaccacacctctaataagaaaaaaagggcaaaggatatgaagagacacttcacaaataaagaaatacaaataaatgatcaacacataggaaaagtatccagtgtcactagtaaattttaaaacattaaacaaaaataaaaattagataccattttcatccttcaatttattacatattttacaaaatgataataccctttattagtgaggctgcactgagatgagtcttacaccactgtgttagttcatttgtgctgctgtaacaaaatgccacagactgggtatttttgcaaacaatggaaatttatttttcacggttctagaggctgggatgtccaagaccaaggtgcctgcattttgtatctgatgagagtccgcttgtgccttcacatggcagaa

SEQ ID NO: 2123 - DNA, 1060 bp, Homo sapiens
attgcttgaacccgggaggcggaggttgcagtgagccgagatcacaccatcacactccagcctgggcagtagaatgaaactctgtctgaaaaaacaaacaaacaaaaaaattattaagagtaattatctcagtctgccaggatttataaatattaatgtcccaaactgaagttagggaggcccatttttaccttttttttttaccttttatttttatctctgtgtaattgtgttgggggcaaatttgtcagtgtcttctcttttttaattagcaattgtttttccaaattctcagtaaataatccttcatcaaatttgtcagtattattaatttacattcatttttgtctcttcgaaataccaagttggtatgtagaattcttttgtattgtaattgtggatcagaatctgctgattaacttgttaatatatttaggacctggtattcctaaagggctcattactgaacctcacactagtctttctaatatctttacaaaaaaatagaatcaataataactctaaattgtcaggtggaaaaaacagttggcttagtgaacatgaagtctttattcagatacatgcaaatgtattacattcttaagaatgataattttgagaaacatttgaacagcataattacttgcagaaatattactgtaacgaacatctttgggagttgtgtgttaaggggtgatatgatgaggaaacctgaaactatattagaaagtggtgttatagatactaagataagaaattaaataagagtatagtctttttacccatttaatcatagttaataagaaaatatattgcaactttctgaactgaaatataaactctcttagtgatagacagctgtctttcaggtggttcctatagttagacattacttcatgctatatgccagacaatcgttagtttgttggttgatgatattttctaatttcacaatttctgtgatgtttcccacagattgggttaagaatgattcagagtcacacctatttttgactttagtgcgctcaaatcatttcctgttgacaggaatctgatggaa

SEQ ID NO: 2124 - DNA, 1030 bp, Homo sapiens
tggttcagatcatggctttgcaacttattagctgcatgaccttggccaagaatcttaacacctttgcactctttaccatatcttacttttacacgcttcacctttaaaatatcttacaagggtgctagaattaaatgaactgatgtctctaaaatgcttaatgcaatgcctggtacataataggtcctttgcaaatagtagatgctttagttattagtaatctaaatatagtagttattattttaaaacatatcccatacatgctctattcttctagtcgtaactagtcttagagaggtagaagaatgaagtagttaagagccggactaaatctcagttatttagctctgggccttggacaagttatctctctgggcctcagtttcctcatctgttagatggagacaataatggcacccaccacatagatttatttttagcattaagaatggtgcctgctgcataataagtgctgcatcagtgatagctttgatgatgacaatgatgatgatgacagtgatgatgaaggcaatgatgatgatgatgatgacagctacatctttggaccaaataactttactctattttaataatataagtaattctgtgccttttgagttctttttatgctttcccttggtcatacttcattaatttctcccgagagtcttaaaagtctcttttttcttttttcttttttttttttttttttgagctggggttcacttctatttctcttttgtctattttgtttcaatattttcatcagctattagattcatcaagcccaacacttatgacttttttttccttatagctatttttattcagcaactatcctaccttgaatttatgatcttgcttacttatttccaagtggaaaactgacttcatgatcacccataccctactgaacgtcagtatcctccctttaagagattgccccttttcttctggtatttggggcaacagtcttgatatttgtagaaatggcattgtggtaatattgatgcaggcagaaacattttgg

SEQ ID NO: 2125 - DNA, 1020 bp, Homo sapiens
gtcatcttttgtttttgttttttaatatatagctaatcatgtcattccccagtataaagcccttcctacagtggcttcctgctgctcccgggtaataacctgagcagggatgacctctcactcctctctggggtcctctctctcccttccctctggctcaagctctggccaagctccttccccactagagcctgcactcctgcagcttcctctcttgactgctccctgacccctcccaccacatcctcttccccacacaggtttcattagagcatggaaccctatacttcccctttgtaactcatatcataatcgtaattaaagtcctgtttgctctaggcccctacttctaggtggttaatagctgtttccccagtacctagcctactgccctagcaggtcataagtgctggataaatatttgcaggatgaatgaatgaatgactgtgatcttgaacataatgttaaagaaggcatggtcttttatttttaatacttccggtagatccaagacttaggcaggttggatgctaagaaataaggcttcataacaacttcaaaaataaatgttccgacatgattttttttcagctattggttctttgacaaagaataaagtaaaattaaattatattgcaatcctcatttcaagtaagaagtgactagttctgtatacctttcccaattacaaatatccccaactctgggaacttgctccacacaatcccccataaaatgtccttcaggaaagggtgaatggatgccagccagttccacaggaggccctggccggggctggggagtgggcagtgaatggggtatgtgacggagcattttcttcaacatttggtgtgtacgtctctaccttgggctgcctttgtttctttgccatatccagacttgtacttggtccatgatactcagacctatggggacagaagttggttggcagagtaaagtcatgtgaatggttctgattcgacccaagagtggggtgggatctgtctgagagagcattca

SEQ ID NO: 2126 - DNA, 1044 bp, Homo sapiens
gtcatctttagcttgtcagttattgtcacaacttgttgggaagatcatcagcttagccacatagagttgcctaaatatttgagcagaaaccccagcccttctgcagggtctcacgtgaacatcctaccagatgtggggatatcaaggtaaaagacagggcaattcatataataataccaacagcatacactatgtgccaggcacagttctaagcactttacatgtcttaggaaaaggtttttcgtatccttattttagagatgaggaaaacttaaacacttaggtaacttgcctggggtcacacaaccagtaaagaatggagctagattcaaacccaagcaggctggctgcagtagccagaatgacccaatcgtagttcacagtagtattcactcaagggattcagtaggatccataatgattcataggacagaatgcatatctcaacaaaacatatgtttgttttgtgttgtctgaaggttgtagatgaagtacctggcaagcatgtcagaattctgagctgccactggatgagaaacttccatgtcagagaatcctttctccttcctacatggagaggtggtgagttagtgagtacaataagagatagtgcttatacgtagatgagttattagaaaatctttatggagcacacgctatgtgtggagcatgtgccagtaacaagacaaggatgattgtctttgtgtctctgagaatccagcagacctctagggagaagaaggagagttcacttcaatgagcccagagtccctcactctcctggctttttggagactgcctgccttccatagccacattatcctaagggaggaaagaaagagttaacattccatggccttatccaaagccttctttgactgttattgggaaacagtgctttgggggatgatactgcttagtgcaaataaaatgtcctctggcctgaaccttagagaaccctgagcatggcatccaccttgctgtgggaaccaacactttaatttcctttcctctggctcaacgcctgtaatcctggcactttgg

SEQ ID NO: 2127 - DNA, 1460 bp, Homo sapiens
aagtaataataacaactactgcttactactctagagttagaatatatatgcaaaatacctagactggactaggtagaagagatagaacacagctgttggtcttacagaataataataataattctccttatttacttatttatttattttgagacaaagtcttgctctgatgcccaggctggagagcaatggcgtgatctcagctcactgcaacctgcgcctcccaggttcaagtgatctcctgcctcagcctcccaagtagttgggactacaggaatgcaccaccatgcccggctgatttttgtatttttagtagagaccaggtttcaccatgttggccaggctggtcttgaactcctgacctcaagtgatccagcctcagcctcccaaagtgctgggattacaggtgtgagccaccacacctggcctaataataataattctctaaggctaagagaacaggagacaataatactataacattctgtaaattggaaagctgagagagtgaagagttgcatttcttagcaaacccaagaaagccagttatatgtagaatgaaccagaggctcaggaattgctagcactagggatctctggaaaccttagctggggtcttttctaattcagctatcacaggacacagcgagtcacctctgccatgtttcacctgctgcttacacggcacacagtccagaattagaaggtgaggtttgaaaattcacctgttttcgttctgctacctacagaagttccacagtagaaaggaaggagacctggatcaaaggataggctttaattatgccactaacagtatgaacttcatcaagtcctttactctctctagacgttagttaccactgatgtaaaatgaagggctagactagactacccttaaaagtgccatccttgctgtcaaacctcatgatgttagaacaaaaaagtatttcaggacaagactctgaggttgacctggttacttttcagaagtgtgtgcacacacatatgcacacacataataaatttagaacagaacaatattgtattctgatattattcatgaggataattaatagtatctaagaattattgaatatccaccatgttccaggtacttgcactatcttacttaatctcatttgatataataatagtgttttatgagagaaattctgttatcttcagtctacagattaagaaactaaggctctaagagtttaagttacttacagactttagaaacattaagtggcagagtctagcttttaaagatctggccaccttcagagccctggttctctagacctcaccatgcacctcttttctgaacactggtgcttctccagaaaggtcatcacattcattccagttcctatgattgctttcagtttgtagtatgactttattaccttcaactggaaaattatttggggtgtccccctgtaaagtggattggcatt

SEQ ID NO: 2128 - DNA, 1077 bp, Homo sapiens
gagatcacgccactgcactccagcatgggtaacggagaaagactctgtctcaaaacgaaacaaaaaaaagaagtgaagataatatataccttggaaacatcggaagactcaaacattttgtgattctaagtgattgtgaaaactctgatgtcagatgcatctggaaagtttaaattgtttcatgaaatgtgcatatggaaaaagtaatacttttaaatatgattttcacataatatgtgaacttaaatatatatgtcactgaattaacaaaccatataagtagtcagctgaaggtttcaaccacatccctaaaggattacgtatttatgtttgccaagacacatttctgaggatctcattggaaagacaggaaccactttacatttagacctatatgattcattaaagctcctaatcatgttctttaactttttttttctttgccttttactcaagtaggaaaagattttcacttaagtggagaggcaaggaataagggcaaaaggaaactggctcttaaggctgacttgactagcaggacctagggcgtgaaaaagaatggagagaatgtgcttattatatctttaatgaacccttaatttgaaagcctcctagtgaaagagtctcagagggaagagccgtgagagcagcaggggatgtggctcatttgttctcactctttctccctgaccagcagctgtccctgtcgggctgcggagggcccagtcctgtcactatcccgcatccacaggacgagctcagctcgggtgtcttaggggaatgcacaccaaattcgagggcaagtgtgaagaaagaaagtatgggagtttttaagaaagcttctaaaaggctgaaaagatacgcaaatgaagaaactcggggctcaacacaccactttaaaggactacaggatcctgtttgcagagtttagaatgaagatatttctagcagtacatttctcaaaaaggaaagaagggagaaaaaaagaatggcacttagtctctattgctaaataccgtatttcaattttgaagaacatttttaacccaaattctagctacaaccagtctcttccta

SEQ ID NO: 2129 - DNA, 1051 bp, Homo sapiens
aaaaattaatactgggggtcattttttactatagcataacctaccctattctgactgattaaaaacactctgggtaaaaattgaatgtggttcttccaagttcgttgattttctgtgtgtgtatataatacttatttgaaaaacttggagatatattatctttttaaaacagccttaacttataattcccagtggaatttatatcatagcttattttaattattgacatggtgacttaatgacttttaataaatttgttggtatgcaattaaatctgttctgagcaattttttacaactctgtttactttcttaagattgtaaatgtttgcagtctaccttgaaaagcaactttgtgaaaaatgttaggtgctttaaaactgatttgccccacttcatgtttgtttgatataaaatgagatacatggctgtattttaatttatagaaaaataacttccaaaaagctgagactttacatgccaactttattactactaaataattgtaacaaaatactaataactctaataatctctgtggacaggtaattgtaatggaagtattgacttcaggtaattgtattgatactggtggcttgagttaattgttgaatctggcagcttgggcttcatttgtaaacatcctgaaattctgagagtcaaggtggcttctctgatcaccatcattcagaagacaagataaaattcctttgtatttgaaggagacagtgtcctatctcatgttaataccgcttgagaaatcaagtgtaagacatcaaatgggattgttttcttagagattacatcctgtgggttactcccccaaagctagcattattgtttattttatagccaaatttttaaaatgtgtgtgtacttcaccacaaatctcttgcttctagttgtcaaattattttttctagttttcatgtgcttctgaaatgcagttgtgcaaatgtacacacacacatgctcacagtctgtgtgcagggcacaccctttgagagtcccaatttagtgcttttatgtctcctctctgtgtagggcactca

SEQ ID NO: 2130 - DNA, 1054 bp, Homo sapiens
agggaaggaggcagcatggtgcaagagaaagagcccatgcttcaaacctgggccaaagccaaggattggctctggcagcagctgtgtgaccccaggttaagttaaactctctgattctcagttttctcaccaataaaatttgagaaataatactaactggtctgggatattgaagaaaatacacagagtctccagtagtgtttgctgtgttgtatgtgctctgtaattggtagccttcattttggttgaagtcgcctgtgtttgtaccatcaaggccatttatacaggaaggatttgggatgggcttgttgggggtggtgctaaaccgaacctgaaaatgcagaacttagaaacttggatcctgcgtgagcaagtgccttcctacggtacaaatatctccttgtagaaagagtagtagaatcgcacagtttccagtgtattcatccacctccctcctatgtggtgtaataaacatgttcaggagttagattcttgtgaacacttacagagccattaaataacctgtgctaactttcgagctgtgattacagaatgagtcagtgagtcagtggcatggatacagctacagctgaatccctatatatttttttctgtttggaagttttactcttaattgttgtgtctcatttgaaaggcttttataagccttttaaaagatattcattggccaggtgtagtggcccatgcctgtaatcccaacactttgagaggctgaggtgggaagatcacttgaggccaggagtttgagaccagcctgggcaacattgcaagaccctgtctctacaaaaaataaaaataaaaattagccaggtatggtggcattcacctgtagtcccagttacttgagaggctgaggcaggaggatcacttgagcccaggagtttgaggtggcagtgagctgtgattgtgccactgcactccagcctgggtgacagagcaagactttgtctcttaaaaaacaaaaaagtattactatcagcctaaatatgcttgtaacaacaacaaaaaaaatttaggaaaggggctccaaaca

SEQ ID NO: 2131 - DNA, 1015 bp, Homo sapiens
atcaggcattggattctcataaggagcacacaacctagatccctcacatgcacggttcacagtagtgttcgtgctcctatgagaatctgatgctgccgctgatctgacaggaggcagagctcagcttcactcactcgcctgtcgctcacttcatgctgtgtggcctaattcctaacaggccatggaccagtagcggtccatggcttggggactagggacccctggcctagactatttgtctattttaaacctgtggaggaaaagtacgttaggcacattggaggaacagtttcttaaagtcactctttgagctgttgctctttaaactagcaggatttaaaattaggatgatgtcctttccttagtacttctaattcttatagacacacttcaacaaacaaaaaccccttacactagaaccttagaaatgtgtgttctgcactgacatcaacttacacttccaggaggataataatacagataactgaagaagacgtggaagcctctacacagagtagggtgtggtcggaaaaattttggtaggcaaaggttccttggggttttttgagtctgcacccgaaggcactcatggttctttcaaacaagccttctttgtcaccatcactaggagtttctgttctcccagctttcgagggcctcctagggatcttgctctctgcagctttcagtgtgtcctttgcacaagggtgggattgtgactaagatcctccagttctaattgagtaacgcatcctgacaaagacttccatttggggttcctttaagggggaagggcatacttctgcgaagaattgctgtgtatctcccaaacccggctcccacttcctgctttctgacagctgaaggtcttcaggttctctttttggcacagttctttaaaaattaaatgagacatgaagtcatgctacagaagcaggctccctgtcctgcccagtagggccagtgtgcagatggggtcccctgtgatgctgagatggggcccctccaatgacaa

SEQ ID NO: 2132 - DNA, 1025 bp, Homo sapiens
ttgagagaaaattgattacaagtaactatttcaggctctgctttgaatttctcattcacatgctcttttttctttttccctccaagggtcgggattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccattaaattacagtgtttcttaatgaacttgcaaaggaatattgctaaaaacaaacaaaaaaaactgttatcgaactttctttgttgctgctagttaaaacttgttgcaacttttcacttctcttgtgtccaggtatgcagcaaaattctgcaatttcaccttaaagatactgttggttttacagatgctctccaacctattttctataagatgaggtagtggtgaactcagataacaaacttctcttctaaactggttctgcttctaagacaagcatctcctgccctctctccttcctccccatctctcgcacgcagtctagagatggactgagccttgcttctcactggcagtgttgagctttggagatgggatggttgctatgccaagccttgtttctctgctcagaagaagtagagaagctattatcaattaaaagcatgctgtgatgtgactcctggaagtgacgtaggagtgagtggcaggttgtttgatttaataggtatcttaatcaagaattaagcttgcaacattggctttgctcagatgcagatggaagtgtgatcacaatcattttgaatccctcttcctcacttttttttctaagaaaataaacattttactgtttttatggatccttgtcttctcccattcatccagctcagtgttttaagatgatcctgggtgcagaagttgagccctcctttgcattgacactgataattagcctatagggctccctacccttccattaagaatctacca

SEQ ID NO: 2133 - DNA, 1103 bp, Homo sapiens
aaggtggcccacacctgtaatcccagtgttttgggaggctgaggtaggaagatcacttgaggccaggagttcaataccagcctgggcaacatagcgagatcccatctttatgaaaagttaaaaaagtagctgagcgtggtcatgagtctgtagtcctagctgcttgggaggctgacatgggaggatcgcttgagcctaggagtttgaggttacagtgagccatgagtcactgagccactgcactccactctgggtgctggagtgagaccctatttctctctctctttttttttttttttttgagacggaatctcgctctgacgcccaggctggagtgcagtggcgggatctcggctcactgcaagctctgcctcccgggttcacgccattctcctgcctcagcctcccgagtagctgggactacaggcgcccgccaccatgcccggctaattttttgtatttttagtagagacggggtttcaccatgttagccaggatggtctcaagaccctatctcttaaaaggggaaaaaaaaagggaaacagaaatgaaagcttctgatctcaggcagaaaccaacccaccaaacaaaaaaaaacacacaagatcacaaaaccccgaatgtgcagcctttagcaccaaggccaacagtatagaggaaaacgatagctagctcattgtttcaaatacatatgcaattatggcaggtggatgtggagaagtatggaactagctattctctttaagacagagtgggaaaaaaacggcaggaatcattagctatgacttgggggaagctagatgtgtgaattttaatatgcagtatacctctttttgacttagaagataaaagattagaggaaacaactggttgctggctgaagtattcaagttgaaagacattgctaaaggtagagtattttcttagctcaggagaacaagactgtttttaggcaatgtactgtcagaaacatttagcatgctttgatccacagaatattacagtttagagagctcttgatgctacttaacataaaggtttaaatttacaaatgaggaaactggaccctcagctataagtgaccagccctgtggttcacccaa

SEQ ID NO: 2134 - DNA, 1053 bp, Homo sapiens
agatgttgtccaattccaggagcccaaataaaagccaattgtgggctgcttgtggtggctcacgcctgtaatcccagcactttgggaggctgaggtgggcggatcatctgaggtcaggagtttgagaccagcctggccaacatggcaaaccccgtctctactaaaagtacaaaaattagccaggtgtggtgctgggcgccttgtagtcccagctactcaggaggctgaggcaggagaattgcttgaacccgggaggtggaggttgcagtgagctgagatcgcgccactgcactctagcctgggcaacaagagcgagactgtctcagaaaaaaaaaaaagccaattgtgtctttaaacttgttataattttgtcttttgataggcccccagtagacctagatcttgttcagttgtgttgacaaggatctttaggctgttgggatctagggagcacattcttgtcactggaaaaaatccttaagatcattttgtgtggcacctcacttcgtatcttctttgctggcttccactctactcttcagcttttcagactgtatcttggccatccattcttgttcttttcctctttgtctactctgtgtatatgttagtatctatacataggtgactctcagatattgttcattgaaatcacttttcattgagatctgaaaaacagaagctaaatgtatttcacattcttggcttgggcaagggggaaccacaggcagaaatgtagcttctcactaaacagaagagaaaagattaaatcgattttggggcagggtgaatttagattaaatttaaatgaagatgtatattgatctaaagcaaagagacactaattctcaagagtatatctgttcagtgacatgttcataagaattgagataatgattttggcagtctgcaagactttgcccctatttttggtctcaggatcaactgctgtactatctggtaaggtagcatccatgtggtagtatttaagactgtagataccagagaacatattattgtaatgcagacttaacagaaagataaggaagacta

SEQ ID NO: 2135 - DNA, 1052 bp, Homo sapiens
tctgcttaagttctcatcttccattctaggactctgtaattccttaccctccctgcctcatttttttcccatagcacgtatcactctctcatgtgttacctgctacactagaattatgacccctaagagggaagagactatgtcagtatcattgattcttattaacaccattatttagaaccatgcttggcttaaagtagtagctgctcagtaaatatttatctatgtgtgaatttttaagttcttcctttatattgaattaaaattagtctcttgtgtgcagcagtctgggtttgtcttatgttgaaatacttatgttgacttctacatacatttcagattctacttctgtgtttacaaatatttttatgtaggtatatgttcgtatatgtccctctaaaggcttaatattcacattcctcatttcttttttgttcctcatatgacactcaagattggtgtcattcttaaaatgctaccatcaggacagtatgtagtattatagacgtgatttgataaatgtaggatataatagacttaatgttctttatatgaacatattctttaaacgctgcctgcagttacattaatatagctctgtcacatcaatccttttttggaaaggtgtgggataaaaataaatatattgagtcttaataaacctgttaggtcactgtaatttatggtcaaataacttttcatttgctttagttgtggattttagaatatattttagtctttatgttgtgctatcaattttttgtcccattattttagcccgttcatacctttttttcaaaaattgtggtaaaagacatataacagaattttccatcttaaccatttgtaagtgtagagttcagtagtgttaagtacattcttttttttcttttaaacgattggctcctcaaagctgaacactcacaatgttgtgcagccaatctacagaactcttttcatcttataaaattgaaaccctgtatccattaagcactaactcctcatttctccctccccccagttcccggtaactgtcattctactttgtttta

SEQ ID NO: 2136 - DNA, 1050 bp, Homo sapiens
gtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctttaatatgtagtgaaagataattctgtagaaaaacgtcagccagtagggtaaagtcattctactgttcttaatttttatattgaggaacaatattgggtgtttgggagccagaaagctttgttgacagatcagaaataagattgacttgggtgttatatttcatctctctccagactctaggtatatttccaactttatatatcacagtatttaaaaagacatgtttgcattgagaaattaaccctaaagggttttcaatagggtgtagacctccagtacctttgtaactaaagtctgtctagtcattgtaaatatttatctgtcagttttgacagattggggccagcttgatgttttaaatcttcagcccggtatgaaaacttaaaggtatatattcaattttttaccattttatggaaaatatttaaaatctgtttttacagggttttttttttttttttttttttgtaatctgtgccatgaaatttgaaaaccaccaaaaatcaagggaacttttatatattcaattccttttctggtgtaatgttaaagttgtatagattattaatgcatgcccactgaatataaccctggttttgtgataaaactgcttagattttgttgatgacattagattagtagttgcattaaataactaaattcccattgtgattaattgaaattttgtctttaagcagagagttatttgtgactataagctttgtgcttagagaatgtatgtgtttttatctgtcagtatgggaggatata

SEQ ID NO: 2137 - DNA, 1034 bp, Homo sapiens
gcctccaggtttcaagtgattcttctgcctcagcctcccgagtagctgggattacaggtgcccgccaccacgcctggctaatttttgtatttttagtagaggtagggttttgctgtgttggccaggctggtctcgaactcctgaccccaggtgatctgcccacctcggcctcccaaagtgctgggattacaggcatgagccatggcgcccagcctgttctattttattattattgttgttaatatcttactgtgcctaatttataagtgaaactttatcataggtatgtatgtataggaaaaaacatagtgcatttagagttcaatactaaggtttcaggcatccactgagtgtcttggaacacatccaccaggcataagggggtgggggtgactactatacttaggtaagatttatttggagagtgcttaataaaaattatgaatttcttgcatacctattttgtgtcaggtcctgagaaagataatcaggaattggtgtcaatctgccatcttttctttattcaccctgatcctgcttcagatgttgtctccatccttaactgacttgtgttttgtttattcttgatgtattagtttgctagggctgccataacagactgaatggcttaaacaacagaaagttgtcaagcatgatggcttgcacctataagcccagctactggtggtggggagaggatcacttgagcccaggagttcaagactgcagtgagctatgatcgtgccactgcattcagacaacagagtaagaccttgtttctaaaaaaacaaaaacaaaaaccctccagaaatttgtcttacagttcggaaggctagaagtctgagatcaaggtattgtcagggccctattccctctgaaggctctaggccactctcctaacttctggtagttccttggcttgtcaacataactccagttttcacatgttctccctgtctgggtatctgttgttcagatttcccctttttctgtggacaccagggttaattgaattaggggcccaccctactcca

SEQ ID NO: 2138 - DNA, 1026 bp, Homo sapiens
ctcaacaaactctaaggccagtgcagtggcacatgcctgtaatcccaattatttgggatgctgaggcaggaggattgcttgagcccaggagttcaaggtaaaatagtgagccctcatcttcaaaaaaaaaaaaaaaaaaaaaaccccaaatacaaaaaactctcaagaactagattttttagtgattaaatctaatcctggggttgaaaatagattttttctttcttttcttctgtgcatatgcttacccaagcaaatagattttaattgagatatttagatgtcaattctaattagttgtcagtgttgcctggagtattaggacgagaagagttgagactgaacctcaactgaatccatgaaacaaatgtggcaattgatgagcaatatctgccttatctgggggaaatgtgtgaagctccccatccttgtagtttccatcccctttctaagttatacttggaagtatgttaagttgtaaagggtgctgtgagctggattggatcagaaacaaaaatttgagaaatagaatgattcacaagattttgtcaaattgtgcagaatgtatgtaaccctataggtctagaagaaactggtgtacaagggagccaagtaacgttgatttagattagaagtgtgaactttgcagaaatgtggtacaacccgggaccccatagaaaggagtccttgacaaagaagtctacaaatatcttttagcacatgaagtgtacgtcttcaaattttgtatagtgtctgtatgagaatttctgctggagattgtatagttggtctttcttattcatgttaataacatgaattaacaaattcatgttaattaatctgtactttgccaagcagtactgaaaattcttgatgaagttctcaatataaataattttctttccttttacaaatggggcctctgttacccatagggatctcccagagtccctacaacaggtgacactatcaagaggaggtatactagactgggaatgaaggaagaaaaccagtacttgttgtgtc

SEQ ID NO: 2139 - DNA, 1058 bp, Homo sapiens
cagctcaccgcaacttctgcctcccaggttctagcgattctgcctgccttagcctcctgagtagctgggattacaggtgcccaccaccatgcccagctaattttttgtatttttagtagagacagggttttgctgtgttggccaggcttgtctcaaactcctgacctcaggccatctgcccacctcagccgcccaaagtgttgggattacaggtgtgagccaccgcaaccagccaaattttcctttttcgtgaggacaccagtcatattggattagcggcccacgatactccaatgtggtcgcctcttaattatatctgcaatgactatttacaaagaaggtcacattttgaggtgctggaggataggactttaacatatgaatttttggaggacataattcaactcacagcaaatcatttagcaattaacattaaaaaaccaaaactctaactcttttactagggaaactcagtttattctaaaatttctgatcaaaatatttgcattagggactatcatagactctaaactctgatctcttttattggataggaacagagttctcagtggcagttatggagaaaggcattaatgtttggggtgctatttaagttctcaaaataatttgtattgttaaaaacctgttacttttttttttttttgagacagagttttacttcatcacccaggctggagtgcagtggcgtgatctcggctcactgcaacctccacctccttggttcaagcaattctcatgccttagcctcccaagtagctggaactacaggcacacactaccatacctggctaattttttgtgtttttggtacagacagggtttcaccatgttggccaggctggtctcgaactcctgacctcaagtgatccacctgccttggcctcccaaattgctgggattataggcatgagccaccgcacccggccctgttacttttaagcatgcatttaataaagtcgtatttaatcttttgttggtgatgtccagatatttaattttgagatggggaaaattacataggagctaggaattctggg

SEQ ID NO: 2140 - DNA, 1044 bp, Homo sapiens
caataatttagttgattcctaatattatttagagaattatatgtttttaaccatttctccattttgactttattgatattctaaaaatgttcgtgtccttttatttccagtgaattataacaaagagcgaaatgactttatcataaggtacttttgtttagacctttattttaggttcaggggtacatgtgcaggtttgtttttaggtaaatggcatgtagtgggtgtacagattatttcatcacccgggtgataagcatagtacccaacaggtagtttttcaaacctcaccctcttcccaccctccaccttcaagtagacctggtgtctattcttaccttcttggtgtccatatgtattcaatgtttagctcccacttgtaagtgagaacattcagtacttggtttctgttcctgtgttagtttgcttaggctaatggcctctagctccatccatgttgctgtaaaaacatgatcttgtccttttttatgactgcatggtattctatggtgtatattccatggtgtgtgtgtgtgtgtgtgtgtgtgtatatataaaatatatatataaatatatatatatgtgtcacattttctttatccagtctactgttgatgggcatttaggttgattccatgtcttggcaattgtgaatagtgctgtgatgaacatatatgtatcacaaaatacgtttaagacttgtaatacatgtaactgtaataaatttcacagatgttgtaaccattcacaatcttaccaacagtacaaatattccaggtttatcatgacactagtttgagtaataatctttcaaaaaagttttctttcttacacagtatacttcaaatttgctgaagtttgcatctctttcactatgactaaatgtgagctttgttcccgttgtttttttgctatctttttttagagttttcctttcatgtagtgtttggtattttatttttttcttatgaagttgaacaatctcttcagatatcataggttttaatctattttaattgttcataaaaatttatgtatttcaga

SEQ ID NO: 2141 - DNA, 1026 bp, Homo sapiens
taatagcccaagcattcattttatctgcacacaattatttcccaggaaaaaaattaaccaaggtgaaacacccagaaaaagtaaaatattgtggcttcaaatttacttttttatattgccaattaataactgcaggataaaaacgtacattcctcatctgtaaaatgggaaggatagagagagtataccacagttatggaggctgtgtgaggattaaatgaaagactacatgtgaaaatcttagcctggtgcctggctcctagtcagcatctgtaaatgacagcataaaggctgtctggcaaaacacatatttgatttttggcccttctcactgcaccattttcataaatatctgtaaagtccctcctgcctttactcttggccaggaactctcttgggtctgtattagttgtctggtaaaaacattagtagagcaccccttatttttttattttttgaaaagtatttgcttggctaacatctgctaacacccactcaaaaatggttcctctgtcgttttctgtgttttgtttaatagctcaaatgtggcttaaaggagactcgggaatgttgcagggaacctttttcttttttcatgggtaacttcggttcaagactctaagattttcttggtatagattaatttattcctcactatttcacaatttcactagatagagaatattaactcacaaaaattacatttagattgcttatgtactacctgtaatttaaccaggatttgaaagactctactcatgacctgcgtgattgaagtaataggcaaaatctagcacacaatgtgtcaagaagaaggtattctggttttggcatgatatgtacatgcagcttttggaaaaaggaaaaaaaacccagcaaattgaatggaattcaaccttcttcttggagaatgcaggcatcttattattaaaataagatcataagatattgttactttattgctgctctatctagaacaatgttctcccaaatttcaagactgcatttcaatgctagaagggagca

SEQ ID NO: 2142 - DNA, 1054 bp, Homo sapiens
tgcttctgtctttactattgtaaatagtgcttaatgaacacacaggtgcatatgtctttatgtagaacaatttatattgctctgggcatatacccaatagtgggattgcagggtcaaatggtagttgtgtttttagttcttgtttttttgcatcatctagatagcatgatgttttatgccaactccagtttatattatcattctcccttttttcttgctatcattccattcttataaaagaaacacttgaactctacaacattttgtatcttgaagtccaattctagttaggattttccatattgattaaaaaataaaaataaaaaagtctttagctgaaaacctgtatttatatgtagtagaaatgacacagaaatgaataaatgttacccaattgttaaccctccaattaaaaatgcatctatattaaatggcattatattgtaagaggctgaggcttttgttaaccaacagccttgaaaataaaatgtattaaaataattggaacttcagaatttttgaaatcatacagtcaatatttgagggctatgagcatccacagcctgaattaatacagaagtagttttgaatatctgccatatatttaaagcctttcttctttcctctgaggtttagccaaatactttttagtgcaaattcttgttggctaaaatagatttgtgtgactatgtttttgtctacaaagcacaaggataattagtcaactcagtcagaaacccattaactataagaaactgtaacatgcatttaaaaatatttttctaaccaaagcagacaaatgataatttcattacatggttttcaacttgttctggagaatatttacactcagcctttgaggctcttatttctgctcatattttgattaaaccaggtgaccaaaagatgtactttatgagctccatatctagcaagttccctgaaaacaaaaatatgacctggtattcacgtgtatataaggaaagccataatgttgaatctcagcccaggtacctggtaaaacataaggttgtttcattcttgtggtccaatg

SEQ ID NO: 2143 - DNA, 1056 bp, Homo sapiens
acagaacttgtatggttccagatcataattctgtagttttaaagctcaatccgtagattgtttcgtgtttactcttatgaaagaatttgttaaattattcattgtaaataatgcattcccagtgtcgtctctctgcagttcccacagtcgtgggccttctgtgaattggtgatttagttcttatatgaaatttattctttttctctagttcttacttttgaatcatgttgtgaagccgtctaagaaatataaatggaagcattttatgatattttgtaataactaaggaaaaataaatcaacagcggagcttaaggttgatttttccccaaaaatattttttagataagcattgtaattaaagttgctggtatatgaagtattatgctatgtcctaagcccacagtattatcatactgttgatctgtcatttgggaaatgtagatttttctgtacttagattcacagaatcctaaaattagataggttttcagatctgctaggattcaaatgctttattttatagattaggaaaccagagcccagaaaggttgagttgtgtcagtcacagtgcttggaccacaaaggctttggctgatatacaacatttctggaaaattatgaccctataaggcaaaatacagttgtcccttggtatccgtggggcattggttccaggaccctctcacctgcccaccccatggatatgaaatccatggatgctccagttccttatattaaatggtgtagcatttgcatatcttaaatcatctctaagttacttataatacctaatacaatgtaaatgctatagttgttatattatattgtttagggaatagtgacaagaaaaaacatctttaatgatacagatgtaatcatgctttaaaaaaataatttttcaatctgtggttggttgaatacatggaagtggaaaccacagatgtggaaagctgactatatacatttttagtactgccttttataaagtatggttgactacatttaaaaattttgaaagagcactaaagaaaaatttatctgacattcaatcaga

SEQ ID NO: 2144 - DNA, 1028 bp, Homo sapiens
aacaagctcattgaaacaataaggaaacagcctccagtaggacatttcagacttgaatccattctctgggctttagttttaaaatgcaaaaccgttttgtgactgacagtttactggtatcagatataccaccccagcatatctctggtagccttaactttgtggtactgaataagattcacatttttaacagaatccaaatgatgatgattcctaaattgcagtgttcaaaatactgtaactgtgttcctgcagtctctgtttgttttatagctcttttggatatcatctcttttacattttcatcctcactgattatgaactccttgatttaatcattcattatattgcctagctcttttattcaatatctttggttttaagctatagaaatgcaaatcaaaggagcataagccaatagagggaatgaatatactgacttccatccacagaccagagggaaaacagagtaagagctacccgtagtaatgatttaattgaaggactggttacgattcctcattatgagcgtggtgttgaaaaacatggattctagagccagagtgtctgaatttaagtccctcctttgccacttacccagctttgtcactttggcaagttatttaatcaacttttctcatttcagtttcttcatctataaaatgaggattataataatggtacccacttcctggggttttatgaattattaatgttacatggaaagtacttacaataatgcgttgtacaaagtagaagctatatgttgttattgtattgctatttatctacttaaataactcttactgtagtatgtattgctcaaggacagagattgtgttgctcatctttgtgttatcccacttagcatagtttctaagcaaatagtatagttctttcatatatgcttatcaagtaaatgaatttgactctacctcctaatgaactattcagaaattcatgtttacgattttagcaatgagaacaccaagacttagcaatagagtatcaaagataatacaactagg

SEQ ID NO: 2145 - DNA, 1050 bp, Homo sapiens
aaccccgtctctactaaaaacacaaaaattagccgggcatggtcgtgagcccctgtaaccccagctactcaggaggccgaggcaggagaatcacttgaacctgggaggcagaggttacagtgtgccgaggttgcgccactgcactccagcctgggtgacaagagcaaaactccgtctcaaaaaaaaaaaaaaaaaaaagaaatctggtgtgttgcttactagtttagtatcctctcccttatcccaggtatgagtaaaaggtttgatctctcatgtcaactctggttgatttgtggttgtttcctgctgcattgtattgagaagaactctggaactgcatctgaactttgcaagaaggaatacactatgtaataagtatttgctgcaaggcatgagatagcctcaggatagtatcacttctcttgctaaactactcccatgataaagacattgcaaatgatattttacctaaatgctgtatcttttcttcttgtgatataggagattttagttcctaaaaatgggaagaacctacattgtagaagagactgttggccagtatctttcaaacataaatctccaaggaaaggcttttgtctctggccttttaataggacaggtatgtatcttttactctgcatttataactaaataattactctgtaatttattttaaaaattacttgttgatttaaagttaaaagatgctatttaataataaactcaagattgggggatggaagaagaaatgtggaagaagtaactttaaagtaggtctttgaggaaacatggagaagtagacaaacctagcccaattttgctcgtcaggacaccttcccctttgaccatgtaaacgtaatttataatatggaaacttcagaattagaatgtttattgaccagatttttcacattttgttgtctttccaaagtgttttgtattcccttctaatctttttaatatctggttgtccagttctttacaaaagaagcttttgaaaattttattcctgttctaatttgtgttgtcttatatcagacttatggcaac

SEQ ID NO: 2146 - DNA, 1049 bp, Homo sapiens
ttattgggacaattttctttctagatatcttagcctgatgccttagaatcttcaaattacataattaactttccttattctgattctacccatattcccaagctactttcttttataatttgatgccccatgttatctacttataaagaatacactgtccagaggactcaagtgttcagatgccttcatgacattttagttttctacatcattctgaataaacttaatcaatgtcagtctagccatgaaagacaggctcattttcagaatttttacaaatcagatttcttaatttgcaagacagagggcagatctacatggttcaaccaggtagcaccactctgtgaggcctctcattagacagccagactgcctctcttgagaacagtgtgaatttctttttaattcagttgtaatgtggggctctttttgttaggagttttctatttaagtttttttctttctctttgtttaaaacatttaagagaagaagagtcttagagaaagatgtgatcagtagagataaaaagtcagggagaaagaccctcttctaaatttgtcttaactggataaaggttgtttctaaagctcaggcaaactgccatcttacaaatgagtgtctcataatttaaggccttccttcttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgatctcgtgatccgcctgcctcggcctcccaaagtgctgggattacaggcgtgagccaccgcgcccggcctaaggccttccttctatctctttttatgctgtagtatgtattgctcacggacagagcaattcattcctttcagtattctacgtgctttttcttccagagttcattacttttt

SEQ ID NO: 2147 - DNA, 1042 bp, Homo sapiens
gctaaccaaaacactctaatctctgagtgtagatgatagaaaaaaatccatgtggtattaagaactagccacaatcatgtgaagggaaatacagatatggagatatcatggtagtatgtatcaaaaaccttaaaaatatgtataacttcttaaaccagttatccacctcaagggatttgtcctaaacaaataattctatgaatgcagaaagatgtactaggatttttaatcaatattattttaaggtaaaattagatatagcaaagatgcccagtatcagtaagtgggcttaaaaatttgaggttaatctatgcaatagaaaataatggattttcaagtcagactccctctgttcaaattccagatctagtatgctgctaaaaatagggatacagaggtagaattacttattcccttaaggagctccctgaccaactagtagggttcacagataactatgatataagactatgtgataaaatccatgggaaaactacaccaaagccctgtcggagttcagagatgaaaagatcagagaaggcagcttcctcaagctgcctttgaagtatccagtagggttgagacatgcagaagtataagaaaaagtcagtttcggcctagggaacaccctgagtaaagacacatagttagaaagcctaggatgtgtatggaaaacagtttatagcctcatttgacactacttttcaagtagtttttgacaaatatttgaattacttgaggaaaagtagtgtcaaatgagggtataaacatcattgaccagatcctagaaagtctgaaatatcaatctaaaataaaacttcattttatttagctgatggtgggacgccattgaaaaaatatttcagtctttgatctcctgagaaaaggatttatttattgatgtagctaaaggatgttgttatcagatagttttatttataaagtagttttaaggtgaaaagctaaggacatgctaagcagacagtttctcaaacagaaaggattgcatataatgccaatttgttagctaataatatatttc

SEQ ID NO: 2148 - DNA, 1035 bp, Homo sapiens
acacgatccatggacttccaaagacagaattttaaaagtgaccattcctgcagaagcagggctttttttttttttaacaacaacaaaaaaaatctttagtatttaactgcaaagtttcatatacaagccctttaatccaataaatagtctcaggtttgacctcatataaaacagtggtactttttcttatggagagtgtatatttgagaagaatctcacgagtgctttgattctatttattgcaattagcgggattcataaaaggtaggaaatgattttcaagcaccgcaagtactatagtgatagcagtttgtatgtatgattatatatacacatatgtatatatatgcacacatgtacatatatgtacgcatatctttaaagtgttatgattttgtaagaacttttggatgcgtgcattttttagtttattttttgatagtttatattcttttagttaccaataatgccttttttggttatttctgtccttaattagtgaagaatattttgtcgaacttatgatatccatgatccaaaggtaagaaatttactctttaaagatttttctgtgtcacaaagtattttcaatcaaaattcagcttttatttagttttaataatttccattgccatcacttcctattgatgcctacaaacaactgtagtttttattttgaaatatgattaattttattacagataaggaaaacttttttgtgcgtgacagggtctcactctcttgcccaagctagagtgcagtgatgcagtcatagctcactgcagcctccacctcttgggctcgagggatcctcccacctcagcctcttgagtagctgagactatagatgtgcaccactgcacctggctaattatttttgttttttgttttttgttttttttgatagagatagggtttcaccatgttagttatgtttgtcttgaacttctgggctcaagtgatctgcctgtcttcgcctcccaaagtgctgagattacgggcttgagccaccacggccagccaactttttaaaaa

SEQ ID NO: 2149 - DNA, 1047 bp, Homo sapiens
taccagtgacaaacctatctaaatattgataatatttcttttccttttagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacaggtcattatatgatgctatttaagaacctggttagattacagctaagattttacctatgagatgtctagtttaaatatcatgtctttagattttttttaaagctagttctgtttgacacttcgaaatattaactgagacattttaaaatacatgtttaatttctacatgtctagacatacagtgagtatttcctgggaaattgtaccaaaatttaagatactaaggtatttttcaagcttagcaagtagatcttaataaaacaagttcaggattaagtaggtaaaattacaaagctttaaggtatttctttcaatataaaagttttctcaaaactcattatcttacttggtaaagcatcatgtcagaacagaaggttttaaaacactaatttattaaacattttctccatattatttgccttttttttttcatatacctttcatgtaattgggatactaagccaaaatgggcagttccagaaattagatgacttttatagagcatagatttgctttactatccaggttttgtaacacatttttttttccctagccatcactttcacatttgactttatactttggaagactgtttgggttttttgctttctttttgtttctagtgagttcagtgtatgaaaacatgtctataaataaatatgtaagttccttttctgatttcttagttattctttgcatagttaattctcccttcaggaatagggtgtttgattcagagtgtgcttgagattatagtgagtcaagtaagtatttgattggggaacttcaaatctatagtaaactgcctcaag

SEQ ID NO: 2150 - DNA, 1057 bp, Homo sapiens
gagctaagtagatttttgtttgtttgttttttgagacggagtctcgctctgtctcccaagctggattgcaatgttgcattctcagctcactgcaacctctgcctcccgggttcaagcgattctcctgcctcagcctcctgagtagctgggattacaggtgcgtgccaccaagcccagctaatttttgtattgttaatagagatggggtttcagcatgttggtcaggctgttctctaactcctgaccttgtgatccgcctgcctcagcctcccaaagtgctgggattacaggtgttagtcaccaaggccagccaatagagttttttaaaaaaatgtctgtgtagatactatgtttttactaacttcagacttgttcagactaggtaaactccttcactaaactttcttgtagttccctcttctatgctgttcttctataatactttacatacttgtaattatttaaatcatcaattgcatatttaatgttgatctttcacattagactataagatttttgagagtaagtagagtatttatctgtacctaaaacatggtaggtgttcctaattatttgttactgattcataaatactgaataagtgattcttaggaaactacagcacttcttgttttcacatttatttcatacttgagaaattattagcttatgcctgtacagacaaggtttttaagatttgtgtagtatagtatattgaacatgttgagggtttaaaaagtctataatattcatagctgtatggctcagtagttcagaacattttcaggagttttgaacatttaagacatgaaattatgtcttttatatgaaaatatgtagcactagttgttgccccagaaattttaatctagtttacagcatttagtatgtctctttatcagatgtttattaagcttatgctctgttcaagacaatataatagatatgaatcaataacttgattcctttcctttagaagcctagaggaaagatagaatgtatatgcgtgattagttatgcagagaatgtagtaaggtcctaagagtacctaagaact

SEQ ID NO: 2151 - DNA, 1048 bp, Homo sapiens
gttaggagtcatgaatactgtattgaccatacaagtggattatggttgtctggatggcagataccaatagcaacattgtcatatgcagtttgcctcaaatcagaaacaagaagacatcggaatctgagatgctgccctagagaggacagttaaagaaggttcagtggtcctcagtttgcagtgctctagctcctggcagaagcaagagggaaacattcctaatttagttccaagattcctacagattattatcaagtagtagtattttatgactagagatcacaggcacaagttgaaacaaactaacatgacaagaaagctatagaaaaaataaacattgaactcagttcttcaaggtttcatcaccaacataaggaatgaagttggaaccacaggcagatctgaaaaagaaccaaatagagctcctaaaaatgagaaatatttattgaaataagaaaaaagccctcagacatgttgaatattttattagactcagctgaagagacaagtgaactaaactataagctggatctaaagaaattacccagtgagcagtgaggagaaacaaggagctagaaaacattggaaagttaagagagttcgagggaagaattataaagactaggagtcctagaaagagaaaatttagagaataaaggagaggcagtacttgaaagataacacaattttacaaatttgttggaaaaacatgaattcataaattcaggaagcacaatatataccaaacatatatttaaataaaatccaggcctagactcaaggtattgtaaatgacaagataccaaatacaagattttaaaagcaaccatggggagaaaaagatcagtgaaagcaagacagtcaaatacttagtaggcttcctaacagcaacaatgtacccaaaagagggtagaattctgagaaaaactattagcttagaatttgcaacaagcgaaactgaaacaaacagatgctcagatgaaaaacagatgttatcctcagcacaaattcagtaaagagactacaaaaggatgatcttcaagaaggg

SEQ ID NO: 2152 - DNA, 1091 bp, Homo sapiens
ttccagtataatttattccttgaacacagaagttatttagatgtatgtgtatttattattaatagcaaatacatatttgtaattaatttctacttaattgcattgtggtcctaaagagtaatttgtcttacagtatactagttcattattaacttttgaaaatgttccttgtgtgttggaggtggaaaagtggctactttactaattattagttacaatgctttatttttattattttattattattattttgagacagagtctcactctgtggcgcagactggagtgcactggtgtgatctcagctcactgcaacctctgccacttgggttcaagcgattctcttgcctcagccttccaagtagctgggattacaggtgcctgccaccacacctggctaatttttgtattttcagtagagacgggtttcgccatgttgccaggctggtcttgaactcctgacctcaggtgatccacccacctcggcctcccaaagtgctgggattataggcatgagccaccgcgcctggccagttgcagtgtttttaatatgtcctttagatcaaacttgttaattctgtggttaatatctacatagatactaattttttgttacgcgatctagcaaaggttcaaagaactgcactgaaatttctgatggtggattgccacttttttcctgtagtctgtcagtttttactatgtatattctgtgacattttattagccatatatatgtttaaaatttttagatcatcctagtggtactgtaccattttatagttatgtaataatgtaagtaatattatgtatataagatatatttctatatctaataatgctttttctctttaaatgtatttgtctgatattaattgatacttgcttaaagaattgtatttgctagatatagtttttccatcattttacatcttgcttttctgtatccttatgttttgaatgtatctcttttgaatagccaatacctgggtttaaaaaatgtctaattagacaatatatacctcataactgttaaattgaaatcatttatggtttttgttactattattatgtttggaatgattgcctct

SEQ ID NO: 2153 - DNA, 1050 bp, Homo sapiens
tttttttactctttgacatctaaataaaactgttaggaattatttgatttcaaaaattaatttgcccgctcaaatattttttagattagcataacaatttatataaagatattacttaaagtacatactgaatagtgtcaataagaacattagatattgccatatttaattttaatttaataattattttttcttctagctttgcttgcctgtatgtgtggcctgtccttcaaagtcttcctccaaactttggcttttggcttcttccattttagggactggatttgatataatctataggaggaacaaagaaataataatgacacaagaattccaggatgtacatacatatatatagagataaatatataggtacatgcatatttatagtctcctgctgccagattccataagtaggctaaggataatcactcagtggtaaagtaagtggtaaagtatttagaatgtttctgtccgcaatgtaaaaggacattaatttaacatgtgttattaaagatgtctggacttaaggattttatataattcatcatttgtcttttcttaactcaagccttccagttaagtctatgtggttagtgaacattatttattactgattttcctaatttcctaatattatgtgaaatttgaatatatgacgtaatatatgttacttatttcatataataaaaattaaattaataattatatacttgctatgaacactatgtgtcaggcattgtttaaattattttatgtgtcaaaactcatttaattctcacatagctatatgtggtaggaacaattgttaatgacatgttgtaaccgaggaagctgaagggcagagagtttaagttacttgcccaagatcatacaataagtggtggagcaaagatttgaacctacattttctgactttggagccaactcttaatcattacactattatggaaattaacattctataatagagtcatttttctcagtatgatttggcaaatcaaatctttgaattggcattaaaaaatgatggtctaaggaacactattc

SEQ ID NO: 2154 - DNA, 1068 bp, Homo sapiens
caaaaagagacaagtgaatataattaatataatataatacattacaatacaatacaatattaattgagatagatctgtactctcgtgagttgttctgagattatggacctgaaactttctaatgctggtgtctttaaaaagaaaagaaagaaaagcctctgtaacaaaatactcaggatacaggtttttttactctaaagtctcatatttaaatagtaatgatggaataagaaaattaattcaccccatttgcttaattgttatatcatggaaagcagcatcccagtgtaagggcattaactcttgtgtatccagttatgttgatcatataatgcattttgaggaaacatgttctgtttttttacttggtaatcctgcatgctttttcaattctttatcttgttaaaggacttgcaattgtgaccaaatatattacaaagggctggaaagaagttcatgaattgtataaagaaaaagcactctctgtggagactgaaaaattattaaagtatctggaggctgtagagaaagtgaagcgcacaagagatgagctagaagtcattcatctaatagaagaacatagattagttagagaacatcttttaacaaatcacttaaagtctaaagaggtgagtgaattatatgttacagcatgtgattaaacatgagtaatttagtgtaggtgctaaaaggataaacttggggtagctatatatttatacttttaaaaagaaattatttaaaatatatcttgaaattgatgtctgtttaaaacacctaccatgatgtccaacatgatgtaggtggcatttgtgttagtttcactccagaaaatctactgccttgctaattaaaaaaaaaatcatctatgcatttccttcataaaatatacttcacatcctttttctagtaaaaaacaagttagcttatttgataagccttttacttagacatttttcattctgaaagtactttgaaccccaaatgaaagcctcagagactgtattatgaatatttttttatataggtatgttatactgatttattttcccttaattcctggtattt

SEQ ID NO: 2155 - DNA, 1111 bp, Homo sapiens
ctggcatacaaagatagtacaacatatgacaaccaatcaatgtaatacatcacattagtagaatgaagtgacaaaaaccacataatcatcttactgatgcagaaaaagcatttcacaaatttcaacattccttcatgatgaaaaataaaaccactaaacctgaaatgaacttcctcaacatgataaagtccagagatttaaaaaacaaagatgtttaaaccccatagctaatgtcataatggtgagtgattgtaagattttcccctaaaatcaagaaaaagacaaggatgcccagtttttccactttaattccacatagtattggaagttgtagtaataaggcaagaaaatgaaataatgaaagacattgcaattggaaagaaagaagtaaaattatcctcagatgccatgatcttgtatttagaaaaccctaaagttaacaaatgaattcagcaaagttacagggtataaaaccaacacataaaaatcagttgtatttctatatactagcaatgaacaatccaaaaaaagaaattaagaaaacatttccatttacaagatcatcaaaaaataaaagacaggagtaaatttaagaagctgtaagacttatacactgagaactacaaaacattgctaaaagaaattaagtcatgaataaatagaaacacatctgtgtttacagattggaagacttaatattgttaagatgacaatactatccaaagcagccaatctacagattgaatgcagtccctttcaaaatcccaatggcatgttttacagagatagaaaaacccattctaaaattcctaagaaatttcaagtgaccccaaatagccaaaacaatctttaaaaaaagaacaaacctggaggactcttcagtaactctttcagttactacaaagctgcagtaatcaaaacagtgtggcactggcaaaagaataaacatatagaccaatgaaatagaaagtccagagataaaaccttgcatatatgttcagttgacttttttttttttttttttttttttgagacagagtctcactgtgccacccagtttggagtgcagtggtgcaatatcagctcactgcaacctccgcctcctgggttc

SEQ ID NO: 2156 - DNA, 1044 bp, Homo sapiens
gtctatctactaaactagctcttggggaaatagcttcaggatactgtagtttcctctatctaatagagaactttttgttaacagacactgtaaaatagttttgctttgttgaataatacgtgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcacttgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcatt

SEQ ID NO: 2157 - DNA, 1031 bp, Homo sapiens
accgtgcccagccttgtttttaacaatgtaatgtctttcgctctttaaagagatggattatagtgattataatgcttacaaagtatgtaattaacagaactaaatacttgggtatctgtgaatataagcctttggttcatgtttagcaaactttctttttttaacctaaaaatggttatttctatatattctgaccaagccatatttaacattttaaatttttatttaatgatcggacttggtgatgtagaacaggaattctgttaacctcattttgcatatttatattctagaccattctaccttttatacttttatttatattctagattattatacttttaaaatactatgcatgtgtattaaatagagtatacttaagacactaataccaaacttttgtctttgcttgtgaatcatcagatctttacggactctatataacatggaatcattatatatgtgctgtggtttctcagaattaacatataactttatatctacgtgggcttttacgtgttttactcactcatttccaaaagcaaatagcaagtatagagatctgattttaagtttgtttttttctggacttcaaattgggattggatatcagatattttgttaatatacttgtttttaaattgtcatcagatttgtttttgtattattaaattatgtgtagattaatgaattcattcaacaagtacttattgagcatttgtgtcagatcctgttcttgttgctggtcatacagctgtgaataagacagatgagccttgtttagagagagaagtcagagatacttctctcaggaggtaacagttgagcagagagacttggatagcattcctctacgtcaaggcagggatcaagactgaggtccagtagagcaacagcaaggaggccagtgttgctagagtttggagaactaagggaaaagtcatcagggattagatactcccatcttatgcgatctgcctggttcttcctgacttcaatatataattcatggctgaagatttagtttaaat

SEQ ID NO: 2158 - DNA, 1008 bp, Homo sapiens
agcattattagcattttggtgctaatgtacttcaagaaaaatgaattacagcaacaacatattcatgtcagggaattttaatacatataaagcgaatattatttttatgtggtttagtttatatatcttaactgagatttattgaaaatccattgcacactggttgatacattttgtgtaagcctgtacaattcaactcaatttagctttgcattttgttaaagaataactattagtttacccaaaacatattagaggttttagttaatatctgtaacataacttttaaaattattctgccgatgactatggagttaatgccacaatcacaaaacacttgagatttattttagaaagaaagaaaagttattgttgccacgtatatcagagtaatcttgaaatcaagattactaataatttttagtaataaatttaacatcactttgttttaaaatgctgtaatattgatcgttgtaagaataggaaacacagaaaccagtttggaaatatattttgttaaataacaaaaatttatactatgaaacatagttttggttacatatattctcttatagtttagtatataatgctgtagttatagatgactttcagaattgcacaaagattttagttttctttcagcttaatagagctttttattccactttctatttacctgcatcagtgtaactttaattcaattttaacaaaattattgtcagtgttaaacatattttataacttttaatttcctactactccttgtatttttagattaaccactgttctttaacatacaaatgcttttattttctgtatttctctttattattttgaacaaatattaatctttaatgtcccttttaactttatgacagatgttttaaatcaattggtttatatgaaaaaaacctagtatatttaataacatgctatatttgggtgtttgggtatgtccttgatgggaacttttccattggctattgctggctgaacattagtttgttg

SEQ ID NO: 2159 - DNA, 1032 bp, Homo sapiens
gtgtaacagatcaaaggagaaataactgctggtgatgaacagcagtgtggaggttttgttgcctatggttgatcagctgcctgaatcctgagttgtctcatagggtggcattatgttagtaatttgctgtagcccagagaaaggctgagaaactaagtaatgttagtataccatgagaaactgattcattttaattaagcttatgagagtagcatttgaaatcaaatgctgatttattaatttgcagtgataaatgtaattaacaagggcactggattctcacctctagcacataacatgttctctgtgtaaagctacattggaaatcacagtgtactgtgcaatgagcatataataaattatatccttcaaatgtttagtggtattaaagtagtctgttatttttaactcttcattaaaaaaaaggacttgttgcaagtccagggtacctttccccttgggcactgcttagataggttttgatttgccattgtgatttctattccttgttgtgtctgactaatcccttgccagatggatatgatgtgttatttctttagatgtatagattactgagtcaactttaggactgtgtttcattccattctatttgatttgttaaaaagtgttggtgagggaactagctcttttgaatttgggatttataatgtagatatccaaaggatctgatttatcacaggagaggtgaggagcgatagactgacctttctgcacgtttgagctgtaaatttaggattagtcacatttagctttgttgatttggaaggggagagaagagcagggatttcctgctgggttttggaaatctttctttctttttaaagagatgaggtctcactacgttgcccaggttggacttgaactctgggctcaagccatcctcctgccttaagtacctgagattgcaggtgtatgccactttcctcagcatggaaatcactttctctacctttcacttattacaggttgatagtcaaattaatgaggctccttaaacctcaccctcccaat

SEQ ID NO: 2160 - DNA, 1034 bp, Homo sapiens
tttgtaaagggctacagatttttttttaagtttaatttcttaaggaatcctttaaacacatcttcttcttatttgccttttccctctgatgtctattacccagaattactccaagctacatatttagctgcataaagcagtgacagcttgtcttctaaacaatgacaaattttaaaatcagatattaagaaaccttttcatagtttcaagggcagtgagctgtatgaacttgcttatcaggtattagtgcctccagggctataaaaaggtaacacatttaaatgactatcatacacaagatattgacataccttccttggtcaggccatttatgtgaagaggattatgcccactgaaaatacttttggcacgccatcacttcagcaaaaaagatgctatcgaacatgcgcacatcccccaacagtctgcctcctgcgattgcttttcacagtatccaaagtgtccatctgtctgcttgtcttcgagttaccctccttgttcatatgggtcctagtcttctgaaattttccctttctttcattttctctctttcgttaaacaaaagagctgtagttgcccgttctgcttgtagcactgttgactcttcccgacagttgatgcattgaagctttttacatctgctattttcctggctggacaatgcagtgctgtgttctcgtctcagtatccatatttctactaataacactgagctgcaatgtaaagcagccagagctaaaatgtagtgcttcagttgtattggaaaagaataggatttacctctcttctttcgttgttgcctggcagctgcaggaaggattttgagcagttttaatggggttttagtctataatatgaaatccacggttcctcagctgctgcacaggcaggcagcagtttaaatgtgggcttgacagatgctctctctgacagagcagaatttaacgtcactgcttggctgaatcccacgtgattgtttgcattcattttgactaaaaacctaaggtagggagaagcttagagattttgctttt

SEQ ID NO: 2161 - DNA, 1099 bp, Homo sapiens
gcactcccagctactcaggaggctgaggcacaagaatcgcttgaactgggaggtggaggttgcagtgagctgagattgcgccactgcactccagcctgggcaacaaagtgagataccatctcaccaaaaaaaaaaaaaaaaaaaagtgtatgtgcaaagaatgaatgttgtttaattctcttaataatcctgtgtgacagttatttttgccatattcatttaatagataaagcagtttttactcaatgtaatactcatgaatcagtaatcctaaggcaaatatatttgttttaattagtcagtgtatagtgattaaacacctgccatgcacctggctgtatcaagattggaggagtagtagtttctgatgggaagtaaagtaccttgcagtctgattgggggaagcagacaaataattagggaattatatagtataatgaggtgttatggtctgaatgcctcccaaaatttgtgtgttgaaaattaatccccactgtggtgatattaagaagtaggaccatttggaaagtgattaagtcatgagggcatggtctttacaaatgaattaatgccctgtaaaagggctggagggaattagcttaaattcttttttgcccttccaccttccaccatgtgaagacactgtctgtcccctccagaggatgcaacaataagacatcattttggaagcagagagacacaaaacctgcaggtgccttgatcttggattttccagccttcagaattttgagaaatatgtttctgttatttacaaattgcccagtgtgtggtattttggtatagtagcacaaatgtcctaagacatgataaaggtatccagaaaatgccaaaaggtcaaaacaagggaacattggaattaagggaagagagagaatgaggaaagagagaaaaagtttgtgaagggaagtcttcaaatcagaggttacaaggtattagtagttagaaagcataggctttggattcaaaaaggcccagatctgttctgcttactaggcatgtgacctgggcaagtaactggtttttgcttgtttgtttgttgtagtttaattttctcatcgtacaatagatacaacatcta

SEQ ID NO: 2162 - DNA, 1029 bp, Homo sapiens
ttcaatgtgtttagaagttcaggccgggcacgatggctcatgcctgtaatcccagcactttgggaggcagaggcgggtgggtcacttgaggtcaggaatttgagaccagcctggccaacatggtgaaactctgtttctactaaaaatacaaacattagccggacattgatggtgcgcacctgtagccccagctacttgagtggctcaagcaggagactctcgagcttgggaggcagaggttgcagtgagccgagatcacaccactgcactccagcctgggtgacagagcaagactccatctcaaaaaaaaaaaaaaagaaattcacacacatatttaaacattctaatctttgggaattctaattatccagaattcataggaataagttactttttaaaataaaggtaaaagcattcaagggtatgactattatttaaataatttttaaaacatatgtgacttttgcccttattaatacaacagaaaagtagataggaaactcctggagtctgcatatatgttctatatatgttttcttcataaaaactttcaggccaagcgtggtggtacacacctgtaatcctagcactttgggagacttgagctcaggagtttgataccagcctgggcaacatggcgaaaccctgtctccaccaaaaaaaaaaaaaacaaaaaacaaaaactagcctggcatggtggtgcgtgcctggaggctgaggtgagaaaactgcttaagccccagaggtcaaggctgcagtgagccaagattgcaccactgcactgcaacctgggtgagatcctgtttttttaaaaaaaagttttcaatatttcactgtttcaggtaacattttaaaattaaatataatgtatatagtgtgttctttttcacttgcaacaaatatttttttctgatggtattatatattacgatatctgttccacttgtttaagcagcacatactggtactttgcaaatatcagaagattttagatgatctcatttgctaaaataatgaaagcaaggattg

SEQ ID NO: 2163 - DNA, 1060 bp, Homo sapiens
cttggtgaaattataatgcttctgacttttcaagagaaagcaggttttcctctccacttagcacaacttgtcagctcttttgtttttgtgccgatacctttcttttccccgctgggtagtgttttttcttccaatccaaatctttaaaaatatggaattgtcagtctgttccatattccagattattttttctgtttcttaatacattccgtgtgtgtgtgtgtgtgcgcgcgtgcgtatagcctttgaaaaatgacttcacctttgtctcttcatctttagggtggagggtggtggggttgatttctgcattccgttatgcagtgactactccacctttacttaaaaataatggaaatcagagtagaatgtgcttttagcctcttgggtggtgttggctggggagtcctagaaatggctataaattcatgacatgatttgcaaagaacttcccagttttgttccaagaaggtcatattctactgttttgtcattagtctgttgtgtgtcacaactgtataactctttgtatgtgtattggcgggggtgggtgtgtataccaactcaaaaattaaagttgtactgtactgaccttggcaactgaaattttcagtaagccttgagaagacaaaattaggtaacattttttttctattgcaacagacaggactttgattcaactgaggcaaatgaaagtgtgtgtggggtttgtagagtgctgagatgggagatttgactcatgtaatcaagaatggttaagggtaaagtaggtcttgcaggccactagaaatagatagtagatattataaagtgtattatattctacctcttttcttgcgttatagcttaattctctctttctgccaatgcattttctccatgagtcaagggtcatcatcatcagtgattttaggcttatttccttgtagctagtggttttaacagctagctctagtctgtaaaaaataatcccagagaaggacttttgattgatgtagtctaggatataaacctttcctagtgaccaggggatagagcttattgccaaaagggagtgatt

SEQ ID NO: 2164 - DNA, 1049 bp, Homo sapiens
gatcactagttggagcgaaggtggttaactgtattctgctttaatattttcgtagtgtttgttgcattctcatggtacttcttattaaacagaagctgtcaaattgtcctgttgtgttacatacatacctgattatttaattttggtatttgttaggaatttggactgttgctcactaatcttaatatggtattatttgaagtgctactggcttgaagttacgtccttccagagtgattttgtgattgctttgccaggtgcttcaagaatatctcaagccttgagttgatttttgtgttaaattcttaacataaggatttctagtccatctgggtagtataaattcaaatttgaatcagacctgagtgacattggaacctggctgacaaattatccaggagccccttttcttcccctgctccagaggtagagcaagatggatatgcttccccgacatttgattggaaacagtttttccctctactttaaccttttgttgatcatgtgactcttctgtggctctagttccagttcctctgtgtcctttccctatgtagttggtaaaagccaattcttagtactgcctacactttcctcatgggcaacaccagtgcactttattggtcgtcagcattttcttcatttgtagccgatgactattttctttctagctcagcatttcaggtatatgttacattgtatttagcatttccaggtgtttatgtataaagttcccgttccaataatgcagtgtaccagatagtataacccattttagtaggaacttattagtctgccaaatgtagcaaatttcttaattcatgtttcataattgtttgagttgtacctgaggggaattaaaaatgcagattattggctgggcacggtggctcacgcctgtgatcacagcactttgggaggccgaggtgggtggatcatgaggtcaggagatcaagaccatcctggctaacacagtgaaaccccgtctctactaaaaatacaaaaaaaattagccgggcatggtggcaggtgcctgtagtcccagctac

SEQ ID NO: 2165 - DNA, 1056 bp, Homo sapiens
aaacgattgggtgtaacttcctgattttggccatgttggcagccacatggggccgagttccaaagaggaaagattgtgcgcagaaggagctcagacgctatgtagagggttctccttacatccgccaaatactattcagcacatgtatgtgagaaaactacatgaggcctgggaaaaagtcaccgggaaagaaacaggcagaaaaattaccagagcgtagactggactgagaatagtacttgttcccaacagccccaggcaatgcaaaatgatctagccactttggaaaataatatgggagtttatttttttcccatcacattgaaaatactactctactgtcttctagcttcctttgttttgatgataagttagttgttagtgtgataatcagtcctatgagggaaatctgttccgtgtggttattttaaagatcattttaaatttatctgctgtagctagatgcggatttcttttttatataccccacttggaatttgtcagaattaaatctgcgtattggtgtttttcatcagttctcaaagtcttggtcgttttgataatccatgaaataagcttttttttttttttttgcatatgttctgttccccatccccccttttttctcacctctttttggaacttaaatgagacatactttagaccttctcattctatcttccatgtttcttaaatgattccattttctgtctcattttctctgttgcctgcatttttcattatttcgttacttttaatttatagttgtccatttctttggccacaccttaatctgatcttaagcctatccattgcaccttaaacttcagatattttatatttcagtttttatggttctgtttagttatttttcaaaccattatctgtctttgtaattcttttttactgtacatatttgcaagcttgttttattttctaagccttggtttttggtaattgtagcatttggagtccttagtcatcttcctttgaatgttgtttcatacatgataacttgttttcttgtgggtttagttttttactgttcattttatt

SEQ ID NO: 2166 - DNA, 1247 bp, Homo sapiens
agtactgttgtttgttatttaaggcttaagtctgggtagtacttgataggcttaaattttgccctctttaacatcctaagttgtattccatctggtcattgctgccattagctgatgcttctaagctgagagtggagttgtagtggaacaggatacatttgacagttgacctagggtagctgaattgatagtgctgtaatatatagcactttggtcacattctttgttaagtttaattagctctagagtattatatactttactaattccaatatatacagttatttttcatgatttaatatctctgaaattgtaatatgtcatataattgatggtatcttagagttgctgtggctaggtggcagtcctgacatagtttttattactggcacatgcacaaaatagtgatggcaattcctagtttcatcagttctgtgagatatgtgcatagatggtactatatatgttgaatttaaatgtagtgcaaaatatcttcaaaaaagatacggtgcaatttagcattgaaacagttattacggaggaacaaagagagaggactcacactacctgatttcaagacttactatcaagttgcaataatccacacaatgtactaacgatgtaaagatagatagatgaatgaaaataatggagattgcttaaatggggctatactattttcgacaaagacatcaatgcaattcaattaagaaacaaatgccttagcaataaatggtactggaacaattggataaatatatgggtggagaggaatgactgtcagccattacctaacaccatacacaaacattttttaaggtagattgtacacacaaacttaaaagctgaaactgtaaggcttctagaataaagcataatagaatgtttttgtgactttgaaatagttttttttttgaagggtgaaccataaaaagaaattttaaaacttctgttcatcaaaagacaccattaagaaaataaaaaggccagccacatgctgggagaaaatcttttcattgcacatttgtaacagaaaatttgtatctagaatcctgtgtgtcagtatttttaaaaatcctattaaaaataagcaagagatgttgacactccacaaaacaaggtatacaaatggccaatcagcgcatgaaaaaaattctcagtatcatcagttgttgaggaagtaaaaattaaaatgatgttgagatactatttcacatacccattagaaagactaaaattcaaaagac

SEQ ID NO: 2167 - DNA, 1050 bp, Homo sapiens
tgtttgaattcttccgcattagaggaatgacattcccattcttttttttttttttttttctcctgaggcagagtctcactctgtcccccaggctggagggcagtggtgtgatctcggcttgctgcaacctctgccttctgagatcaagtgattttcctgcctcagcttccagagtagctgggattacaagcgcacgccaccacacctagccaatttttgtatatttagtagagacgggatttcaccatgttggccagacgtctcgaacccctgacctcaaatgatccacccaccttggccccccaaagtgctgggattacaggcataagccactgcacctcgccctaatcccgtattttttttttttttttttttttttttttgcaaagcaacaaccaggagctttatggaacctaaaaatggaagatagcaatagtagatgaacctattttgcctgagatacatatgaaacaattgcctatcacacacccagcagtgcagcccaagccagaagaaataaccagttttctggagggatgatgactgtgatttatgtagaatatcatagtttaattggcagtagttttttcctttcatagtggtacaatataatggtgtagctcacaatcattgtgtcttagatttgatgaactgcagtagggtgaacaggtaaaattatattgactctgtggaatactaatctttttagtagacttaactttagggaagaggtcataagatctatccttatgttttcaaatgagatccttgctgaaaagcgttttgaaataaagccttttttattgctaatagagatgactaattctaagaaaatacgtagatataatcagaaattaacatgctacagcatctaaaaattctaggacggtggttaattgtaaaaaccacgttaatgtttctgagcttttataaaacatatcaaccaatgtgtagacctgcaaaagttgaaataggtgtataatagactttttattagtttggtattgtaatagatcactcatttgtatgtattttgcattctagtcatat

SEQ ID NO: 2168 - DNA, 1047 bp, Homo sapiens
tatatatataatataatttaaaatatatatatatttaaaacacacacataaatatatatatatatatttaaaattataattcttctctggtacctaatagatactttgagtaatatagaaaatgagtaagatgagaatttcagatatcaagcttaaaaccaagtaggaaagttatatcacttgtattttatgtttgcagtgtatttgcagaaataatacagtgtatacaaatctcatcactatgctgtaaaatactgcttgtgtgtattagttagggtctccagccattgaagcctccagcattttccctacttccttattttccttttcctttaattgtccttccaagaattcatggggagtaacatttttattctgcttccgtgctgatgctatgagacccagtagaatataagtgacctctgtccagcaaattccctttgctttggcaggcatcttgggctttcaactgttgtaagttacatcataaaactgaaagattatttaatagtgtgctgcattgccaaagatgattttgacagtttgaggcatgtatcccatgaaaggggaaattttttaacttaagatttaattttagtctcagagattttttttaattttttattttattattactatactttaagttttagggagattttgagcaggttgagaactttaagctggcagtttttaatagttgtaggtctttgcttgaatagaaggtaaccctggtttaatgtttttttgtatgtctgcagtcgtcattaattgcagtggttatcaaagtgtggtctgcagacctcaggtcattcctaagaccctttcacagagttgcaaggtgaaaactattttcataataatactgagatggctattctcatgatttatctgcccttaaataggaacagtagcatacccagtgccctagcatagtaatttattctcctccttctcttcttctcttcttccttttctctgtacttctaccttcctcctttctcttctccaacatgcccatgcacttgtttcttcatttatacaatg

SEQ ID NO: 2169 - DNA, 1131 bp, Homo sapiens
attttataaaataatgaaatttgagggcctacaaagaagtttgttctttctaggaaaactgggttgtttggttgggaaaaaaatgctttaaaaactacttataaatttagggtgaatgaaacagttgtaaaacaattgcaaaaattataaaagtctaaatggtttctatactcagattacttcctaagtaatcacaagaactcagataaggccctgggacctcgtaaaatggttgatgagttcctataatgtaatatttttagttaaagtaaaatatttaagatgtgtttgaattttaaatgattttttaaacaacttttttgattaatagttatcaaccactattccctattacattggaaaagtgggccactactctaattaacagaagggaacagaaagggcaaacaagattacatacgagtattgtccattgaattatgtttaaaagacttaggtgtaaaaaccagatacatgagaagtatagcaatcattaatacattctaatggcaatatcatattgaaaaggtggtaagtactgtatttgcttcatggaaggattgataagactctttcacatgaatgtttatgggactgttgcctaagggatttatagtagctaaagctcaagtttgaaataatctccgtctgtcccctacctccccccacccacttttctacttgtagggaccgcgttgtagccgtttttgtgcagggtcctgcatggcagttcaaaggttggccatggcttttgcctgatggatcaccagttgatatatttgctaaaagtaagattctctttgtatttactgtatccagtatagaaatgttctcactttatttaagagaaacagtcatatagttctgcgcatatgatgtgtatgtcaaaagattgctgttaagtaacatatgttaatgtttaagcatctgtgacatatttttaaaagctttgtatattaatactttctgtgtaggtatatctgaaagtgaatattgcctatcccacaacattactaattatttttagatcacttaaaaatcattggccagacacagtggctcacacctgtaatctcagcactttgggaagctgaggcaggtggatcaccttaggtcgggaggtcgagacca

SEQ ID NO: 2170 - DNA, 1020 bp, Homo sapiens
ttatgtttttagcagccccagtttttgttagtggtaccatcatttttccttagaaaatacccaagcttgaaagttttagtcatttgttcttctgttaccttcattcatttaaaaaaaaagaattctaatattactgactgtaggaaattggtcagggtggtgggagaaatagaaaaaagatgcaaaccttcttggaaggctgggaggttttgcaaaagctttgaaagataatttggctgaagtcaactggattctcttacccggagcctgatagcaaagattagataacctggggatgtaaagaaattgatctagataagttagtttacttaggcctcccagaacgtggcctttaatcaactgcaggagtcgggaggtaggggtggcgggttggaggtggtgtggtggggtggcgaggcagtggtgaccacgttaattacccacaagtgtgttgactcaaagcctttgtcattaaatctgtaataaaaagatgctggcatgtcagggctgcggctgctgtgactctttacggcatcctcctcgacgtctgtgagtggcccagtcccctagctgcacgtccaggaaaaaacctgtgtctgcgtacattttccttctgtcgttcggccaggatctgcaggttgggcccggcaactgacattatgatagctttttatgttatttctgaaacttgagtgatacacagagttggtaaatgggaagttaaataaaaagggaatgagaattttaatgaaagtaaaatgtcaacgagaattcttttttacctacttgcttgccttgttgaataatgtttcaacaaaaaatgattaggatgtctttaagatataaatgttgtatgaaattcattaagaatataaagttttaatttttgttcaaatttagtcttctgaaatttagataagaatttagagaattttaacaatcatcagtgatttactttcatgaactgttctttctctttcacctgttccttctatactgactcctttttctcagcgttta

SEQ ID NO: 2171 - DNA, 1027 bp, Homo sapiens
agaaactttttactttaatataatcccatctatttttgttgcctgtgcttttgaggtcttagccataaagtccttgcctcgaccagtgtcctgaagcagttctccagtgtttttctgtgttctcttgtattccactcagtttctgtgacatcattattttgaattctttttctgatatttcctaagtttatttttcattgggatctgtagctggagaattattctgtttttcttttttttggaggtatcataatttcttactttttctgtttcttgtgtcctatgttgatatctgcacatctggtataaacattgcttcttctagttttttgaatttgcttttttaggggaggacttttccccgaagatgtacctatgattttgattgggtggggcactttggctttggttcttcatactggctgtgtaatttctaacctataaacagcgtcagtggtgtctgtggtttcctcagtggcttaaggtttgcttgttagtggagggtgtggtgaagttttgctggggtcagtgacatcaggcaggctattccttgggccccagtggtggcagcagcaggctgagcctgcctgtttttgagtcccaaggccacgtatgctggcacctgtgctagtaagtccagacatcatcttgggtgccagcagtggcagtggtgagcctggagggtgagcaggtcaagtttctgggcagtgggcaatggcagtagcagtgaaggggcaacctctggctccccagaggtccacactgttaccaattgtggctttgatgggctggacaggacagtgcgcaggcccacagggggtgtgtgcgggtgggtaacagttgtggtggtagtggcaggttggttgggcgtgtcttctgcccctgggaaaagtgctcaggtgccaacagtggaggatgttgcagggccaccctcaggccccaaaatgtgtgctcaggcactgctagggcggcagaaggggaggacagagcccagccaagttggcctgtcctcaggcctccaggtcgc

SEQ ID NO: 2172 - DNA, 1044 bp, Homo sapiens
tttaatattagccttctagtctgtaatggaaattgtatattttgatagaagttttttctccattggttaaattagcattacttaaaatttgtttctttagaaaataaatgcaggttataaatgtgtgtatatttagagattataaggctctctgagccatcttctgatttttcattgctctataattctttttactgaaaatactatgttatgaatggtattaaattttagtctctggaacatccaaaaccaagcaaagggatgtgactattttgaatgaatcagaatgtcaacttgtatgtacactatatctacacttactcattatttaaaaagaataatgaaaaatctagatcaattcttcaatttgattgaactgttcagccttttcaagatttctttatttacaaatgattacatttaaatgaatgtacattcttctcactgactttggtgattttgaaacctagaatgatgtgtttctatctgtaatatctttccatttgaaaaaaatctcaaaacacagattaaaaccacaataggctgtagtattttttattttgggagccagagtatgatttgggggaagaatatgtatcagccctattgcagtataactttaagctccttttctctttagtccacttttgattgtaatttttatggtataggattttgaatcttctattttaggcttgtcagtcttggagttcttatcttccattatccctaaatattgataaactcccaggcaccaaagaaaacatttgcttaattgtctgaaaagaaacaagagaaaaacactggtatttttatgtctgtattcaatatggtataaaatataaaaactatattttaacttagtgaaatattttactatttctctacttcagacaaaatgttgcatccaaggtacatcaagtgaccatttgccttgaaccttgatttcactttgttttttttttttccttaaaggcaactaggaagctttactttcctaaagtgtttttgccattggaatttttgctgatcacagtcttatgt

SEQ ID NO: 2173 - DNA, 1031 bp, Homo sapiens
atatttaaacaatgtttaatgtatttcattattaactagtattatagtttgtttttttcccatgtctccataacttttactaacatttgtttttagcagcacaacagtaatccatataaaaacaactaattcataatgaggaaaatctcataatttttaaggcagaaagaagtattaatttttgatctgccatgtagaatgagacaaatacagtttgcttatgaaaggaaagtggcatacttttaaattggtctacacagaaaagtaaaagtaaactattcatttaaataagattcattatctaataaatattgagggaatatttttcctaaataaaaatttttctgactgctaacaaaaattaaagtgattacattgttcttttttggaggggtggggaggaatatttgttgaactaaagtatataaaattttttgagactagcagtatattttataatattacaaatacaacaattatttataaaagctagtcaaattaatggcttagaaagtagctgtaaactttgtgttttgaaattgcttgtttaaatgcaaaattatgagtaagataagtctttttaaattttttatttttaatttttttggaagtttattaaagcccttcatatacacatactttttaaaaaaagattcttaataaagaaattattggtttgtctggttaaagtccatatagaatgctgagaaataatttataaaataagaactatagaaatttgttctcagctgaaaagttggcagctgctctgtttctttaaaaaagtacaacatgaaaatttaattacattagccttaatattacttgactgaatttctactatttattcacttgtgtttgagattcacccagctattctaatgatagaaataaaaagtggagaaatgactaaagttgacttaagttaagaattggagtgggaattttgaaatgccatgtcctatatattctggcatatttgttggcacatttgcaagtatgttgatcccagcattgtttatatctgttgg

SEQ ID NO: 2174 - DNA, 2023 bp, Homo sapiens
aaataaactttctagcaattaaactacattaaaatgtggtagaaaaagagaggcatggccactattggggactaaatagtggccttggatatcatgtagaagtagttatctttggaaaagtaaaaatccaaagacacggagatttcaaaaatcaaaacacctagaagacgagtctaagatatttaatgtgagtaagtgaagaaccacaaggagaaaaagggaaacgatacaggagggcacaattactaaatactataggaaactttagttcgaaagggctctcactctaataggttccaagcaacatgggtggggttggagtgtggggacacacctaggcagataaatttcattcaaatatttattgttacttcctgcagtgacaagtactgttttagttgctgggaatacagggtgaacaaagcaatgttagttcctttattgggtggaaggaagtaaatgaataaatatgtctcaggtggtaataagtaatacaaaaaaaaaaataaagcatagtagagtgactaggctatgttgggataaggtagtggcaggatttactattttatatggatggtcagagacatctcagataagatatttgatcagcaatttgaagtgaggtatctagtgtggtaaatatgtggtggtggggggagagcaagggcagggggagcagcattccagatagggaacaggaggtttaaggcaggcaggaacatacctgccatttaaaggaccattaaggaatccacttggctagtgtggagggagcaagaagagtgagcaatgagggcagaggcagtagtgaacaagattacggagctttgtagatgaatggaagcctttttggctttaatttgctgatacatatgggaagccatttgaggagctgtaagcagaggagtgatacgtgatttaagagtaattgactcaaccttcttgttggtagcaaaggcagaagctaggacaccagatcattggatattgcaacaatatagacaagaaatgacacaggcttggacccgtgtggtatcagtggagtaaaacaaatggtgagattctgtaaatattttgaaagtagatggataggattacaatgtgtgagatacaaatcaaaaacacttcttttttttttttttcccctcagtaacaggatggagtttctgtttatactgtgatggggaggattgtgtaaggatcagattttgcagtggtagcagctggaggaatcaatttagtttcggaatgttgagtttgagatgctattaaacatggaggagatattcaaattcttgaatttcagggtaaaaagaggaatttacaaaggaaaaagaaaatgacatctctagactttagaatgcaaccaagaatccctttttcaggtaagatcattcatcttgaggatatgtaatgatccaaatgatatatctgtatgtgtataacttcacataaggaaaataacttaaaaactttaaacagacagcaaattataacaaaggcctgtattctctgatagagtgactgggtatttataacataagtgttaagtaatcttcaagcagaaaagataatacatggaaaaatctcacactagtaactatcagtactaaagtaagctatcttagcaaaacttagaagtgacagctgagccagaggagtagagtgagtgaaagcattctaaatttcacaaccctagtgacaacaaatgtttgccttcatggaagaacaacatttgttcttgcaactaatcagaacttacatatttttaacaagtagctttctaaaagccactaaagccctttggaatattttttaaaacaacttcttttgaggttatggagatttttaaataggtcaggaaattatttctaagttgttatattgtgaagataaaaaagttttggtaggtaatatgtttgcagccacaaaagcacaaaatacaatgtttttaatattcaagatgtttcaaaatgttctttacgtggcacaaacttttttctaaaagtattcacagacttct

SEQ ID NO: 2175 - DNA, 1032 bp, Homo sapiens
catcacttttattgtcattcttaccagactttatttgatggaggatgtgctaattcccttaaaagaaagcaaaatgaatattggtttaccaaaaataactacaagggcccttattgaataacattgagtatatgtttaaaaagcatttttatgatattgacaaatatttaaatgctagaatgtttaaaaagaaaaaaagatgatttcttatttctcttaagagtcaacttgattaggaattcatttacttattcaataaggatttactgatctgctaccatgtatgaggcactgtcctagggctagagatccagaaataccaaatctgtgatgttttttatttctatcctcaagatcatcatcatttggagagattagcaatgaatcctatgattatattgtagaagagagtgctaagttgaaatacatatggggtgagatgagaaggaggtgggtggctcctacctcaaccatgggctctaaagaataaaagagagggtgatgcttggactgatcttgaaggtggatgagaacaaagattgtaccaggcagagggtactttatgtgcaaagacaggaaggaatgagggaaaatgatgaatggagggatttaattttatgtaatataaccagatcataaaaggttcttcttgaaatgttaggggtttaggctttgtttggaggcactagaaagctggtgaggaattttaaataaaagaattatatgctcatttttttattatgctaaaaaacacataacataaaatttaccaactttaacccactgttaagtgtacagttctataatatgaagtacattcatattttgaaagctctccagaaccttttcatcttgtgactctgaaactctatattcattaaacaactctctttgcccccctccccatgcccctggtaaccattctattttctatttctctaagttgtactattgaaatacctcgcgtaagtggaatcatatactgtcttttgtaactggcttatttcacttaaaataatgtcctcaaagttc

SEQ ID NO: 2176 - DNA, 1027 bp, Homo sapiens
agccactggagtaactgggtccacagatgcatgccactacgtggagctaattttgtttattttttgtagcaatgagatctcactatgttgcccaggctgggcttgaactcctgagctcaagcattcctcctgcctcagcctcccaatgtgctatgattacaggtgtgagccctggcaccaagccagtttgatcttatttgtctatttttgcttttgtttactgtgcttttgagatcatatataaaaaaatcattgccaaggcaaatttcatgaaacttttcccccatgttttcttctagtaatagcttcaggtcttacacttaagtcttaaatccattttaagttgatttttgtatatggtgagacagagggatgtaatttcattctcttgcatgtgaatattcaattttaccaggaccacttatttaaaaaccaatcccttccccattctgttttcttggcacttttgtcaaaaatcagttggctataagattgtggacttatttctaggcgctgtattctgtactgttggtctgtgtgtctctttttatgccagtaccatgctgtttggttactatagctttataatatgtttgaagtcaggtggtgtgatgactctgtgttcttttagctcaagattgttttggctatttggggtcatttgtggttttatacagattttagttttttttcctatttctgtaaagaaagttatgatattttgttagggactgcatagaatctctagattgctttgggtagtatgcacattttaataatattaattcttcaaatccatgaagatgatatatttttccatttatctgtgttttcttcaatttgtttcattaatattttatagttttaagtgtaatctcttacctccatgatgaaattcatttctaagtaattttttttttgctgttttaaataggattttaaaaagttttagatagttcactgttaatgtatagaaacactgctgattttcatgttgattttgtatcctgccactttactgattttg

SEQ ID NO: 2177 - DNA, 1069 bp, Homo sapiens
tggatatattgtttcattatttctatttatgtatcagttgtcttttaggaactaggttgaataggtagtcacatagagttgcttaaaataatctcaggtagcatttatatccttctgtaaaaatacagttacaagtaaaaatgcttatatggttaaaatagaagcacagatgatttttttttcctcaggggtgtcatttgatgtgtggaaaaaaaaatcagagttgtcaactgacattggtgatagtcctttgtcactactcaggttcaaatagatatattttaaacttagattttaaaacatacagctatgaaaaatgatatttcaacaggataatcttcagtgatttttgataacgataaagtctgacaaagtatttctatttaaatacactctgtgaagtaacatagtatagagtctcgctaacatagtatagggacctattattctctcactaagtaggatttaagcttctggtgagtgcttcctttggatagagtaaaaagttatatatctgtagacaaatgaagtaattctctctactcagttaaaaaagaagaaagaatgtatatcttattctatttgctcattgcagatgaaatcaggcattctcctatctctttaataatgtatagactgtacaatgtcatggattctgaggcagtgtttggtaaattaatgaaagtgtaagctttagctctacttctgtaaaaattaaatgtggaattcaatagagtgtgtctagactgaacagagcattaaattaaatttgtacttcattttggcttgagaaaataaggaaattattggtggagcatagaacgtggactattcatagaactggagcaaattattagttttcgatggcaggcttattcatatttaaaagaatgcttggatattatgtaagccataagtttttagcttaagcatatagcaagagcaaaaatatattaaggccaaaagattgacaattgtattttgtatttactctctatttggatggaggaaatctacacaaaaaaagtaattataagatagattctccatggaaaacatagatcaatga

SEQ ID NO: 2178 - DNA, 1040 bp, Homo sapiens
cataagttcctttttcatatgttagattgaataatcttcatacaacttgaataaatattaaacaattgactggcttttgttagttcattgtacatgctaaacattttttgagaggttttcattgttgcttcattacctaaaaatgtaacctctactagcaacattggtttatttattattctctttgcttatatggtctcatacataaattggaaaatatttttattttcaaagtcaacaaaattataatttatgacaattttaatacctatgtttgagtcattacaaaactaattttttattgaaaatgtcacaaatgtcattactgaaacaattatatatatatgtaattcaatctgtgtgtagaatatatatattcaatatatattcaatccgtgtgtagaatattgtttggagattgggatcaccgaagtgttagaaattgcactgagctaatttatacatacttaatggtaagtgatttttttaatatgagaaactcctagatattagagctgagaaagaaaagatagactcttcaccagagacatatgatgcatcacagatagccattcataaaaagggagttttgaattacatttctaagttaaagaaaatactcaagatcatcttaacttagtggtgagcaaacttgtattttctttataagagagtaactccattaagaagaataatgattatggaccaagttttgctttatatgtaaatatttatttatttaaaaattaggcatctaaaattgatatatgcattattttattcccaattacttaagaatttatgttctgtggtaactgtggtcatggtaagtgaagttttagctattatttcaggaaccatataattatcatgcattgccattcctggttgtaacaccaggctttggtacacattttttaaatgaaaaaatatgttctcaatcagaatatggcttaccttcctttggctatattattaattgatcagttaaaataacttgttccttaatataattttaaaatagatgtttctttcacgat

SEQ ID NO: 2179 - DNA, 1021 bp, Homo sapiens
gccggggaagagggctcaggggaccggacgcggtgccccgcaccacgctaggcctgacaaccggaagagaggggccaggaggggctcctccagagcgacttcggctccagtagggaaaccgccgaggctcccccagctccagggagcgccggggacgcaggcgggaagcctccatcgggcagccggcctggactcacgacgcggggtggggccggcgcccgccccgcccctctcctcggggatgccgggatgtttacactcctgacagcggcggcagcaggaggaggatcgggagtcgcgggaggatgggccgccgctaggctcgcactccggacgcgcctcgcagtgcgcagggtgggtgccccgcgcctgcagcgtccgccggggcggcgcggcgggaggtggccgacaggctccgggcctcgcagcctcagcccccggcccagcgcgctttccgacggcggcgccgcgccgagccacccgcccgcccaaggtctctcgcgggcgggagaacggaaaactcccaacttcctggtgagtcgctgcccagggttcaggcgcccggaccgggcagctcctgccgggaggggccgcctgcgggagtcgggccgggagagggaggtcgggaccgcgcggggcggcctccgggataccctcgctcggggtaggtggggcggggcgcgctgcgctcgaggcggatgggggtttcggtcttgttcgttggcagcggtgggagggggcggcaggaaacttcatacctggccccggctctagaggcccgaggccgccaagggcgccgcggtaactaagaaactccgtggccacggcggcggcggcaacaggtctttggtttcgggacccgaggaacttaagcgaagtcccgccttccggcggatgctcattggcgacgtcggttatttatctctcgcggattggtgaagtccgtctgtcaggattcggcagcagcccgacttaggaaagtgaagtgcgctgggagagagtgggtggtgggagccggcag

SEQ ID NO: 2180 - DNA, 1057 bp, Homo sapiens
aaaatcagctgtcagtaaagattgtctttagttacatagttctcccgtttactcctctaatcactttttttaagtggaaaggaatttgttactgaacatttaatagtatttaatggttgtgagggagtttgagcttccagcagaatgtcccagtaccaggcccccaagggagtttctgcctcttctgtgatcagaagtccaccggtctagggccatacagccactgctctggtcaagacacagttacagtaagaaaaatcctgctatttgggggaccctagaaccataccctgcctattgtggtccaggaaacaatgctgtgggccctagctctatacaggcattattcagagatattgcaggttctagtctagaccactgcaataaagtgaatcttgcaataaagcgagtcagatgaatcttttggtttccaagtgcatatgggagttagagttacactatactgtagtctatacagtgtgcaatagcattatgtctaaaaaatatacataattaaaaaatattttattgccaaaaaatgctaacgatcatctgaaccttcagcagttcataatatttttgctggtggagggtcttacctcaatgttgatggctgctaaatgattacggtgacggtcactgaaggctggtggctgtgtcgttttcttaaaagtagacaaccataaagcttgccacatcaattgactctttctttcatgaaaaatttctctgtagcatatgatgctgtttgatagcattttacccaaagtagaaaatcttgtacaattggagtcaatcctctcaaaccctgctgctgcttaaaagtttatggaatattctaaatcctatgttgtcattttagccatgttcacagcattttcatcaggagtagattccgtcttaagacgcattttctttgctcatttataaaaagcgactcctcatccattgaagttttatcatgggattgtagcaattcagttacatcttcaggcttacttttaattctagttctcttgctgtttccaccacatttgtagtgacttccttcactgaa

SEQ ID NO: 2181 - DNA, 1012 bp, Homo sapiens
agaagtgttcatgtaggaaaatcaagggactttaggacctgaggctgggacagactctccaggatgtggttggattttgggctaaacagtctttctgtggtcttgaggactgcctttatagtctgtgaaaccctatccttcaattgtggctttacagagtttaagaaaattttgttcgtatgcagatttctgcagtcttcctgttgccaggaagaacctacagttacacaggagtgtgtgtgtgtgtgtatgtatgtgtgtgtgtgtgtatgtgtgcagacacgtgtgtgtaaacacacaaagtagactgaacttaaacctgatttataggagtcaggaaacctgagtttctttgctttctccttgtgtaattttggttaagttgtgtaacttctttctttggagtttcttgtctgtaatctggaaattatttcccactcactccactgtgatgttttgagaagatatctgtggaaactttttgaaaagtacaaaatgataagtgtaaaatgtcaataaagcatattgatgcttattttgctagaagagtacatataaacataaaatttagaaaccttaaaaatcacggccagagagaatcatgatttctacacctccctttttttttttggtgggggggtgcttccagttaaaagtaagcattcagtttgtactaatatttaaaagcctttgcatcatagagaaaattaatcaataacgaagtatcataatttagaatcattattgttactaacattttattccttattctaaagtaatttattcaggatgtgtgctgagacctgttgttttaactgtatagctagatgaaaatatgagagaagaggtttggatgaggtttctttcctttgtaacagtttgcttgaggaatgggcaggcttttcctcacttgacagatggtataggaagggcattgagaagcttgcatttgcttggtggtgatagagacagggctagaattcataatttttgttgttgttatttaacacat

SEQ ID NO: 2182 - DNA, 2040 bp, Homo sapiens
gagaaaaagttcatatttatttgcatctttcgagttaaaagaactaaagattcgttctaactctgagtggtatgaacagtaagcagtaggatactactaagtagaagatcatagtagtcaggctagtgttaggtcagactttccattattaatccttcttttggtatatataacttttggttgaaaattctaaggaacaatttgtatacaaattttcggcctgggttgaacaaatatgtcatgacccacttacaggcctcattaaacatttggattaatgttaagggcttttaagatgaaggcaaattttatgttttagaatatgttttcaaagtatttgttcttttgggacaaacagcttaaagttattttattcattccttctggggctgctttatttttagtattaaactcagaatagctaccaagctcaagtgataaactttaaaaacctataaattgtaatcattatgaatcaaaacagcatttaatcgcaagaagctgttggatgtgaataaagaatttgtgtattaattgattaaaaagttaaacttatctccaggtttcaatgatatttttaaaaagagaggagggtcattattttgtggctacttaattatttaatttgtattgccatataggcaaatgttaagaatgcaacatcttgaataattctttcctatactttgagtaattttattttgaaaaatgcttgcattttatttgaaacacatgaaacagaagtattttaatgaaaatattactgccacattaagttttctgttcttgaagatgtataaaaattaccccattttatctccctaacactatcagagttgccatcaaaatccgctatgaaaacttatcatttagtatatattaaagcattcatctgggaacatgttgtcagctttcagtcagttgcaacaaacaacagacttttagagactcctctaaatttcagcgtgcctccgtcttcttaaatctatacccctgatattttctcacacaacaagtaaaccaacctaaactggcagagaggtggaatttttatgccagtatttttctttaatgcttttggatgacttaagctttaataaaatgcatatttattaagagtatactgttttatggacttctagaataaaaatacagttttactaaataaaattgaacagaattaatcagatattatagagaagacatgcttctctgtgtatttagaggatactctctaaagtcccttgtaactctgaattttaaaatctgtgactcattctggtcctagatcatttttttgcattcttataaatgcaaatgtatctgtaattaagtaattgttaatggaattacaaattgagaaatttagtaacttttcctaggaatggtttgtttcttttttatttctaccgttattaggagagtggccctgaaagagaaggatgataattttttttgttttatttccaacatatggaatttgttataatcttcttagaatcttggcttttctagactagtagaaggattttgctatgcttcctattagataaatagtaaagaggtggtcatgagttttatatagtactttgtttagtgcatttgcttttatttcatactttgatgtattcatatcatttatagattttttagagtgttttgaaacaagtagtaacatcaacacttaagtttacaaaatattttttttctaactcagtagatcaaacagggaaactaacacatcaaggggtcctaggcctttaatcccgctgggtcctggcagaagtgaaatgctcttttcactatgtggctattacaaactgtgctgtcctgaacatttttgtatgtctttgtgcatatgttagagtttttttggagtatatactaggagaagaattggtgggttgtagggatgttgtccttcaaatatttctgcctgtagtatatgtgagttccagctgttccatatccttgttttattttgacagaatttaatttttttagcccatctgataagtatgaagtggtatcctgttgttt

SEQ ID NO: 2183 - DNA, 1050 bp, Homo sapiens
aaacaagcagaagtacaaaagatcagtgaaacaaaaactggttatttgaaaagataaacaaaatcgataggccactagctagattaaccaagaaaagaagagagaagatccaaataagctcaattaaaagtgaaactggagacaattacaatcaatatcacagaaatacaaaagatcatttgacattactatgaacacctttatatgcacaaactagaaaacatagaggaaattgataattatcaatttcctcgaaaacgacaacccttctagattgaatcaggaagaaatagaaattctgaacagaccaatcacaagcagtgagattgaatcagtcattaagaaaccaaaaacaactgccaagaaaaataagcccagggccacatagattcacagccaaattctaccagacattcaaggaagaattagtacaagtgtactgaaactatttctaaagattgagaaggagagaatcctcctgaactcattttatgaagctagtgtcaccctgatatcaaagccaggaaaggacataactgaaaaagtaaactgcggacaagtatctgtaaaacacagatgcaaaaatcctcaacagagtgttagcaaaccaaactcaacagcacgtcaaaagaaataaaaattcaccatgatcaagtgggttgcagggatggttcaacacgtgcaagtcaataaatgtgattgatcacatgaacagaattgaaaacaaaaccatataatcatctcagtagatgcagaaaaagcatttgataaaagccagcatctccttatgataaaaaccctcaactaggcataaagaaacatacctcaaaataataaaaaccatatatgacaaacccacagccaacatcatattgaatgggacagagttaaaagcattccccctaagaactggaacaagataggaatgcctactttcaccatttctattcaacatagtacttgaagacttagcccgagctatcaggcaagagacggaaataaaggacatccaaattggaaaagaggaagccaaactatctctgtatgctg

SEQ ID NO: 2184 - DNA, 1098 bp, Homo sapiens
aataatggggatgatatggcaacatctggttagcccagtgacttctttcacttttgtaatagaagtctgggcataaacagaaaactaaggatgtcaagtttctgagtgtcaaataccaattccctgttataatgataagtgatgtatattgttggcatatccattctttttcttgtttcaaaatgaatactctcaccccataatgtataatatgtggtctcatttttggtacagtgtaagttccttttgttttgttttagaatgtgagatttatgtttctttattaatgtattttgaaattttttctatcagctccactccttcccaccctcccttcttttccccctttcttcctttcttgattctttccactaacatctagaaggtactgaaaggatattttgactagattcttgttctgtatattttcattgcctttggactcttgtttttggaacagtggatttagctttttaaaaataaaaataaaaattcaaactgtataaagatggtggttgggaaatagtaaaatttttactctttactgtaagactaattttaaacaatggaagtttacaattaacattttgtgagtattttgatttatggttattgggtgaagatggctatggtagagtcacatttttttccaaaaagttaattataaaccaattataatcagagtacaattttaagaatttttgcgagttattagaaggaggattaattttcattgtgatatgatcagaggcctaggttatttttttttaatttgaagatagtgtaatattttggctacttatgaaagagaaaagacatgtcactcagatctgtgggtagaaaaaacagatattccttattcttacagtgtggaaagtatgaaaatcttatcttggagtcttgcaacttaaccagtaaggtagactgaccattcctttaagcttcatggcagttcagactgtaatccatttactattttgcatctctgtggagtgactgtggagggatgaaataaagtttaccttgagtagcatgttcagggtagtaatcagggttcattgtaggccagccagaaagtatccctctctattgagtggg

SEQ ID NO: 2185 - DNA, 1507 bp, Homo sapiens
cacctgttcctcattcattcattcattcattcattcattcaagaaacttattttccagtggggaagtcaaataaaatgctaaaagcaagtagaatatatgatatgccagatgttgataaatcaattgagaaaaattaaataaggagtttggaggaggtgtgttgctattttattttatttatttaattaatttttttgagatggaatctcactctgtcgcccagggtggaatgtagtggtgcgatctcagctcactgcaacctctgcctcccaggttcaagcaattctcctgtctctgcctccctagtagctaggactactggtgtgcaccaccacacctggctaatttttgtatttttagtagagatgggatttccccatattgatcagggtgatctcgaactttgacctcaggtgatccacctgcctcagcctcccaaagtgctgggattacaggtgtgagccactgtgtccagcctgtgtgttgctattttaagtaagatgatctcagaagaccctcttaagtcctaccaccctcacctctgcctgccttttccttcaattactaccctagttcttttttttccttcacagtcagacacttactcctgaccctctttccaacctaccactcgtaatggctcttcaatgacctctctcatgaaaccagaggactttgtccagtcttcattctgcttgatttctcagcagcatttggctctgcttttcattctcttcctaaaacactcctccatcggcttattgagtcccacagtgtcttgattttcttcctacctctctggagactatcatttttcttaactgactcattctcttcttcctggcctttaatgatggaattttaagtttcagtccttgactttttttttttaatgttcttacgttatagctgatctcattcatacctacggattcaattactctctatactcttgttgacttccaattttttatctttagcatggagcgctctttaaattctgactctatatggctcaatatgtctgtaaacaaattccttacagactacccatcctcccatgttccctaactcgaggcctggcaccagtttatctcgtgcactctggaaaccaggacttttttttgacatttcactctcccttacctcttcttttcaatctcaccagattctgtttattttttcttctaaatgcctttcaaatttctccacccagctccctttccatttctctccctatcgtctctcatttggagagagcgagagctttttgtctcccaacatccagcacccattccttaaatccgtttctccatcagtctttaagacgttagaagggagagaaacaaagaaaaaagaaaaacttcctttcaatcacatctttctaggttttcactttaagggtaaagactaaaatgtttggcaagattcagcaagccttgtgtgatacagaagatacgctccctcagagaggatccgagtccgttttgtgtattcacatatccc

SEQ ID NO: 2186 - DNA, 1609 bp, Homo sapiens
actgactgttctttttaatctcactttatctatcactagtactctgatgcaatagagaaaacattttaagtatttccaagtattttcttatcagttttagtaatgtggaaacttctcttaagaattattcacatggcagcaatgcagggaccattctttttagtaattctgatgcattcatgtgtttttattgttgatcttttagttttttaatattctaaataagttgccttgatattgatgtaccagttttcaggaggcaactgttttggggaagttttgtgactttatgggtacttagttttcttgtttgctaaataatttaagaggtttttttccctcaaggtgtaattgctcatgaaaaatattttctgtttcacattttctaccctaagatgaaatatatttttggcttgcattaataacttgcaccattttaacttttgggaatgaattgattatatttatattctattataatctaaaaacagcttagcactcttaatagattttccaacattacaggaaaagacaaagactagtagaccttggataagaagataaaatgagatgctagtgataagtattctcagtgatctcatgactgtcaggcccatcctactttacaccttctaatgcaacttaagatatctgaattgtattcattgtgccaaaagagaaaatacttatgcactgtaaattagtgttacataccaaaattttaattttatataatttcccacaattatgtatagcaaatatttgtgaagtttagtttgttgatacctcattatgccttccaaagaaaaatgtttccatagaaagattaataaatgataaaaatcacacttagaactgtccattatacttccagaagcatcctatctttttcatcacccagtctctgtgaatttaattctttgaaataaccacgacaaaatatagtcttataaaattgcattataattacaatgctgtgtttgagaacttaacatcccctctgatggtaaatgtttgacctaattacaaacttataacaaagaattctaactgcttgtcatctcatgttaagaccttttatagtattaaatggaccaatagggatctctgaggtttttttgttgttgctttgtttttactaattggatatatgaaggataaggcataccaagaaactattatttttaagtatgaaatgtgccaaacagacatttattatttctgttttatttgaaactaagactgtagacccacagattatattttagaagtggtggagacgtcatagatcatctccaaactctgtttataatagagtgaggaagctgagacccatcaaggttaaatggcttgttcaaggtcacacaaccagttactgtcaaaccttataatcaggtctattattataagatggatatggattgtgttagtggcacatttaaacatttgacaacactccaagcaggaaatgcttccttatatttaacataaatcacttacttcctcttactagatacttggaagaaatggagagcagctggtgcctgtaattctagttctcttatgacttcattatttctcatcatttaattaacatttttcctaatcc

SEQ ID NO: 2187 - DNA, 1056 bp, Homo sapiens
acctacaatcataaattcttgaaagataagtggaattacatgtgctgtagtcttcaagcttctcaatacataggacagtaattcgcatgatcattttaatgtctaatcatatcactccataactctcttttcttgtacagctgttaaaagaagtcacaacattcttgaggcaacagtaatcgtagacacagctgtcatgaatctctgaaaaaggtttttggaaataattatatcttcattaattttgaaatgttgaaaacatatcactgcatttaaatgtactgcaaattttcctgagcacttaaacttttaggcctctctgctagatagagagaggtaaggactaatcagtttacgtgatggggctgaacctctttgctcagtgtcagtcagcgtgagtccttgtccagaacggaggggcatatgaagaagcgtgtcaggagacagtagacctccctcttaggcctgtgttccctagtgaattatgaatttatcctattaataattatagtgcagaatacaaagttactcatcttatataatgactgttggaaatttgttgatcaaagaggtgagtagcatccttagctttacattttaatatatactaacgaatatatgtagtttaaatattgaaataaaacatgcttatttaatataaagaggcttgttatttatattaagaatcagtatctaaatttaaagtatcagtgttaactgagtgtgtaactttttgcagtgacctccagcagctcactgaaaaaggatttttgtacattaacattttttacattttaagtttagcttagtagaattcctaatcattcttttcctctgctcccttcacttgggtcgtccttgagttcagtttgtgttgcagttaaggtgttatgctggggctaatctctgtaaaatgctagcatttgttcttctttttccttatcatcaatctttcacactcatatcaaacccctaatgtacagcaggtttcccagagctactggttaaaattacctttgcttttggtaaactctgaaccttcaagcctcagtgttt

SEQ ID NO: 2188 - DNA, 1086 bp, Homo sapiens
acactgtccctctccttttttttttttttttaaagttagagaaatggaaggcaggaggggagggttctttctggcttctcctggaatagtttagcagtgcagcctgataatatcttttctgctgcttcactcaaatgtttaagaatttctggcatcatttcctatattgttgaaacaagaaaagtcttgattttctggagtatttaaaatgaacacagggattaaaaagtacaggtattttttcctatggttgattatgtatgaataacaaaaataaatttttaattgaactaaactgatttcagatatttataggttattggagagtataacatatttatgtggctttgaataaaattacaatactgaatttttttcaacttttgaaatcacattttctttaatgcgattatcaattttcctgctaaagaagggcaatgtcatcattcccactttacatatgagtaagtagagacctagacaatgtttagagcaaacactggacatcacagtggtacctgtgcggcatggcatccccctgtttgtgttacaagaacacagagcccaaagtaaactctcaggtgttttatgaatgagcatttcatgatttttactcttagacttactaattctttatttttctcctctctgttcttaaccctttcactcaccatctttatctggaatctccttccctagaagcatagcaggttagagggcagaggcacaatgaggtgtttgcttagaatactcttctggctcatggtaactcaggggcaatgtaacattgaaaggaaagaatgaggaaacggcagaagggtaggaattatttccatacatttgagtatgaaaaaccaagcatatatctcaagatagcaaatatgttgatccataatatattgaacaaaaaaagttacagtttgtcataattttactaatactttgttttcaaatggctactgttaaggaaaggaaatcactaaatgaaagctttaaaaatataactgggtttcaaaccgaatatttataaataatttttgtttattttaaatttagaataaatttaaagaagatttttaagggagt

SEQ ID NO: 2189 - DNA, 1032 bp, Homo sapiens
ttgagttaggtttctttgtgacacccaagtgaagagctgagtaggctgatggcttataaggatctggagctcagaagaggtgctttggccttatagggtaatgggaggagtagaggtgataatttaagctcaggaatgctgtaccacacttaccatgttaggtaataatgtagagggcaggagggagctaacttttaattggtaccttcttggaaggcaaggctctatgtgtaggtaccgtacagtcttggtaaatatttgagtgcgtactgtgtttcagacgcagttccaggtactagtgacacaggacagataagtatcttgctctccttcaggtaccttatagtgagaggaggtagaaataaaatattatgggatagtaatagttgttatctagagaattaaactacaatgagtgactgggtggtcagggaaagtgtgtttgaggaggttacatttaactgagatctgaatggaaagagccaaccattcattcggttaaggggaggaacattagaggcagaaggcctctagtgcatgggccaaaaggtctgaacctggcatattctagcaacaggaagagttgggtgtttggaacatagcggcctggggaaagtggaggaagttgaggtcagagtaggagtaggcagtacatttgtggaatatggagaaactaaaactcagagaagttaattactgaactcaagatcccatcaagtaaatggctgggccgggcatggtggctggtgcctgtaatcccagcactttgggaggccaaggcgggcagatcatctgaggtcaggagtccaagatcagtctggccaacatagtgaaaccccatctctacgaaaaatacaaaaattagctgggtgtggtggcacatacctgtagtcccagctactcggaaggctgaggcacaagaattgcccgaacccaggaggtggaggttgcagtgagtcgagatcacgtcactgcactccagcctgggcgacagagtgagactctttctcaaagaaaaaaagaaaaaaaaaa

SEQ ID NO: 2190 - DNA, 1053 bp, Homo sapiens
aatatgctgtttcagttcatttttttttaatgtggtacaattccaaactttaaaaaaaataatagttttataccattggtaaaatgatagacacatttgaagtcttctcttaagtatatttagctcttgaagacttgtttttaaaatgacctattttatattcagtatgaagttttacattctcttgagggctgaaaaatctatttttgttgtattcttgaaacagtctttgattagctgtggatcctttcccttttccttgcattggggtctttttaaaacttacactttcacaacttaggttagtggatatgctttaatgaaatggaagcaacccctggactcttgtcttccaccttccacccttttgatcttggcaaatcattattatgtttgagcctgtttagcaagatggtgtagagctataattctgtgcttatcagctatgtgcccctgggcaagatgtcctttcttgagttctttatctgtaaaataaggtaagagggttgtcagaattaaatgacagaatgcatgtttaggactgtgtctgacaagatgttataaaggtcatatatgaaaatggatgtaaaagcagtaagtaaatgctaggtggatatataggtatgatagataaatttgtaatcctgataatgagcatttacttttcacagctaatatttagatgccaaataacttatattagccattttttactgatacaggaaataaaaatccattgtttatacatttgataagttatcttaaaatcaaataattttccttttacagctgttctactaatagtttctgtttatttcctacaatactaaagtgtaaatgaataccagcactatattctgcaatttaaaactgaacttcaccatcacgctgaggcagctatattaaatttaaagctggctcactactgggtagtgcatctacgaagaaaggaaagtgttttcaattattaaatgaggatgatatttttagatgtcaccaaaatcccaaattgatacatccactcttgacctctttccagagtcctatatctcc

SEQ ID NO: 2191 - DNA, 1068 bp, Homo sapiens
cttgtagtccctttttggaatatactcagaaagtatcttctgtaaaggaaatttgtatctttgtctcattccagagtatatgtcaaagtttaatgaatcatcttttcagttaaagggttattgctatatttttagagggaatcttaaattctatgacataaataataattattaattaaattctatgtttcttttataaaaatcttgtaagagaattttttccattaatctttatagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggtgagtctttatatacccaagattattttaagtttgaagtgtgtacttttgagtgtgaatgatatactgtaaaacagagggaaatgttttgaaattggattgtatttttgcctagagtttacaactcatctttttcttaaccttgtttccaaatgaaggaagattttaacgattttggaatgtttggtgccatctaataccttggagaaacaactacataatttccaactaccttaatgtaattttaattgaaaacttttattttttccgttgtagagactggctagaagagatggaaaatgcatccttgactttatcattaggaaagagttgagattaataagtgctgatttatggccgggcgcggtggctcacgcctgtaatcccagcactttgggaggccgaggcgggcagatcacctgaggtcaggagttcaagaccagtcttaccaacatggagaaaccctgtctctactaaaaatgcaaaattagccgggcatggtggtgcatgcctgtaatcccagttacttgggaggctgaggcaggagaatcgcttgaacccaggaggtgga

SEQ ID NO: 2192 - DNA, 1028 bp, Homo sapiens
aatttttcaagaaataatgttagtactaattctttttcttcaaagtctcagtataaaaatttcctgtgaaataatatatatgaagacagaaatctttagaagaatttacaccagactgttaactttggtttcttctgtgaaatgggattaaataggattggagaaataaatggtaactttcatatcttatttgatgtatttctgcactattaacatttttatatgattttactgttttaaaatttaaaatgtagagaagaaatttaaattcaaatagaaattatcattatctgaaataacatgccttgtatgcatactaaatatttctgatagttaaattgttaaagagaaataagtatcctgcatttagcctttaagcagacataggaaataagaataaatattgaagacctctctaaatggttaaattccaaatatcccgtaaatggcaattcaaacctttaagatatcttttctgtagttccttttagtaatcaatctttaaaaagaaaagatgtggctgggctcagtggcacatacctgtaatcccagcactttgggaggccaaggcgggtggttcacctgaggtgaggagtttgagaccagcctggccaacatagtgaaaccccatctctactaaaaatacagaaattagctgggcgtgatggcaggcacctgtaatcccagctacatgggaggttgaggcaggagaatcacttgaaaccgggagaaggagattgcagtcagccaagattgcaccattgcactctggtctgggcaacagagtgagattccatctcaaaaaaaacaaaaaaacaaaaaaactcaacgtaacttctcaaaacaaaaacatttctctcaatctccaccccaaaattaatactacaatctgcttatcagtcaaacttgccttagtcatacttctttatttatttattttttcgagactgaattttgctcttgtcacccaagctggagtgcagtgacacaatttcagctcattgcaacctccacctcccaagttcaag

SEQ ID NO: 2193 - DNA, 1026 bp, Homo sapiens
gacatttttgtcttattcctcatcttatcaggaatctgttgagttcccattgttaaatgtgatattatctgtaggatttttgaagatgttctttttcgggttaagggagtgcctttctgttccacgtttgctaagaaatatatgtatgtttatgtttttaaaatcatgaataactgctgtatttttcaaatgctttttctgcctctattaagataatcatatggctgttctcatttatcctgttaataggtgagttacgttgatttcaaatattaaactggtcttgaattcctggagttaaactcagttggtcacggtaaattatctcttttatatattgttaggtttaatttgttaatattttctcaagggtgtttacagccatgttcgtgagagatatttttcttctcatttctttgtcttgtgttagcatcagggtaatactgtttttatataatgagttgcaaagtgttccctactccactgttttctgaaagacttcacttaggatttctgtaatttcttccttaaatgtggggcagaattcactaggtatgccaccggggcttgatgttttctttttttttcttttgttttttttttttttgaggtggagtctcactctgtgcccaggctggagtgcagtggcctgatcttggctcactgcaacctctgcctcccaggttcaagcgattctcctatctcagcctccgaagtagctgggattacaggtgtccccccaccacacctgggtaatttttgtatttttagtagagacagggtttcgccatgtttgccaggccggtctcgaactcgtgacctcaagcagtccatctgccttggcctcccaaagtgctgggattataggcgtgagccatgtgcctggctgatattttcttttttttgagacagagtcttgctccgttgtccaggctggagtgcagtggcgtgatcttggctcactgcaacctctgcctcccaggttcaagtgattcttgtgcctcagcttcccaagtagctgagatt

SEQ ID NO: 2194 - DNA, 1026 bp, Homo sapiens
ttgactgttttgttatgggctatgtgggctaatgtagctggtgactttagatcgaagccagtgctcatttaccattctgaaaatcctagggcacttaagaactatgctaaattgactatgcctgtgctctataagtagaaaaacaaagcctggatgacagcacatctatttatagcatggtttactggatattttaagcccttattgagacctgctcagaaaaaaaaaaaaaagattcctttcaaaatatcactgctcgttgacaatgcgcgtggtcacccaagagctgtgatggagagggacaagggcatgaatgttttcatgcctgctaacacagcttctgttctgtggcccatggatcagggagtaatattgaatttcaagtctttttatttaagaaataacattttctaagtatatatctgctatagatagtgattcctctgttggatctgggcaaagtaaatttaaaaccttctgaaaaggatttaccaatctagatgccattcatgattcgtgggaggagatcaaaatatcaacatgaacaggagttgggaagaagttgatttccaacttttagggatgactttaaggggttcagtacttcagtggcagaagtatctgcagatgtggtagaaataggaagagaactataattagaagtgaagcccggagataggactgaattgctgtaatctcattatcaaaattgtctggatgaggagttgcttcttacagatgagcaaagtggtttcttgtgatggatctattcctggtggggatgctgtgaacattgttgaaatgacaacaaacaatggatttacagtattatatatcaagttagttggtgaagcagcggcagagtttgataggactgactccacgtttgaaagaagttctactgtgggtaaaatgctatcaaatggcatcacatattatagagaaatttttggtgaaagaagagccaatcagcacgcaagttttgttgtctcaagaaattgccacagccatcccctccttcagcaa

SEQ ID NO: 2195 - DNA, 1095 bp, Homo sapiens
tatttcataatctgaaataattgttgtcttaagtagtttaccggaatactactcagcaataaaaagaaatgaactattgatacatataacagcttgtatgaatatgcatagacatgctaagtttaaaaaagccaatcccagccgggcgcagtggctcaagcctgtaatcccagcactttgagagtttgagatcgggagtttgagaccagcctggccaacatggtgaaaccctgtctctactaaaaatataaaaattagctggttgtggtggaaggcacctgtaatcccagctactcgggaggctgaggcaggaaaattgcttgaacccgggaggaggaggttgcagtgagccgagatggcaccactgcgctccagcctggatgacaaagcaagagactccgtctcgggcagtaggggtgggggagaagacaatcccaaaaagttacatactgtataaatcccatttatataaacattcttgaaatgacaaaattatagaaatggagaacagattagtgattgccaggggttggagagaagtagatgtgactgggaaagggcaacatgaaggatcctgtgttgtagtgttttgtggcttaattatatccatatcagtatcctggttgtgatattgtactatggttttgcaaggtgttaccattgggggaaactgggtctatggtaaatgggatgtttctgtgttctttctcacagttgtgtttgaacttacaatgagctcaaaataaaaagtttaataaaaagatgtatgaggaatgaatttttaagatgaaaagaaaatgctaccatgtggagcagaaatggtttcagtgtcatttctcactggtagtgagaaagtatggagtgatcgagtacattatctctgtagtggacagaccccaacaatgatcagcagtttgactttataacatttctaaaactctctgagcttcagttttcctcatctatagtaagcaatgataatattgtctgccttataaataggtgtgaggattaaatacaatagtggctgtgaagtatctaatgtggtgcttgacctatagtaagaaagatcagtaaacgttagcaatcatcgtt

SEQ ID NO: 2196 - DNA, 1050 bp, Homo sapiens
tccctgactcctcctcagctgtagaaaatcacagttacattctagacctattcatcttgagaaactatgcaaccttcacatcccattacagacttcccattcttgaacagtttctcctatcttcctaacccacttgctttaaataataatttttaaaatgttgaacctcattatgacttataaactattgagcctattaatttctcacaatcttattggacttcatatttgtccatcttgaacttagatttttataagtactctcagttcttatgtctccccttccctccctgttactcatttggtaacagctcagatggtttagcttagttacccattttatttctaacctgcatttgcagaggcaaatattgctggagaaatttacacaaggaagttggtttcactttaagttcataagcacaaacttccactgccagtccaacaaatgtgtccctaagtttgctttcccacgcttcatgacaactgtgttacccattttcctctaattctcggaccttctgtaaccctttccctactactgtcagctaaatttgccttatcttttcttgagaccagagatgggaaggctttaggtgggaattatcttccctttatactagcaaatctgtaaacagttttggatcgcactcattgcctttcttttgtcctactgttacaatgaagaatttcccccttcacatcaaacgtgagttttctactacttgctctagaactttcttcccttttttgtggtcattggtcctgtacttcagttcttactttttaatgtacataagaattacctggtgtattagtccattttcttcttgtaacagaatacctgagccgggctcagtggctcacgcctgtaatcccagcactttgggaggccaaggcaggtgggaggtcaggagttcaagaccagcctggccaacatggcgaaactccgtctctactaaaaatacaaacattagctgagcatggtggcagatgccagtaatcccagctactcaggaggctgaggcaggagaatcacttgaacctggg

SEQ ID NO: 2197 - DNA, 1035 bp, Homo sapiens
ctttttcctgacaaccttatctaaatgaagtgcctctatcaaccccttgttttctataccctaacactctactttttttctttcatagcacttttcagactaattacttttcttaatcatttaattttttaaaatctgtcttcctcactagaatagtctatgtgaggataggtacaatgaactttttatttctagtgcctacgatgaccttcttcttttcagttttagtatctagaccagcacagtgtttgacaaagagattatatttaataaacactaaactaataaagagaaggatagtttaagccattgaattaagctaggcactttagaactttggaaatctacacaaaattaaggaaatcacttaactaggaatgttcagcacctttatgcagtcatatccacctcattccattttcaaattaggtttaaaacaatttgattcaacctgaactgcagtgtattttttttccttgatccattctaccagccccagcattattttttattctcgcattatgactttacccttgcctctcagatttagtatatgttttctccttctggctcttgttttggctcgtcctaacccagttgccttttttcctggataatgcatccacaagtataaaaaaacctaccaaagaaaaatggcaataacatggctaaaataattatcagcatagtggctaaaatgagtttaaacttaaaaaagcaaaatcacagaagacaagattatattgaatgattgaatcatgcagaggtacacaaaaatcatgaatatattaaccttatattatttggctctacctctgtttcctatctcattttgtgacttctttgggttcactatgtcattctgttacttaaacacgcaagtatttttcctaccacagggcttttgcttatgtttttcattctctctctggaatgctctttcctctacttttcccatagccagcttgttctctttaagatctcagcttaaagttacttcttaaagaaattgtcttagtctgtttgggttgttat

SEQ ID NO: 2198 - DNA, 1028 bp, Homo sapiens
aatggtaatacatttccgtctcaggcatctctacatccacccagcttgtgtagtttttgttttgtaatgtggggttgggctgcttcctggaaatttctcaaacaataaaaatttcaaggtgcaacagttacaagcaggtaccttttcacagtgtgtacctgaaaacccaaggaccctgggttacaacaatagaatatttattacaatattaaatctttaatgttttagtacatagtattaggaactaaactgaaagcaaagtaaaaatgtcctatcatattaatacctagataatcctgacttctcacccaggtatatgatagggacattagtttgtttaaaaatgtatttcagcagctcctataagcagctttttatttgaatctattagaacctacaatttatattgactttggactccctaatctatctgattttttacgttaaaactaatgtcttttgtgggtttttggaaattcagacacattaaaaatacatttcaaaaattatgagtaaaacattcaaagtaatttctgtatgaattcttggcttaacacaaaaatatgaaatttagcaggcatggtgggtcaatagtgacatttccttccttgaagatttagaaaacactcagtgttctaggtcatcactcttgctctattaaatctttaaattccactttcaaagtggaggaaagtaaagctttccactcaaagattagattattccataattattctaggaacctaaatggacagtctcccacatttctgaaaaatgttttaattcatgtcctctggaaaactcatctcttttctgtctctcagacatctcagcagctcatttttcctatttttcccagcagaaactctttttataatgcagatggatgtctacattcttttccttgaaaagttattgtgtagccattattctaggctattctgagttcctagtcatcctctcatttctataagtctccatatggtccattgtagttctccaacactgtggaacttttgagaaagaat

SEQ ID NO: 2199 - DNA, 1774 bp, Homo sapiens
ctagtagctggtattacaggcatgcaccacaaaataaattttgtatttttagtagagatggggtttctccacgttggtcaggctggtctcgaactcccaacctcaggtgatctacccgcctcagcctcccaaagtgctgggattacaggcatgagcccccgtgcccagccaaggtactgcatctttttatccccatagcataataaagtgtctggcaaactacaatatatgtaatttgatagatgaagacatatgaatgtttgaactaattgcttgaatggtatcttctgactttctccattcagagttaaatctctctctgggtttccatacaaagcctgttgtttgtacctcttctccttgtgattttttaggctccttgacctgaggtaccatatattttaatatatgtaatatctgacactatgttgtgagtatgttagacaccaaagaaatgtttattgaattaagcattggcagggacagttgacaaggagacattaagacagtgaaccacttctacaacagcttgttactttgctgaattctgaagcattttggaagcccgctgagaactagggctgtccctaaggattcaggtagaaactagggcaggcccaggaggcctatagataatgaactagctctcaaattaaaagtactgtagaagggaagtataatcatccccatcttttcttcaatggaaaaatgttcattatagttcagaacctatcaagcagactgtcagtacctcaacttaaaatcatgcagcaatagtttcatttatgtgctacaacattgggtggctaattttgggatgtttttacttgaggtatttttactgagcttatattttaaataaaatttaaatgcaattttaaaaattggtgggggaactacctactgtaagttattaaattagggttaaaaaaaatttgtgcttttttgttttgtttttatggttgttctttgcaaatctcataggttttgacagagtgtaattaaataagtttgcctgtcctcttttttgatggaactgttaccactgtagttccgttcttccttcataatttctcaaccacacccacattcagaagggttgtaatagttcaaactttcagttataggactaaccacaaaatgtgactacaacaattgaaaatgagaatattggtacctaaaatgtttgatcgttttcaatgaaattcgttcttaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttattta

SEQ ID NO: 2200 - DNA, 1064 bp, Homo sapiens
tatgaaatttttttttgttattgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctgattttgtttttattcaggatcatgaatttatcgtgttttttcagtctctagcctttctttggcatcgctgaacacgggtgataacgagagtgtacattcaggcaagaggacgccaaggtaaatctataacgtatgaatatttttacagaaaagaatatagtacctgcaattatacaaactctaagtaaaaattcttcagtgtttttacattttataatgaccaaatcataatcacaaattttactaagttttgctgacttaggactgttagagtttctgttaaaataaattatgtaaagaggtgtctattcatctttcagtgcttgtcttttagaatttagaattattgacattgataacatactttttataagctatgaaacattaacagtaattatacatcagtaattgctaacatgattattaaatcacagtcagtagaatgagagtaccaacttctctagtctattaccaactaagacaaaggagttttccccattagaataattccaaagtgggttgcctatgacttaggaaggatctcttttgtattttctttctctaggattctttctctagattagaagctaaaagtcagtattttattactttatactataatatcatatcagaaaagaacatttctagtgacagtcatcatcttagagttcttatctttgtattaccatcctttgtgttatttgccagttttcacattgaaaaacattcactctttcaacagatatttatagaatgcttactatgttctaggaacttggatgtgtagctg

SEQ ID NO: 2201 - DNA, 1051 bp, Homo sapiens
tcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacac

SEQ ID NO: 2202 - DNA, 1032 bp, Homo sapiens
caccatcatagctcactgcagccttgaactcctgggctcaggcggttctcccaccttagcctcctaagtagctgagactacaggcacacaccaccttgcctggctaatttttttttttttttttgtagagacagctgggttgggaagtctcactatgttgcctaggctggtctcgaactcctgggctcaagtgatcctctggcctttcagccccaaaagtgctggaattacaggcatgagccaccaaacccaacctgaaggtatttttctaaggtcaagtatgccccccgaccttgggtcctagttggtagaaagcatttccgaagtggagacatctggatggcagatgtgaagttggctgggatgggcgaaggtctggaaggcttcagattccaggccccatgactcactcctccatcacagcaacccctcagcagctgggcctcctgagccctgggcaggacagggttagtgggccaggcccaggtgggcagtggtcctttgccttggacactgtatggtctgaaaggatcccggcaggactgatcacttttgaaactgctttctgaaagctccaagcttccttctgagtggagcttaagatataatattaagcaggtcattctaggactgtatgagagcagaatgtggcatctctttctgttttagcttgcagggtacttctaggcggttggtgctctctcctgggcctggtggatggaagggagcaggcagggaggggtggggcaggccctgcctacagagcctgtcagtagggaaccagtgagtcaccagaagtccaatacctcagtccagatcctggatgctgttggatcacgggatctgtctgagcatcagtttccttttctgaaaagtagggatgataacagcctaggacggtgggtgaatcagtgaggtaatgcacaggaacacgcatagtaaatagtttttgccagagtgggtggttatgagtatttagagtggcctgagcctcccaattgaaatatcctggccttttgtcaagtcctaaga

SEQ ID NO: 2203 - DNA, 1078 bp, Homo sapiens
agggagtggagagaccagcgagcaggtttttgttacggttcgagtgagggttgaacacaggcagtggtggtggagatgggttgcagggataatcttgagagagatttaggagacaagattcacaggttggaatggatgtgggagaaaggaggagcttaacgccttggcttagtagccccatctgagaaaatgagcatcagattttgagagggaaagaaagaaacggagtttagctgtgttgactgtgcggagtctgtgagcatcccagtaaggatgtcaggtggacaagtgtctcagtggagaagttaaggccagagagaggcagatttgagagtcattacatagaatcagtagttaaaaacagagctccggccgggcgcggtggctcatgcctataatcccagcactttgggaggctgaggtgagcggatcacctgaggtcaggagttccagaccagcctggtcaacatggcgaaaccctgtctgtactaaaaatacaaaaattagccgggtgtcgtggtgggcgcctgttatcccagctactctggaggctgaggcacaagaatcacttgaactccggaggcagaggttgcagtgagctgagattgcaccactacactcgagcctggacgatatagccaggctctgtatcaaaaaagaaaaaaataataaagctccctgataaggttctaagaatttttttaaaaatgaccagaaacaccatcctggctaacacggtgaaaccccgtctctactaaaaatacaaaaaattagctggggatggtggcgggcgcctgtagtcccagctactcgagaggctgaggcaggagaatggcgtgaacctgggaggcggagcttgcagtgagctgagatcgcgccactgcactccagactgggtgacagagtgagactccgtctcaaacaaacaaacagaccaggaacagagctgccatgtttcacaagtggtcagcaaaagaggagccatgcaggacaccacaaatgagactgagaagggcaaggaaaggccagtcatgagtttgtatcagtcattcttaccagaaaccacttttcatatttg

SEQ ID NO: 2204 - DNA, 1054 bp, Homo sapiens
taagcaccataggcatctccagggagagtttgagggggaaaaaacaacactttatttggaaacaattctgctgagatacaatcttgtctcagcttcactttctctgctatttattatgaagtgctatgtgctcaaaaataggggctgagttttaaagtcacaggccaagctctgggctctgaaccgaggagacagcttgggcccggttatctgccctagagaggaagggtcttaagcaaagcggctcatctgtgactcgggatacctcattcttccaactcctgggacgtaggccccagtcatccctgaaagcctttgtacagtgaatgacctctgtaccagaggggtccccaaggctggagcagagaaaagccccaaaggagagactctccaggtctctccaggttgctgagtgagcctcctcccttgacttgctttctctgtttctctgtgactttctcttccttttactcctgccccatgccctgtgtggtgctatcctgctctgaaccaaaagtggacaataaccccaacgacttctccttttcccctgaagcatggtggagacaggctggagttttcaaaaagtttgtgtctcttcaaacatggatcctggaacagaaaaagaacattagtggaagaactggtggactccaaatacagtctatactttagttaatagtaatgtgccagtgttgatttcttagttttagcaaatgtaccgtggttatgtaaattctaaaattaggggaaactgggtgaagcgtagatgggaactctgtactatctttgcaacttttctgtaaatctaaaattacttcaaaataaaaactcaaaaaaataggtgagggagtgacaaaaaaaaaatggaccaagatgagtcagaaatttcaagcctggggaggcttacaacactaaggtacctgatccctcagtcctagtaaaagagcaaaggactctcctgagccgaaaagccctcaagatcaagtttgtcctgggatcacaatcctctagcacttgagagattccctacctgaagtctggctctggaagt

SEQ ID NO: 2205 - DNA, 1028 bp, Homo sapiens
tagaggatggctatgattcacaccaggggtacatgaggctgcacactgcagggaaccaggtcaatcctttactttcccagacaaagggaaacttgcctcaacaaagtaataaatttccttttcacaaacctgagattgtccagagggcttgtctcccagctttgtcttggtgccctgctccagcgggccaagctggggcttagaacacagcctgaccctgagatcaccggacaggatggtatactgcttctgtcttctctgtgccctgctgggcaggtggccagatatcccttcttggcctgggagctgggaccttttgagccctttctaggcctggtctatagcagtgatcttggagccactgcaaccctaaaaacagagcagcaacactcattcttccatgacaagccttgtggaggagggttatgggttaaggactcagcatttgcaaagcaagccatctccttccacaataaatatacatgcaagagaaccagggcatggcaggggacaaaaggaaaccaaatttctctggcaccgaaaagccatcagaattagaatgtggtaaccaggaaactatgtggagctctatttttacatttgcagttttgttagtgtaatggcttcctcatgtggatgccacattgttagagcctaatgatctccatgcacctaacccagcgctcgttcacgattattatccgatgagttgatgagaggtcttttacttttaacgtctgttgcagactagcattaggaatcccccaggcttgtcagctggaagaccaccctcactggttagatgtgaaactgtctgctagatcacggttgggtacctctggggggacagagtgccggggaacatttggaggagggttttaccagaaaagtgagaaacactggctttctccaaggctcctagggaagaggagcagggttcactgcactgcctctgctctggtgctagctagttgtcatggtgacccatctctgccgaggatacgccgagctctttgatgggttggatg

SEQ ID NO: 2206 - DNA, 1051 bp, Homo sapiens
cagaatgggatttggaatgaatatgccaggtctctgcccttcaggaggagaaagacatgaaatctaaacaacagctcagctgttatttcattttataggtgagagaactgaggcccagacattgaataccttgcccaaggtcacagggcattgaataccttgcccaaggtcacagtggtaaagctgggatttgacaaagactctctagctccgtgtcctgtggcctctcgtcgtctgatgcccagagccagtccttcctctcttgtggctcagcctttgcataggctgtatccttcctgaacctgagacttgccctgttgcctgtggtcagattcattctttcccttcctttggtttcagatcagtggtcacctcttccaggacctcccctgtgactcctctaacccacccaccttatcacttttctagtcagtccccaacagaagctctggcccccatgcacggatgatgcctgaccacagctgcacatgccaacctcttggctgcaagctccctgagggcagcccctattgtatgggtggactcagaaccctcaagacagtggctaagtggaagccagtggctgctggtcagggcacagcccggcatgatctggtggataatcagtgcttcagaggcggtgatgttcactcatttgatgtgtctcccatttgaaatgcagccacttccaagggaatcacgtgggattcacatcctacatagaagactgcaaaggcctggtttggagaactcaggaaaggtctgtagccaggagacctgaccccttgagttctggtgcaggcaggagtgtgataggcagaactactcccatcacaacagtggcatcttcagataaggtgccttttgtcacttggccactggtaggttctgcgaaaggaagtgatgtcagggatttagggacaggcctgggggtggagggctgcacaggagtgggagtgggcaggtgggtgaagtcaaatgacaaaagcctgcccttacctttgctactggttctcttctgccgctaactcaaatatatatcatctggcaa

SEQ ID NO: 2207 - DNA, 1030 bp, Homo sapiens
atgaaccttttatcacatgtatgatttggagatattttctttcattctgtgtattgggtttccttttcattctgtagatgtatcctttgatgcacaaaagctttttatttagatgaaatccattttatctgtttttttcttttgttggctatgctttgagtgtcatatctaagaaatcactgcaaaatctaacgccatgcagcttttcccctacgttttcttctgagagttttatagctgatggggttttttggaaatacaaattctaagcctcagacttaccaatgcagaatctctgctacccagaaagccacatttttctaaagcttctcagtaattttagactagtccatgttcctatctagtacaataatcttatctacagtatccctgacagacagtctttcatccttggcttgcataggcacagtgatgggaagcttattccatatcatacagaattaagttataagaaagtttctaaatattcaactgaaatctgtttcgctgtaacttctacctattgattcaaattctgtcatctgggaaaaatagaataagggtgtaactcttcatccaaatatttcaacatgttcttaatatagctcaaatattctctagaccaaaaagaaaaagaaaaagtccctagcttatttcagtacttttttcaatgacccagtttttcgaacctttcattgtcctggtcaccctcctctggaagctctcaggacgtcaatgaccctcttaaaatttggcacctagactgatcacccgcttgacactagaagtagtctcgccagggtaatatccaaatcatgacactgcagacaactttgagttggctgctgactgtcctagatgacagctcgggccatttttaccacttggaaatacaaaaggaatttgtttttctaaaaataggaaagtctggaatttaatctaaataagaagataagtttcacagccatctgtccttccatccctggcatccattggagtgggaggggaatagaggatgggtacccataca

SEQ ID NO: 2208 - DNA, 1084 bp, Homo sapiens
gaagtttttgcaacactttttttttaagttattgggtgcaaaatcccaaaccaggatatgtgtatgtctgtgtgtttatgttttttatttgaccctcccctctttcaacctacccccttttatatctaatgtagaaaaagcgaaattgaatctggaaagcaaactgttgtatatagttgcggtaacaatcatgaagagagagccgggctgtcccctcagtaattcattttaaataacaaattatttaaaaataaaattcatgccagagccagctgaagaggccttccttcatcaccactgaggccacccccaatctgggccctctgtccatctggcatgtctcctcccagcaagattcatctgttcaatgccatttgcgtttcaataaagttatctcctgtactgtccactggttctctagctccctctctgcctggtttctgtctccatttatcttgtggcccattccttgattggcaaggccagactgcttgtggtcatttgcctaacccagaagtaacctgaaaccctaagctagagtctcctgactcccatggttgggggtgggaggaacccctgctcgcacattatggacatagaatccttcaccggatctcaaaacatccagcccaaacatcaaggctccggagtcctccatctgggttgctgcagtgtttgaaaacataccaccctcttgactttgctaaattttcttcttggggtaaaagtgaactgacctattagaagctgttgtaatcaagttcaacttcttttggccacttcaagaaagtaaataggcttactattccccattgcaaaattgaagggtccaagaagcaatcttttccctatgaaattgtagtaacataactcatctctgccctcttaacatgggaggtgacaagtgtgttgagaactctcttcaagccagttgcagtgggtgtacctgtagttctagctactctggatgctgaggtgggaggatcacctgtccagcctgggcaacatagcaagacccccccaactcaaaaataaataattgagaaagctttcttttgaagtaatcttctgatgagatgactta

SEQ ID NO: 2209 - DNA, 1022 bp, Homo sapiens
tctccttaaagccctctacatctattcccatcccgcctcctctctcctaacacctgaaagatgcatgaatataaagtcatatatcatgaactttattccaaatgagattgctaacttactgtgcaactttaggaaagccccttaacctgtctggggctcagttttcacacaaatccagagatccttgcagagaaaggtgcagttctcgttcaggcagcaggaggcgctgtctctggaggcttagattcattccccgccctccgcccgctcccgcccgcctctggtgcgcaggcgcggcttcgcggattggccgcgcgcgggggccgtcattcggtggcgggtcccggccgcggggctggcgggctgaggggagaaaagatggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggagggtgagtgaggcgggaccgtcacgaggatggctcagccgcacaatccgctgaccgcagctccgtaccggctggggacatggggagcctgagccagttggagatgtgggcgccgagaagtggagcaggaagcgagagattgatgtcgctggtggttgtgaaagtccgagagaggagaggcgcgcctgaaggatagggtcgggggaggtggagcctgggagtgggggagggagggtggagacttgaaaagatagatggagcctagaatctgcaggggacggagatggagctagacttggtgctgttggaggaagtagcgcggtcggggaaatattttttgagtccaggaccaaagtctttcgctgttctcttcaccagctggattgtactgggataagagtagggggagctattagtaggagtggtgaagggtagggcctcgaaaaggcggctatcaaagcttaatagatgtcatcaaacaagt

SEQ ID NO: 2210 - DNA, 1050 bp, Homo sapiens
aagcaaaggaacctcatcacattcaagttgtcacctgaataaaacttgagagtctggtgcaaattcatcttaactaaaccttccctgagtggtacccagtgctcctggtgctccaaatgcatgtctggcacctttgtatgaaaggtggaccttgacttgtatttaaactgtcttacaacaactccacttttgctctgatcttttcaactttagccaaatgccatggtctcatctgggcaaagtcaattataaagttctcgaggtcttttttgaaactctgattcctcactttattcatcttttttttcttgagactgggtctcgctctatcgtgtagactttggagcagtgatgccatcatggctcactgcagcctcaaacttttggactcaagcgatcctcccacctaggcctcccaaagtgctgggattacaggcctcagccaccacacctggcatctttttgagcctttaagtgaaaaattaaatttcagaagtacagaattttgatctaagtcactgatgagaaatagatcgactgccccccgacccccataacttactggtaatgtgctgttgggcagactatgagaatgaaaagtatggaaaggcatcgatgcagtgacctgatattggtgatctagtaatagagcatatgactcaggttttggatttggttagagggttggatcagtctctggagtttagtgcaatgcttcggaccctttggaggctgcttgtgtcttttaagtagtctggctccttaatgtctatcaaaaaaactatagagatttacccccttctgtacctgttttaaggtggagaatggcggtccattccctcagatgcggtctgctttcttcctcttgtggcctttaacaagttatctttgacattgggttcagagtacctcccaccttaaactctgtctgaatctctcagatgttttctgaacatggtgcaatatagtagctgcttctttaccagcctcaacccttctttacatgaaaacatagaacccagctttccagccgggatttagccaactatc

SEQ ID NO: 2211 - DNA, 1044 bp, Homo sapiens
attatttaaatcatgccttaaaagaaaatactaggccaggcacgggggctcatgcctgtaatcccagcactttgggaggctgaggcgggcggatcacttgaggttgggagtttgagaccagcctgaccaacatggagaaaccacatttctactcaaactacaaaattagctgggcgtggtggcacatgcctgtaatcccagccactcgggaggctgaggcaggaggatcgcttgaacccgggaggtggaggttgcggtgagctgagattgcgccattgcactccagtctgggcaacaagagtgcaactctgtctcaaaagaaaaaaaaaggaaatgctgttatgtcccagataatttgtgaatgtgcttgtagattattgtgaaggaagttacataaggcacaccagaattggttcaccatgtccagggaggccaatcctgggtggacagtgacattctaagcagacttgaagccatgaagtctaagtatcatccattatcacactaagtatctgaactcaaaggaattgtggatgcccttactagttgtctttctcctttaaatggatttcacatgtgcattttagagtgcttttttccattgaactggaacattgctatccaagagatgttcctgaattatctgactcatctgtgttttagaatcagttctgatagttgactcccatatcttcgggttgtagatacctgttgtttcttctcttgctacaaatgggttttatagatttaaccagagtctgtactaaccaaattaatcctaagaattagaatggattgcagtatctgtagggggattgtgcaagtttcaagtgtttgcttgtgatttaatcatttaataactctttcagaaagaatgtggcttcttctgtggcggtcatgccaaaaaaaaaaatccactttcctgagtgaaacaataggtgccataggagtggatcaaaaactgcagcttaaaggcataataagaatgaattaagaatctaagaattcagtaaaacaggacataaaatataaaaatcaatagct

SEQ ID NO: 2212 - DNA, 1058 bp, Homo sapiens
atgtagtgggtggggaatagttgtaaagaagtgggtaatgaaaacaaggtaatagggttgaggaagaagtggcacttcttggaatattcctttttgtatagctttgactctgagaatcatggtaatgtttcacataccaaaaataaataaataattaaaattaaaatcaaacaatagggaggcactaaaaatggagcagaagtagtaacaaatgaacctaaatgttttacaaatgaataacataactttttaggtgagaggaagaactaacctaagtaactttgtaaaatagtatttacaaatagtaaaatagtatttgactgcatcatgtaggttacagttaaaaaaactatacaccaaaattgtagttcaattaataggtgtgtttttcacaaaggtatggattaatacttctgtaattgctttatattttaagattgaaaaaataagtatagatgatgagagccaagtgtatcactgttagagaaagaagttacaaataagggaagagtagaatgaacctcgaggtttggattggcatctgggctatcagtcagtatgataaatggatggatggctatatggttaggtatactgtacttcctagctctgttctctgagaacgcctaggaatagtgatactcctgtagcaatgaacatacctagtgctcacatcttggtttctaaatataattctccactaaaagacagcagggttccttggaggagaagttgatatcttggcttggacagagaaaatacaagataagtatagaatatcttgtgtattcaaaaaataaggaagtgcttgataaagaatggggatgtatagaagtacacaggagttaattggaaggagttccagtggccaaagctggaacaatttgagcaacaaaaaaaataagatagtattggattaaaactcacagaataaaataaatacttatgagttcatataggtataaataaatattaggaaaaacaaaccatttttcctctgctctcacactacaacagtcaacacagaagacttctgtgatctcaaaaatatgtggaga

SEQ ID NO: 2213 - DNA, 1034 bp, Homo sapiens
cctgcctctgcctcccgagtagctgggattacagccatgcatcaccaagcctggctaattttgtatttttagtagagatggggtttcaccatgttggccaaggtgatctcaaactcctgacctcaagtgatccacccacctcgacctcccaaagtgctgggattacaggcgtgagccaccacgccaggctccatgtttcaattaccacattaattggtctaagaggaaggtgttgtcatcttggaagagaagatggctggaaggtgctatgcagtgactggaaaaagtgtaagggtgttgaaacttcattgtaacaaggcatgtcctgcaagccaacttgtttcttttacttggaggaatcagtcttagcagttatcagctctttttgaaacaacagattaagtttctttctggaatcttgttggcatcagggttagagcttagtaaatttctatggctttcctaggtactcttagactcaataaaattttctctttcagaatttggtgttcacttggcagaactgactgtagatccccagggggcactggcaatccgtcaggtaagtccagactggcccaatttataaatagtttccctttccttggtaatgaaactttcttataggaaagaaaaataaggccagtgtataaataacctaggatgttgtgccagatttagatatacttcagatgtatcaggctatgtatatagtttttatgtgtgaaaaaaatctttttcttgctgtactacttggcttattctcttcacagctggcatcagtcatcttgaaacaatatgtggagactcactggtgtgcccaatcagagaaatttaggcctcctgaaactacagaaagggtaagtcagttacttgattagtctacctgaggagatttgagggtccattttaagagattagactataacattctttgacagcatggagcaatcaaaagactaggcagaaaaggagattggtggctggcattgcgggcatagggctatacattaaagagctcaagtatcaggctg

SEQ ID NO: 2214 - DNA, 1035 bp, Homo sapiens
agattctgcctattgtttggaacaccctaaccgagagtgcagctttatatcctttcttgaaagtttaagggagctactaccacctatagttaggaatctcgcactgggtttcacattcatatggttccactcttcttacacaggcttttttaaggtgtctacttttagtgttggaatatgtaacatttccatgtagattatatgtaaagcagactccaaattctatttctttactcttcatcatacttatgtgaggacagaagtaaattacacagaagaagtagaagatcctgtggattctgatggtatgtagtttatttgatctttatagaaataccagttagtgggaaaagaaaaagaagccagagatgggggcgggaaacagtaacttgagaggcttcactctattaagtgttttctaattcagtttattttcgatgtattcgatgtggggaaatgagaattgacaatctttaatctgttccacataggtagttgcataaatctcataaaatcatagaatttctgcattggaagagatacttttaaggccatttaatctagcctacttctggcattttgttgtgtttcatttgggggtcccagatcatgaatctttcgtttctgttttaacatttctcattatttcagattagaacaatagacatactggaaaatatatccagtgtttctgattcttttacttgaaaaaccaaagaatatttaatatcctcaaaattacgttttgtgacctctgagccctctctcccaattcctcaggaatgatcattagcaagtactttaaatattcagtaatttacaaaggttatgtagttcattttctgcatatatgctttccttttgctttcttgtcattaatttcttctcttctgtatttcctgcaggtgaagtcctgggctttgaaaatctcgtctttagcatttttgaatttgtccatgctctactagaaaatagcaaattcaaaagcactgttaagaaagccttgcctgaattgatttattatattatcctgta

SEQ ID NO: 2215 - DNA, 1016 bp, Homo sapiens
atttacaagaagctgagcaaaccaaaaacagtggcactgagcactggtaagagtgagccgctaattggttaagatgcttttgtttaccccttcttaaaaagtcttgaaaggatggatttatttttatcttaatttgaaaatctggttttaatttaataacagattttaatctcttattattaaaatttcactcttttcagctataggttagaatggaagggcttaaggtaaatgactcttttggaagagattgtgctggagtgcccttttctgaatcttgtttcctcaaatatttatctcttttggcagtttagtatgttttactaggctgtagtatcctttcacaggtggaagatccatgaggcatgcatgcttgccctaggctcagtgaaggccatcatcactgacagtgtgaaaaatggcaggattcattttgacatgcatgggttcctgaccaatgtcatccttgcagacctcaacctctcaggtatgtttcagcacgtgccaggattctagaaactctttaaacctgttgtggggttgggggagggatcagcattaggagatatacctgatgtaagtgacaagttaatgggtgcagcacaccaacatggcacatgtatacatatgtaacctgcacattgtgtacatgtaccctagaactcaaagtataatatatatatatatatatatatatataaaggaaactctttaaacctgtcattaacttggttatattgttcacttagactggtaggccagatattcttgtgtcctttgagtgaaaattgtttgcaccctacagcttgaactcatccgaacctctaaaacagcccagaggccgattcaagcttcacctaatgacaatctaatattgcctagttcataattcttccgtgatgtttatgtttcttcccaaattggcgttcccattcatggttgtttttggcatttgaatggaatccaaatctggttgctgtaccttgagaattatcgagtactgctcccattgttaa

SEQ ID NO: 2216 - DNA, 1035 bp, Homo sapiens
ggctaaggcaggtgactcacctgaggtcaggagttcaagaccagcctggccaacttggcgaaaccccatctctactaaaaatataaaaattagctgggtgtggtagcaggagcctgtagtcccagctactcaagaggctgaggcaggagaatcacttgaaccaggaggcagaggttgcagagaactgagatcacaccactgtattccaccttgggtgacagagcgagacttggtttaaaaaaaaaaaaaaggtagccctttactattagaccgatttcttccgcaatacagagcagtagctgagaatcattgttgtctatgtggcattttctgctacttgcttctgccatgccatgccttttctcatccttggagccagatcaccatccgaaaacactgcctttgctttctctctcagtacttaaatcatggaacctttggtattgtttgctccattttcggtccatttacttcctctccataggatagttctgggagtagcttatgtcatttgaaaatgttctgctctgtgattttaaataggtaatctattatcgggtgtctcagtccatcacttccattctctgaatcacaaattaaaatggttgtacatccagagctcagatgcgttgggaatatcctgtttcactctgtacttatcatatgctgcattgttgaatatgttttcttactcctactagtaaggtctctgagagtagaaatcatgtctaatctttgtatcctacaagtgccttgagtaggcatcccatagttacacattgaatgatttctgaagcccatcaacacatttcttatagagtttaccctagcaaagatttttcaaaaactttggaaattttagaatatttgttatttagtctggaaaaaggctcaatatatatcatttgttaatcctacctgtagctaaaaccttttctacaccaaccattctgaaactttttggttacaaattatcaataatttaaaagacatttttatgtggctttaatttattaatatttaacatactaaaga

SEQ ID NO: 2217 - DNA, 1023 bp, Homo sapiens
tacttcaagtacccttacaaccattctgttttcacttacagtatagtattcaataaattatatgagatattcaacactttattataaaataggctttgtgttacgtgagtttgcccaactttacgctaatgtaagtgttctgagcatgtttaaggtaggcccggctaagctgtgatgttcagtattaaatttaaatgcatttttaacttacagtattttcaacttacgatgtgtttatcaggaagtaaccccatcataagcagaggagcatctgtattgcgtaatttgactggcacagtttattaggttctgttcagtgttttccgtcaacaagatgtttattgtgtgagtaaacaagttaagccctgtgacaagctgaataagaatagtctctcctcagcagcttatagtaaacaagggtagtaatccttacattagtggctagactatcaaacgaaatatataacatgtaagaacactaaagacagaattactgtggcatagagatagttagaattgcttcagcctaagagatgaattaggtaatgcaaggaggtgaatatgttggcttgcaatatgaacaaggcagagagctgggagagtaagatgtaagttgctaaggagggatgtgtacttgagtttggaaaccataaagggaaatcataggtaatgctagagtcactgatcttagggagccttgaataacgtgatgactaaggtaatctttatttggtggactatggaattaattgacagattttaaatagaagaatgacatgatcagagctataatttatgttttaagagtggtccaaggctgcacgcggtggctcatgcctgtaatctcagcactttgggaggccaagccgagtggattgcttgagttcaggagttcaagaccagcctggccaacatggtgaaaccccctctctactaaaaatacaaaaattagccaggcgtggtggtacgcacctgtaatcccagctgctcgggaggctgaggcaggagaatcgctcgaacccg

SEQ ID NO: 2218 - DNA, 1050 bp, Homo sapiens
gttgtttccctgtggattacctaaactagatccaagaacatgaaagaccatccctcagggagctggcatttgtctaaaaaccagcattccctgtgccatttgattgtggttcttgctccactgcaaatgggtgacttgcaatgtctcactaatgccactcttgctctttcctccaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaatggggaaaagggattttttttaaatccacctgacccaactatatttaa

SEQ ID NO: 2219 - DNA, 1074 bp, Homo sapiens
gcctgtaatcccagttaacttgagatgctgaggcaggagaatcgcttgaacttgggaagcagaggttgcagtgaaccgatatcacaccgttgcattccaaggcaagactcaatcacacacacacacacacacacacacaaatcatggggagaaagatgaaacctgtgttcccctttttttggtagtgcccacatctggtgccccatttttaataaccacaggatatttctttagattgatattctcacaaagaagaaatagaatataggctgggcgtggtgtgtcacacctgtaatcccagcacttacggaggccgaagccagcggatcaccagaggtcaggagttcgagaccagcctgaccaacatgatgaaaccctgtctctactaaaaatacaaaaattagccaggcatggtggcatgcacttgtaatcccagctactcgggaggctgagacaggagaatcgcttgaacctgggaggcagaggttgcagtaagccaagatcgcaccattgcactacagcctgggcaacaagaggagcgaaactctgtctcaaaaaaaaaaaagagaaagaatataaagtgaatctgaatctccactcaaggggatggccccaaggatattgtagctggtaatttcttcatgccactaggtgtccccagtgttcaacctccatgactgagattggaagaagtagagttaaaagtttttactacctttgagaagcctgcgggcatgttcacagtcgtcccatgccagccaggttctgaggctaactgcttgtgcccctgctgcttcacatggcattgtgggagttgctgatactggggaaatgatggcagatctgaccaagtggtgctgagaaaaccaccctcggccttgcagactccatagtttatctcaaggcagtgccagtcggatttggtgctaaaggcataaggccaagtcagcctctgatattggcacaaaagaatggtctcatgccagtagcattgaactgctgagcttgggaaggcttaaggctcccacacacagactgagaatgatgggggtccctctgcgtctgctaattaga

SEQ ID NO: 2220 - DNA, 1097 bp, Homo sapiens
ttaactgaactatttttttctgttcctttgaagatggagctatttttatttttagattacaacaattagtgattttagtttggtctaacggtttgtcacaaacatatatccctatagtttcttcttgatttgtagtttgtttgaaaaattaacctgaattatgatacccatttgaaaatcttgtctctgtccttcagacactcggtgattttttttttttttccttctccagaagaaagacagttatttaaagctcaggtgtgaggccgggcacggggctcacgcctgtaatcccagcactttgggaggccgaggtgggcagatcacctgaggtcaggagtttgagaccagcctgaccaacatggagaaaccccatctctactaaaaatacaaaattagctgggcgtggtggcgcatgcctgtaatcccagctactcaggagactgaggcaggagaatcacttgaacccgggaggcggaggttgcagtgagccaagatcatgccattgcactccatcctgggcaacaagagcgaaactccgtctcaaaaaaaaaaacctcaggttcgtgagtcaggaccgatagcttctgaggtaacataaagctgaagagaatgtgatctgaaggattggggtttcatgcaggagaaacccatcaagccgattgggctcttctccaaggttggttttgggacattgtgcagaggtcattggaaaatttgaaaagattctattcattgtactttgtaaacttggttattcagaagctgggaaaagggaggtgacaaaaaatgtttgtaggttatattcacttacaaaggtatagtcagggttgggcgcaatggctcacgccaataatcccagcagtttgggaggctgagttaggcagatagcttgagctcaggagttcgagaccagcctgggcagcatggctgcccatttccccagaaaaatggaaaaattagccaggtgttggggcatgtgcctgtggtcccagctactagggaggctgacatggacggatcacttgaacccatgaggttgaggctgcagtgagattgcaccactgcactccagcctgggtgacagagaccctgtc

SEQ ID NO: 2221 - DNA, 1087 bp, Homo sapiens
tctgtcgcccaggctggagcacagtggtgcaaacttggctcactgcaagctctgcctcctgggttcacaccattctcctgcctcggcctccagagtagctgggactacaggtgcccgccatcacacctggctaattttttttgtattttttagtagagacgggggtttcaccgtgttggccaggatgccctcgatcttctgacctcatgatccacccgcctcggcctcccaaaatgctgggattgtaggcgtgagctaccgcacctggctgtttttgtatttagatagagtttaagtgcaaagtaatctgctgatttaaggttgttttaaattcatatctgaggaataaaggatggacaggcaatttccatccctttgatgttccatagttctagctatttatatcattcatttgccccttcagcatggattggcttacacctgtaatacgttccagaatagctggatttcttttgttttcccatcggtgattttcatagagtagatgctcaatgacatataatgcagaaaggccaaaaatagaggtaagtaaagctatgaaagaaaagaagaacgaaagaggaagcagagtagtttgattttgtttattgctgcttaaaccagagagatatgttattctggaagggtgatttgcttgtttttacacatatgcagcctgactgttttaggcttggcttcttttttgtttgtttgagatggagtgtcgctcttgttgcccaggctggagtgcagtggcacgatctcggctcactgcaacctccgcctcctgggttcaagcgattctcctgcctcagcctccccagtagctgggattacaggtgctcgccaccacacccggctaatttttacatttttagtagaggcggagtttcgccatgttagccaggctggtcttgaactcctggcctcaggtgatccacccacttcagcctcccaaagtgctgggattacaggtgtgagctatggcacccggctggcttatttcttataggctttgggccgttgctaattttccagctgatataatacaatccagctttattcgaaagataagtattctaactct

SEQ ID NO: 2222 - DNA, 1030 bp, Homo sapiens
ctaaatgaaaatatcccttgacaatggaaggatgcaaaaagatattgtgaggtggccgggcacggtggctcacacctgtaatcccagcattttgggagactgaggcaggtggatcacttgaggtcaggagttttgagagcagcctggccaacgtggtgaaaccccgtctctactaaaaatacaaattagcagggcatggtggcacacgcctgtaatcgcagctccttgggaggctgaggtacaagaatcacttgaacctgggaggcagagattgcagtgagctgagatcacaccattgcactccagcctgggcaacagagcaagactccatctcaaaaaatatatatatatataacatatatatgttatatatatgctatatatgttatatattatatatgttatataatatgtatgttatatgttgtatatatgttatgtattatatatgttatatattatatatgttgtatattatatatgttgtgtgtgtgtgtgtgtgtgtgtgtatatatatatagtgaggatagtagtagtgaaaatttgacctggcatttgggaaggaaaaaaatacgtagaatagtgagacatgttgaaaattatttttggagcttggaaaagattcagcataaagttaggaatagatcatacatcccaatttgctttgatttccctgaggcacctagcaagagattcagtatctttttggcacaattttcaagtgcactgctcgttaaatggcagtgagtaatctagatgaccctgcagaccctctcaccttctgtttgtttttcattccttacttctgagttaacactctgtagtgatggtcactttccaattttgttttgactgcttcagtgtgaaagactttacataaaacatcaaaacagttccatattcacagaaattcagaaatggatatagttaacttaaatagttacattgtctcatagaaattagccttgagtactttgttttaggcttttttcctcagagggaatctcctttttatttatttattttattt

SEQ ID NO: 2223 - DNA, 1046 bp, Homo sapiens
accaaccttcagggtttcttgacctctactcagggagccttctccactctgtcagccacccatattcacacccatgctctggagtctagagcctagacatcgtcattgtcatgaactgtaccatatctgaacttttaaggcccttgagccccttgtcctcattcatcctgactctgctaaccttccagctctctgacggcctctctcccactatattccaccatgtctcctccttgagctcatggcagcctcccttccggcaagccactcatttctcctgggcagtcaagaccctcctgactgggcttccctccctggcccaagtgtgtggttggttacctcttaccaacaccccaaagccccttgcccacttcccgctgctataatgtcccagtcccttgttatacaattccttttctctacttctataagtgggtatttgggagatgtagaaaatagtgaaactacacagtaataaccactacacctttctcaattcttcgtgaaaagttggaattaaaggaaagttgaaatagacatgtgtggggttttccagaaaaatgtaacagatgtacagtcttcaactgcaggtgtgctttcaaggttgttcaacagtcctcttatttacctttccatctcactccctttaagctgttctaagactttactcttctctttaagtttgctatccaatcccatcccctcatttaagcagaaggtcttgtctcctgttttattgagaatattaaattcatcagatatgattatgtcagtttcctgtcctccacttaaaaagttatcttcatctgcttttatccttccggactgcaacaaaggtccttccttctgtttaaagccaaatctcttcccttacatgtcctctgggactttgcctcatcatttacatctctctcttcaaatctgcagcctccccctctagacaagcaccagtttctctaagatctatagcaaagcaaaaaacaaactcaaggctgggtgtggtggctcacgcttgtaatcccagcactttgggaggccaaggtggg

SEQ ID NO: 2224 - DNA, 1039 bp, Homo sapiens
ccagctacttgggaggctgaggcaggagaatggtgtgaacccgggaggtggagcttgcagtgagccgagatcgcgccactgcactccagcctgggcaacagagcaagactccgtctcaacaaacaaacaaacaactcaaaaaacccttaactccatattctcttctggcacgacacactgtccttccctctgtagccaggtgacttcagtggcatgtatacgcactggctgcacttcttgaaacccccccaccccacaatcatttattgctacaacccattggaatccagccccccacccttgccatgccgttgaaactagtaagagaggccattcgcctcaatacggataacatatgtgatgctttttagcccttgccttcatgttctgctgtttttcttctgcccccattgaccctcctctggcttctgtgacaccacccatgctggtcatcaggcctcctggttagtccttttctcatctccttccctgactcctctgcccagctccttgtgtgtcgatgttgcccaaggctctgtctttgacctgttcttttcttctacatgctttccttggagagctcacccattcttgtagtttaacatattttctgtgttctgcagccaggatgatatcttaaaactaaatctgataatgtcacttgttggcttaaaatgctcccatggctctgaaggtccggttctgtaacagtgcacctgaggctcttcatgacccgaccctcttgggcatctcatgtcccacctcctgccactgcctccctcattgcaatctgatcctgtcctcaagtaatcccagactctcggtgcttcctcacatgcatatgcagtgttccatggctacgtctttgcttttgatatttgggaagtacctgatactggtttccctgtatcttttcttcctgttagaatagttcctatgcttcagcaaacgcagaggaagttttccctcatccgggcctggacccatcccactttgccatcagtctcttttttttttttttttgaaacagagtcttact

SEQ ID NO: 2225 - DNA, 1135 bp, Homo sapiens
ggtcaggctggtctggtactcttgacctcaggtgaaccacccacttcggcctaccgaagtactgggattacagacatgagccaccaggcccagccagtctcattcatatgtctgtgtggaaaagcagttctaagcgcagccaggggctcttggtcaagcagagcctttggctgcaggatccctgagtccattgcatctttccattagactggatcttcttgttttgtttttgtttttgtttttgtttcctccaagccacctttgtttccctatctttttattaagaaaatttcaaatatttagaaaattgaaaggatgatgcattgaacacctatagaaccatctactttgtcatattagttttatgagtggatttgtttttatttttgctagaccatttaaaagcaagtaaatctgtgtgcctctctgaagaatagaggcattctcccttataaccacaatcccattattgtacctaaggcagttaacaaatttctattaacattagtaggtttgggtcggacacagtggctcatgcctataatcccagcactttgagaggctgaggcaggtgaatcacttgagcccaggagttcaagaccagccagggcaacatagcgaaaccctacctctacaaaaataaaaaaattagccaggcatgatgatgtgcaactgtagtcctagctactggggttggggagctgagatggaaggatcacttgagccccaggaggtggaggttggatcacaccactgtactctagcctgggcaacagagcaagaacctgtcttaaaaaaaaaataaaaaaggtttgtctcttaaggttttattcaattccagattctactattagaacgctttcttatctctcctctaagtagggagaagaaaactaacatttactgtataaatgtttgaagggcttttgtgtgttgtcttatttaatcttcactcattttacagatgaggaaactgaggctcacagaggttaaatcacttttgcaagatcgcattcagtagtgaagccataactgcgtagcacggttccacctccatgaggctgtcttgggttcttgtttctcaggtgtggtgagcggtctcttggatctgtgtggtgatccgatcttgcactcc

SEQ ID NO: 2226 - DNA, 1050 bp, Homo sapiens
agctggaccgtatgcggctgtgagctttatgtgccgcagctgctgatatctgctattcacgtggtggctcaccacctacacctttccagaagtctggaatcccattgtgtccacccaactcattcattttgttgactgtagacgtccccatgttagtatggattgggacgcgtattgagatccatctccatggatctctggcgcccaagaagatgcctgaattagagcacttctgatgagaagctcctcattccagctgtgatgcccacatcccttttagcacctagccatggctgctgttagactggcactgggggcagcagggctggacagatccaccaggcaagcttcttaggcatgtgtatgtgtgtttcttgcaggggaagcagaagtatacacttccgctgtaccacgcaatgatgggtggcagtgaggtggcccagaccctcgccaaggagacttttgcatccaccgcctcccagctccacagcaatgttgtcaactatgtccagcagatcgtggcacccaagggcagttagaggctcgtgtgcatggcccctgcctcttcaggctctccaggctttcagaataattgtttgttcccaaattcctgttccctgatcaacttcctggagtttatatcccctcaggataatctattctctagcttaggtatctgtgactcttgggcctctgctctggtgggaacttacttctctatagcccactgagccccgagacagagaacctgcccacagctctccccgctacaggctgcaggcactgcagggcagcgggtattctcctccccacctaagtctctgggaagaagtggagaggactgatgctcttcttttttctctttctgtcctttttcttgctgattttatgcaaagggctggcattctgattgttcttttttcaggtttaatccttattttaataaagttttcaagcaaaaattaagttacggattgagtgactattaaatttcttccaccagaggtcctcactgtgtttgttcaggaaaggtcactgggggaggcccag

SEQ ID NO: 2227 - DNA, 1071 bp, Homo sapiens
caaacccatctctcatcattaccccacacacaacctctgggcctaacctgtaaccctgctcccagcagtgtatccattttcacatttcttctctgggccttagcatgtgctcttccacttgcctggaacgtgttcccttccctctcttcacttggctaattcacctttcaggtcttagcttggcttagatggcctttctcttggaaaactttctctggtcaaagtctggtttaggagacttggttctatggtccccataatatccccatcacagctctcatcacattgcgtggtatttaatttttttttgagacagagttttgctcttgttgcccaacctggaatgccatggtgcgatctcagctcaccacaacctccacctcctgggttcaagcaattctcctgcctcagcctcccgagtaactgggattacaggcatgcgccaccatgtgtggctaattttgtatttttagtagagacagggtttctccatgttggtcaggctggtcttgaactcccgacctcaggtgatcctcccgcctcagcctcccaaagtgctgagattataagcatgagccactgcacccagcctaatctgccttctttcccaccagcctataaaactgtctgggaagaaaccaaactgcttggttcatagctgtctccttagcagctaacaccgtgcctgacaaaaataggttttccttttttgagatggagtctcgctctgtcacccaggctggagtgcagtggtgtgatctcggctcactgcctccagagtttgagcaattctcctgcctcagcctcccaagtagctgggattacaagtgtgtgctaccacgcctggctaatttttgtattttttagtagagacaggttttcaccatgttggccaggctggtctcaaactcctgacctcaggtgatctgccagccctggcgtcccaaagtgctgggattataggtgtgaaccaccgtgcccggccaataataggattttcaatacatatttgttgaataagtaaatgagttccccaacagctggaatcctgtttatgtcctcctgcagctg

SEQ ID NO: 2228 - DNA, 1046 bp, Homo sapiens
taattttggggggcacatttgtattgagcacttcctggatgccagatgctgttgtatactgggatacaaacatggcatacaactgtgtcttgctctcaggcatcccacagttactgacaaactcataattttaaagatctattctggtctatattgcttgtacttcatgttgattccatttcctattaatctgttcatagtaaaagtggagaaaagggtattgatcattatctacacatttacctttgtatgttttaagataatcaagaccttgtcattagccttctctaataaggataaacatgtgcattctttaatttagtttccaaatcattaatcgttttgtctatctctcctgggaatttctagttccctttgggtcccctggctctgtgagaagagactgtaatgtcttcagctctggggaccaccactagggtgaaagactattataggaccacttgaaagtacagagttgcaggactgtcagatatgcgtttgttttattagaagattatgaagttccaggatattatagcaaaaagaacattagaggacaccatttgacccacctgtgccattttattttattctatttatttatttagagacagagtctcctgtttgttgcccaggctggagtgcagtggtgcgatcttggctcactgcagcctctgccttagggttcaagtgattctcctgcctcagcctcccaagtagctgggactacaggcacacgccaccatgcccagctaatttttgtatttttagtagagacgggtttcaccatattggccaggctggtctcgaactcctgtcatcaagtgatatgcctgccttggcctcccaaagtgctgggattacaggtgtgagccaccatgcctggcccattttattaatacaaatgagaaatatgaggcctagaaaaaagctaaaggaataccttaagcatggtacagaaataagatataatgaaatgttctatttatcaaacttctgcttgatattcttttctgtctatggaaatgtagttatttgcaaattat

SEQ ID NO: 2229 - DNA, 1065 bp, Homo sapiens
ccagcactttgggaggctgaggcgggcagatcacttgaggtcaggagtccgagaccagcttggccaacatggcgaagctccgtctctactaaaaatacaaaaattagccaagcatggtggcacatgcctgtaatcccagctactcgggaggctgaggcaggagaattgcttgaactgggaggcggaggttgcagtgagccaagaacgcaccactgcactccagcctgggagacagagcgagactccatctcaaaaaaaaaaaaaaaaaaaaaaaatcagttgtgttttcttaatacagtaatgataacaaaatacattaaaaatcagacattgagcaacagaataaaaatgtatgaatattaaataaatagactaagaaactacaaaattatgttttatttaggaacacctaataataccagatgtattaataatgatgatgttgattataatgcttttgatgacaaacatacatttagaaattgtggtgctattagagcaaattaaatagaaaacttcatttacatatgggtgcaaaacgtagaacctcactgattgttaaacaatgtagactaaaataaaaatatagactaaaatgattcaacaggaagatcaagagaaggggctatttcatggagtcactgtactgtgccatgtgcatagttttatgtaccaaaactatggtacttaagtggttccatatagtgaagtcatgtgcatagttttctgtaccaaaattataattaggaagtttatgtagagaactatatgaattaaatataactttacccatcctgaatttttagttggttgcaaaacatttttaatacaatacaaaattttattcagaagatctttacattacactacttataagccattttagaacaataaatgattgggaagatctgatataaagccttttagctctaacgtattgatagtaagcattcagtaaatattgagtattgttatgtttagttagtaaagcaaagtggttaagattatgagctttggaatcagacatagttggtttctaatcctggttttgctacttacataagc

SEQ ID NO: 2230 - DNA, 1149 bp, Homo sapiens
tttacatatagtaaaatgcatagaacttaaatctacagtttgatgggttttgacaacgtatacaaccatgtaaccaatatggtttggatatctgtcccccgcaaatctcatgttgagatgtaatctgcaatgttggaggtgggacctggtgggaagtgtgtgggtcatacgggagggtccctcatggtttggtgctgttctcaagatagtgagtgcagtctcaggagatctgttttttttttgtttttttgtttttagagacggagttttgctcttgttgcccaagctggagtgcagtggtgtgatctcagctcactgcaacctccgcctcccaggttcaagcgattctcctgcctcagtttcccgagtagctgggattataggcgcctgccaccacacccggctaattttttgtatttttagtagaaacagggtttcaccatgttggccaggctgatgttgaactcctgacctcaggtgatctgcctccctcggcctcccaaagtgctgggattacaggtgtgagccactgcgcccggccaagatctggtcatttaaaagtgtctggcactgccccccgcaaccttgctcccattctcgccctgtgatgtgcttgctccgcttcgccctccactgtgagtaaaagctccctgaggcctccccaggagccaagcagatgtcagtgccatgcttgtgcagcctgcagaattgtgaaacaattaaatctctttttttaataaactagtcagcctcaggtatttctttatagcaacacaagaatagcctaatatggtaaccatcacccaaatcaagaaataggacatttttgcctcctttgaaagttctacccaccaccccttcatcctcccccaggctaccactgttataatttctatcattctagaattagtgttggctgtatttttctttttttttttcaagaaatattaactattctttatttgatatatataagccatataaaatgccttttaataagttaaaagaaccattttattttgagatggggtcttactgtgtcacacaggatgggttgcaatggcaggatcatggctcactgcaaccttgactcctgggcccaagccatccttccacctcagcctcctgagtagctacgactacaggaat

SEQ ID NO: 2231 - DNA, 1035 bp, Homo sapiens
atttgtaggcattcttgatgttttctggatataagtccttggtcagataaatatattatagatattttaccctggtctatgccttgtttctttacgttcttgttttgttttgaataaactttttatttagaagtgatttaagatttacaaaaaagttgcaaagatagtttagagagagagtatttgtatacccttcacccagctttcctgaatgttaacattttacataaacatggtgcgttattcaaaagaagtttttttgttgttatgttgatattctggatgccatttccttcattatagtttcttttttttttttttttttttttggagacggagtatcgctctgttgccctctgcactctgctggagtgcagcggcatgatctcagctcactgcaacctctgcctcccaggttcaagtgattctcctgcctcagcctcccgagtagctgggattacaggcacgtgccaccacatctggctaatttttgtatttttgtagagactggatttcaccatgttggccaggctggtcttgaactcctgacctcaggtgatctacccacctcggcctcccaaagtgttgggattataggcgtgagccactgcgcccagccccttcattatattttccaatcagtttttcttatattataaaagtaatttttggccggttccagtggctcttatctgtaatcttagcactttgggaagctgaagtgggtggattgcttgaatccaggagttcaagaccagcctgggcaacaaagcaagaccccatctctagaaaaaatacaaaaattagccaggtatggtggtgcgtgcggatagttccagctactcaggagtccgaggagggaagatggcttgagcctgtgaggcagaggctgcagtgagctgagatcaacactaaacttcagcctgggtgacagagtgagaccctgtctcaaaaaaaaaaaataaataaagcaattttgcctggacaaggtggctcacacctgtaatctcagcactttgggaggctgggcaacat

SEQ ID NO: 2232 - DNA, 1027 bp, Homo sapiens
tttctaccccaacccactttctctatattctttcgtctttgtaaccttacccactcccatggcctcatccctcattatgtactaatgatgtcgagatctgtctgaccctgacctgtttagacttgacttttttcctggactcaagatatgcatttccagctgcccattagacatcttgatgtagatgtcttacaggtttctctcggtctcagtatttccagagcaaaattgttctcatcctatcacaaaatttgttgctcctcctgttttctcttcttgaaaagaaatatcatcagccactcagtcatttaagtcattgattcccaattgactgcatgagaatcacctgggggcacatgttaacaatagaggctgctgaactgtatcctccaaagagcctgattcattaggtctatggtaggacccaggaatcttttattctgatgcttatccaagtttggaaatcactgatgaaaactgatttgctccctccgtccccatctccaccgtctactgagttaccaggacttgtcagttctatctgtgtaatgtctcataactctgtcttcttgtctccatttacactgctagtattctagttgagactgtcatctttatgggaacttgtaggtacatagtaggtatttttaaaattcttgttgaataaatgaatgcatgattgccatagtctgccataggtctattttttcccctaatttcacatctttacagtctatttctaatagtaccttgttatttttaaaataccaatctaatgatataacttttctttaaaaaacaatccatcattggctttcgagcttggttatacatcagaatactcattaaatgcagattctgtctgtttaagaatgaggacaattaaagaaaaatacagatgcctgagccccaactctggaaatttcaatttagtagatctggagtacagcacaggaatctgtatttttaccaggtatcccagagattctgatgcaattttgcattttgaagccattcacatgcagag

SEQ ID NO: 2233 - DNA, 1049 bp, Homo sapiens
attatgagaatgtccaaattcagcaataattaaatactatgcatgtagctattttctggcactgaagaaaatcatgatagcaatggtagtagtaataacaatggcactggcaagaatacagcatagtcctaacataaatattttcttttttacttttgagatggagtcttgccctgtcgcccaggctggagtgcagtggtgcaatctcagctcactgcaacctccacctcctggactcaagtgattctcccacctcagcctcccgagtagctggactacaggtgtgcgcccctgtgcccagctaaaaagtattttctatatgtttgatttttttaggagacagtatgccaaattccttaaatttggcagattctcatagtatatgatctcatgctctgaaagagggaaatagaccactggaaaaatggatagttctcagctagtgcattacacgcacatgcatacacacattagaaacaaaagaagcaaaaacgaaaacccaaggacaaagtgattctgatgtcattatttccacagcaaacagctgggatttttacatatgtgacattaacttagaaaacttagaaaatgtaaagctcctacttcatcctcactgtcatgttagtgtcacctgggggctgtgatctgaatcttcactgaactctcttcgttattatagcattcattgattttgatgatattaaattgccttttggaaaatattcactatttagttgttggagtcccttcctcctttaacctgttctcccaaaacagctttggtttttttaagagacagtgtgccaggcatgctggttagcctagaattagtagacacaaggaaccttctgtcagagggattgttgtgtctggcacaggatcatttgggcacagtatcatagcttgcctggcagaagtctaagcaaaggggcacaacactcttggcaagttgagagtggcaagggtaatgtcttatgttgcccaagtaactctgttttagttagaatcctgactagctgaaaaagcatacttctctcaatggctttggt

SEQ ID NO: 2234 - DNA, 1067 bp, Homo sapiens
tcttttgcctatacagcatcttacaacatcctccattctgttctgaaatttctcctctacctctgtcctacataacagttgttcagagtttgggcttgaggacactctataaatgagacagttgagacagattgaaagcaaggtaacacacactctttccttaaccttcagtgcctctgcaacagcatctgaaattttctgtcttggcaagcttcacctaattctgagcaccctgctagtgaagtgctctgggaggctgggatttgactgcagataagtaagcacttaccatcaaaggagacagggggcgtttctcattttcatttccataaagggatgccattgctttgccaggctatgtggaaagtctttgccttaacagtgaatcttgagtcctctttcaggtttttacctgtccatattctacttttggaacatgaggtttctacctttttgctattcctgatcttttcctggacttaggaatgacttctcttaccaacaaatcacggaagcttttcttgttaccttggtactaccagtaagctagtcggggagagtggaatctaactcttctatttgtgatctcaagggatgtttgtgttattcattggtttgtatttttcattctacttcccttcttctaggacatagcagtctgaagtttggactacaggctatgttttgttgtatcattatgcttgatgctttcaggaaaaaaccaagttgttcagatttctcaagtcttaatctctagtgtgtgttctgttttcagcctcaatagtgaatttatattatcagatatacaaaattgattatacccagatttggactgttaaggcctagcagaaacaagacgcagctttaagagaggtcaactatgtttctgctcatagccagcatttccttggcctcggacagtgctgaggtcagagcaatgtagaaaaacaattttctgtccaaggggtcagatgcctgagagatgcaactcaaacacctacagtgaggggtaacatatacagacatttgtcaaaacttagtgaatgtatacctaagattcgtgcttt

SEQ ID NO: 2235 - DNA, 1052 bp, Homo sapiens
tgtttgacaagacaggaaccccaacagtgagagtgagatgttgaacatggtcagaccaacaagctataaaataatccacaggttttgatttatagtcaggcaaacactgagaaaagaatagtgtacctaagccccattttcactgccatattatccctccaaactggagtccatgatgagatgaaatgtttctgctagaggggaaagggtcacacattaagtttacaatggagtctgtgttttcctctgaactctgccatggctggcctacctataatgaagatatttaacttactctgttgtctggccaccagctcctgatgaggtctggctttgctgatatgatttctctccatgatgggagaatactacccttcttcatgtctcagtctctgaggctcactgaatgtcagtcaccaaaaggaagttagagaaccatcagttctatagagaagaaaggcaccagctaagtttacagtataggagatgaccttttattcattgagacttgaacttctattattaatcatgcacagtatgctccggaaatggtattgtagtacctgtcagaatttataaatgttcatctttttgatatttgattatttattgagtacttacatgttctaggcttcaaatatttgcaacaagtatctgaacttgctctattctagatcacttttgttagttgccaaggtatgagaaaaattggagggatctgcctgaactatggtcattgctttgtgatttgtacccttgcgtcagatctcttgttctctgtagccaggtcttcacattgctattggcataaacacccacagtacccttttgattatgctacacctctgtttaaacctatgaccacctccctcactctatctttgcctacagagtaaataaaccccaagctccatagtctggccttcaggacttttcataatctagctctagctgacctttccaatgctgtacatagataaggacatattttggccaaactggactgcttaatttcctcaaacctgccctgagctttcctgcttctgaacatt

SEQ ID NO: 2236 - DNA, 1046 bp, Homo sapiens
tattattgttctgtattttgtctctgagcagtcagtttttggtgactcaattatttatgattatttagcatagacacttaacgccgttatggatttattttttttatttttttgagacggagtcttgctctgtcgcccaggctggagtgcagtggcgcgatctcagctcactgcaggctctgcctcccgggttcatgccattctccttcctcagcctcctgagtagctgggactacagctacctgccaccatgcccggctaatcttttatatttttagtagagacggggtttcaccatgttagccaggatggtctcgatgtcctgacctcgtgatccgcccgcctcggcctcccaaagtgctgggattacaggcgtgagccaccgctcccggctgtcgttatggatttaagcatatcttttttctgtttgtcttgtgatagagacaattgttaggcattatttcaccattttgtaatggagaacctgtgaagcacagagaaggatcttttgttttgttatggatagtctacgttgacttctctggcagcaaagaaaggaaacagtatgacacaaggctcaaagaaatagaactaggatataaacttttgattaatttgagaagaataccagaaaaagaaatgaataatatgtgatgatatggtagaagaatagtgactagatattctgtaatttctttagagagaagttatgagagaatattgtgaattgacatagaagagatttaaggtagaagctaagaaaaactttttgattgccagcattaagagaaacattagaaaatgtgaccgagcaagaatgggtcattttctcctacttgaggaagtattaaaaatagaatgtactgcatttgggagtttcaaatgtacttaaagactaaggctataattatcccttgttaagattagaccaggtgaaatcttatcaaaatttagatttcagtttgacttcatattattttgaatatccaaaggaaggagcttttatatttgtgtgtattaagagattgtcttttctccaatgtatg

SEQ ID NO: 2237 - DNA, 1078 bp, Homo sapiens
tatagaaaccaacaaggtcatctgattataaagggactgatttgacaggacagaaatggcaagtggcaagctgttggcagatagctctgcagaaataccagggccaggcagcagctgtcacaatagggtagtggttgggttcattttccaaagctccaagttttccttagcaacaaaatgtaaacaattcccattgctaatattagagtctaatagtgtctgactttgattcttttgtttttcctttagctttttctctctcacccaaccctgaattttacctcttttttaattgtgctctttcttttctttgtagaaatggttaaaaatagtttttctccacaataagctaaaattgtctttcccaaatagctcacattacatatgactctgctttgcttggtcaagatacagtgagtactggctgagtcatatataccacacttatggaccttcttcagtcccttggggtctttataagctaggtagttatacctactaatgtgaagctgtcagcagattaatttggcatcatctttggaatgttcaaaatttaaaccaagaatttaaactctgagttatggtttttaaaagtcatttgatttgttcccctgtgtccaagctaaagactggcagttgtcaattcaaaaaggtactcaaagaggttccacaaacgactccaatctttctccagttttgttctaaagtgattagttatctaaaagtctgcggccatgctgccattaccaagttttttctctactgatagaaataagctctctcttcctaagtatgaatattgaacaagaagagagtgaaacatatgtagcagtgggtacattttctactatattacaattctggaggtctctggattgcttatagaattaggattatgctgtgggactctgaacaattctggaatagaaagaaaaaaggtgattcttttagtgctttggccctaatccttaggtagcaaaatgacaagaggcttcaccaggctgaatatgccttacaaacaaactgctttcagtgtcatatggcacctctatgtaattttttttcagaatatgtctct

SEQ ID NO: 2238 - DNA, 1236 bp, Homo sapiens
ccgagatcacgccactgcactccagcctgggagacggagcaagactctgtctcaaaaaaaaaaaaaaatttttttttagtaagacatatactacaagatacatctataaaagctatatactcaacttagttcctttcctgtttggagtgaacatgtttaaataccattctctcctcaacagatttgaggtataggactctaaagctacttcaaaacccaatttcccattggattccggacaaaatttattttgttatcattctagagaaagcagcgttgttctctccttggaaattatgattatttcttttttcattcttctacttggagtagttttattttacttaggtaaccctatgaaccttcatggagaatatttcaagggaattaagtcctcttccaaatgagttagccatacctggtaaaaataattaaggggaactctttgattaagatgtgatgaatattgtagcacacctatcctttctttattttccaaattattactgatgagcttttaatatgacaatgaaaataatgtagtagtaagagtgttggtcgtgatgatagtagttctggtcatggtagtagcagcaaacgtgtgccaggttctattctaagtgccttacatgggtttgcatttaatcttcacaactctattaatatatctgtatatatctgttacaactgctcatatcttcattgtataagaaactcgggtatagagtgcttaaataatttatccacaatcacctaccaagtaagctgagaagccatggtacaaacccaggcagtatgatttttatgccagggtactttatcactacactatacctgtcaaaagacagtttaggtcttttattattatttattgtgacttttaaaatattcactggtgatttgctggatgttttgcacaacttcctttttatttttcttttcttttcttttttatttgaaacaggctctcactctgtcaccctgggctagagtgcagtggtgcaatcatggctcactgcagccttgacttcctgggctcaagcaattctcccaaaacaacttcttgaggcagaatttgtccatttatagtgtgtgaaggggcagtataaactttagtgacaaagtacaaagtgtatctttgaagtcatgcttaattctctgtaatcaattatttgaatgccactgatggtgtaatctcaatatcataccaaatacaaagaaaaattcttcctgccc

SEQ ID NO: 2239 - DNA, 1102 bp, Homo sapiens
gtccctatctgtttttctcatctgatcctattccttcttacttcccaaggaccagtctttgaggttagctaagattatagttgggaatatataatcacttaatacttgaaatttagcttttgtagattatgaccgtaagtaaatttgcctttaaggctcacaggttcttggaagagtgcctgtcagaagattgttagttgctgtcattcactttaattgcttgttgtcatttgaattccttaattaggagtagattatggaatttactagtctttttgccttgtcaacgcttagtctactgaatatgtgcaggaaaaacattttggggatttgtggaggggatgacagaaatcttcaaagtgatgaccctgtgcttgcttgaaatgatagttaggagggatggatgtgggggaagagaagctgaaatcctgattcttcaacaattttaaggaaaaaagtgatgaaaactgacattaatatgtcacagtaaagactcatataaggtgtgggaattgagcatgggatggcataattaattttgtgccaaataaacaaaatcagatcctttcttgagaataaatgttcacacagatgtgcctttatagaatatgtacttttaaaaaactccatatatgacatgttgtatgagaaggcctctcttagatcactggtgacctctagtactttggactaaaactaatgaaatattatttaggcagtttatgtatcatttctggagttcttgacttagagctaagggcgtgtgtagatactgatatccagcaagctgagccattttcaactataataacctaatgggtaaagcttctatagtagtctccttcaaacctgtcagtagcaatcactggggttatttgtttacaatgtaggtttttagacctctccccttgagattctggataaggaggtgacatggtggtagcgggtggaagtcctggaaatctatattgtaaaggtcttccaaagtgtttcttaacaggcaagtctgatggatagtgttcctagaggtataatgtttagggattgctaacatcccaggtaggccaatcattaaagagtaggattaactgtagcacactaa

SEQ ID NO: 2240 - DNA, 1056 bp, Homo sapiens
tatttttcccatagattttgggggaacaggtaatctttggttatatgaataagttctttagtgtgatttctgagattttggtgcacccatcatccaagcagtgtacactgtacccaatgtgtagtcttttattccttacccccctctcacgctttcccctgagtccccaaagtccattgtatcactgacaccttttcgtcctcatagcttagctccctcttatgagtgagaacatataatgtttggttttcagttcctgagttacttcacttagaataatggtctccaattccatccaagtcactgcaaatgccattatttcattcctttttatggctgagtagtattccatgttgtgtgtatatatataccacaatttctttatccactcattgattgatgggcatttgggctggttccaaatttttgcaattgcagattgtgctgctgtaaacatgcatgtgcaagtatttttttcgtataatgacttcttaggaatccaattttatttttttattttttggacagagtctcactctgtcacccaggttggagtgcggtgacgcgatcttggctcactgcaacctctgcctcctgggttcaaagtgattctcctgcctcagcctcccgaatagctgggattacaggtgtccgccaccacacccggctaatttttgtatttttagtggagtcggggtttcactgtgttagccaggctggtctagaactcctgacctcaagtgatcttcccaccttggcttcccaaagtgctgggattacaggtgtgagccaccacacgtggccagaatccagttttagatatgttggtttgagatacctgttagatttccaactggaaattttggcagtttggttatacagatctgccaaaatgctgtggagtatttagatgatatttaaagcaatgagactgtatcaaataacagaaagaaaatatagaaaagggaagagggcccaagaagtatctggtgtcctttccagtgtgagtgaaaaaaaaaaatgtatcatgaaagaggtagttgtcaacagtgttaa

SEQ ID NO: 2241 - DNA, 1054 bp, Homo sapiens
gctgttatgaattctagactatcttccaacttggctgtgtgctgttgatggtctcctttaaaaataaattgtttgtttagtatgagatcaaaaattatttatataaaaatatatggaagagtagggcttgatattttttaacagtatggagatctttttagtgatacaaattttgagatttcctataatctctttgaagacacgaatcatgtcttacagtactttgtatatccctatccctaatagtaccttgcatagaataagaacttaatagttgttagttgatggaagaaaagtatcagttgaaaataaaaataaaaatattttctttggatcttatattcataaatggactgaaaatgactgccctgttccaaaaggaggaacagagatcttaaactatacttcttaactggtaatacttgactcatcaccttcttgcctaaatctgaactaaaatactgtatattgtatctactcagaagtttataaactaacctaccaaaaaattgatttgaggacgaggcagagacatttttgaaagactaggtaatttccacctaactgttgatctcctttgggccttaaaggaccttgtggttttgttactagaaaagcagtccgatctggaccccaagaaagggttcttagatctcacgcaagaaagaattcagggcaagtccatacagtaaagtgaaagcaagtttatttagaaagtgaaggaataaaagaatgactccatagacagagcagccccaagggctgctggttttatggttacttcttgattatatgctaaacaaggggtggattattcatgagttttccaggaaagaggtgggcaatttccagaactgagggttcctccccattttagaccatatagggcaacttcctgatgttgccatgacatttgtaaactgtcgtgtcactggtgggagtgtctcttagcatgctgatattttataattagtgtataatgagtcatgaggacgaacagaggtcactctcattgccatcttggttttggtgggttttggctggcttctttatc

SEQ ID NO: 2242 - DNA, 1044 bp, Homo sapiens
aggtcatctcgtacattgttctgactgtgggcagaactgcatacacacacaacccataacattttggtttactgtaaatcattgcatacacacacacacacacacacacacacacatccaaggtctctttaccgttttcataaccttgaacagaaaggaagctttcagtgggaccctctgccatttaggtcttacgacttgaaacatgagccaacacagtctttcacttattttgactgaggggaggatttctggttcaattgctgatctcctcccaactgtactcagaatattattctgggattttacattcttggattgggaaaattcaattagatttattgatggaccctagctttgatttggccctggagatataatatgttcccatctgtcctgttgttgtctgtttaatttggaaagcagctaagttttacattttattcctttggcctgtaaccaaacttccttggtatcccatctgatcaaaaactcctcattgggtttaggctaaaccaagagtcagttgctgggaaagagaaatggaacgggagagaagcaactacagggggagggaagaaactagggggagagatgctgtttcttagacaatgatgtctacttcccggctcaccatctgctcctcatcatgagagaagcagtttcctaggaatttagggagagcattactgaagataatgatgcctttttgataatagagagcaagggccctagtcacttgcagacatttgaaattctatgaaatcttcaacctgcacagagtaactgaatgtcttcttctgtttgcatattagcaagttgcttctccatatatctactgattttatgataggagatttagataatgtgatttttatcagtgaggtagctccatcttacaagtggcaggatcagatagtgctcagatctcctgagtaaggtttgcctgagtcagcagacaaacctttgaccgtgaatctgctgatcacacagcagctgggaggcagcatttttactcccttctgaattcaataatgttcaaca

SEQ ID NO: 2243 - DNA, 1095 bp, Homo sapiens
gcctcagctctctctcagcataatattgacaaacatttggtaaaatgtgttaccagtcgttatcttggcttcagccttcctctgcattggctgagttgccgtttctagcatgatacatgctttattagtgacaggatgtgaagtgtctcagggatttccttttggtgaggaccccagaccacccgaagaagaattagaactttctggactacaggttatatactgtgattttgctctgtcaagcaacataaattgatccttgaacgctgtgagagttatggacacagaccctcacacagttgaaaatctgctatgacttttgactgcccgaaaacttaatagcctactgttgactggaagccttattgataacataaacagttgattaatgtgcattttgtatatgtagtatataccttattataataagctcgagaaaagaaaatgttattaagaaaatcaaagaagagaaaatacatttactgttcattaagtgggtcatcatgttgagcaggctgacgagtaagaagaggaggggtagtcttgctgtctcaggggtggcggggaaggaagaaaatctgcatgcaactggccctgtgcagttgaaggccctgttgttcaagggtcacagatttagcttcacttacccacccctcagatcagaattactcaagatttccctgtcttcaaagagacgcaaggaaattatgccaaatggtgaatatattgggtggaagataaatgagagaaggttgtatgtgtcactgatctcaactatagcatttgctgctgatatagaacatgctgtgtatatatctataaatacacacacatgaacacattgcatgtatataaaaattgttcacacttttagtggtgcttactgggtattggtaaaggattgagtaggcactgtgatgaaacttcacaaagcagatggaaaagatgcattaatagccacagggggcagggtaagggagcaattcaggaaaatggagaggcttagctaaaatttgtcagtcaggaattttggcatttgagacttgttttcatactatgtatatgtaatagacaaacccttcattttgtagtaac

SEQ ID NO: 2244 - DNA, 1050 bp, Homo sapiens
cagtgcaaaggccctgaggcctgcaggcccagtgagcctgctgtgtttgaggagcagcaggggtgtcagtgtggctgcagcagagagagcaagagggagagtggctgaagtgggtgttaaatgggtagtggagcagatcatggagtatcttataggccattgtaaggactccgagtgaagtagggatacaaaggggtatcttgtttttgcttttccttccacttgcaggtggtaggggtctttgtcgttccagtgcctggagagagagggacatgttggattcattcaaagaactttttttcccatcaatccatccccaggcccgctccctgactgagagggaggatatgggttagacagagaaagggagtaacctcgggatgggtcgcaggcaaggccctggggaaggaggagcatgaggaggctggggtgctctttgtgctggaggcagtaggtctggacatgctgtggctgatgctggatgtgagacaggtggtgtgggaatgtggccccactgaggctctggcttgggggctgtgtgcctgcagaaccagtcttcagtatggcatcatgtgtctgaagaggctgaattatgaccggaaggagctggagaagaggcgagaggagagccagcatgagatcaagggtaagctcgtcaggcttggagagggttcgggagcagcctgcttggctggtccctgccttgggccaagtggaggggaggcattctgtgtctcagggaatcttccagtctgaaaaggaagatgcagcctcaccttagggagctcccagtctgatggaggagacatagtccatgccaagttgtctataattcccctccctcaaccccacataccagatagcagccaccaactggacaaatgcagtgaatcctctgggacggtgttatagactggtgtgcctgtggaacttgttgatctggatggggctggatgggagatgcaagtcttagaggagaccttgaaggtggaaagaataagaaggccattccagcttgggtcagggggatgacccgtgcaagggttctgg

SEQ ID NO: 2245 - DNA, 1027 bp, Homo sapiens
gtctttgttccttactcctgggtttcccgagacccatggctctgctctcaggagagatgaggctgcttggctgttccttgttcctcacaggcatgaggggtggggtgaggatgaggcgtggggccaacaggaaagggggaggcctgtgtgtatgagagagccttgaggactccccagcactctagaaagaggctgctgtgtggcctctccagggcccagcactctgctctgcctggtgtggagaaaatactctgcaatagctggagggtttgaatagctttttccacttccctttccaaaatactttcatagcagctctctcaactgctcagccaacagcccaggtgaaaaaggaaaggcaaggattgttatgcctcatttgacagatggggaaactgaggcacagggcagggaagtgacttgctcaaggtcacacatcaaggctttggaagaactgggactggaagcccagtgtcctcagtctacatggagtgctagggctgggggtggcggggaaacaggagtgttggcagaggttctggggaggctgcctggggcaggagactcactgggatatcttggcaatgtcatagctgctgtcaatggtgaccttccccgcagacagtgctgcgctgagcaggagctgctttttccctggctgggcttcctttataaattcggccttcatttcctagatgggagacaggcaggtgagagaaagggtcccaagtggcatgagaggtagactcatcgagggcggactaggtctctgcgcaacccatttgctgtactccccaacctgcctggggcctagtggaagtgataaagtggctcatcagtggtcccatcctcaagtcacccatccttttcctaaaaaactgactaatcttctccccaaacccatgcacacccatcagcactcaattactccctgtcctggagggagcatcggacagtgggtgacccctattggcccacagatgactttgggagacatttgcctttcggtctgtgctttgttctagct

SEQ ID NO: 2246 - DNA, 2049 bp, Homo sapiens
tttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgaggggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaacttgtgtggtgtagagaagttaaaatcctcacgttgtacatttgtgtttccctttcagatccaaatcctttctttgtgtttaatagtatttctcctcacttgcactcagacaatctatagcatgtgggtggtataaaagaaaaatctggttgtatggctgggccatttccaagcatcccctctttcctggaaagtagctccttacttccctccgttttgtttgtttgtttgtttgttttgagacagttttgtcactcaggctggagtgcagtggtgcaatctcagctcattgcaacctctgcctcctgggctcaaataattctcccacctctgcctcttgagtagctgagattgcaggcatgtgccatcaggcccagctgatttttgtattttttgtagg

SEQ ID NO: 2247 - DNA, 1046 bp, Homo sapiens
ctgcacttcagcctggtgacagagcgagactccatctcaaaaaaaataaataaaaataaaaaaagattctgagctatgtactgcctctacacaggatcatcctagaaagtgtggaatattcagaaaagcatgaagagaaaactaaaacgttcacaagtccagacataactgctaacattttggtgtagtctcttttagtcttttatatacgtgggtgagtatatacattttttaaacaaaattgggaacacgttgcataataagattttgatttaatttttttttcctacccaatactagatcatgagcattttcccacatcataaagaattggtcacaagtcagccccaaacatagtccagtggaatccaatgatagcaggcaaccagaggcaaagtatctgtggttttagaagggaaataaagaagctgatgggctgggcacaatggcccatacctgtaatcccagcactttgggaggctgaggcttgaggccagggttttaagaccagtctgggcaacttagtgagactccgtcacttaaaaaaataaaaaataaaaaaattagccaggtgtggtgatgcacacctgtagtcccagctactcaggagactgaggcgggaggatcccttgagtccagggctttgaggctgtagtgagctctgattgcaccactgcgctccagcctcggcaatagagcaagaacttctctctaaaaaaaacagaaaataacaacaacaacaaaaaaaacaaacggctggacacagtggctcatgtctataatcccaacactttgggaggcaaagcgggagaattgcttgatcccaagagttcgagaccagcctgggcaccatagtcagaccccatctctacaaaaagtatgaaaattagctgagcgtggtagtgcatgtctgtggtctcagttactcgggaggctgaggtgggaggcttgcttgagtccaggaggttgaggctgcagagaaccaagatcgtgccactgtactccaccctaggcaacagagggagactctgtcttaaaaaatttaa

SEQ ID NO: 2248 - DNA, 1059 bp, Homo sapiens
ccctgatttatgaatgaggaatttgatctaggaaacaggcccagagagggtcaatgacttgtccaaagccacaagtcaagttagtgcagtgctgagaatagaacctgtgtctttgaaatacgaaaccactgtctgttccctatgctataatgtacaagcaacagagaatgggggggattttagtaagtcttcctggcgatggtggttttaataattggcaacaaaggctacaactgatgccaatctatctctggctagggccctaggactgccctccagcctgggttcatatgacttgtttctctggacaggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaaggtgagactagaacaatcctatctcttcctttaggatagagatgggagagaagggtaccatgtaacctttagtgaaaagataagccattctatcatctataaactttggctggtgcctcacaagagcagaagtccctggtattatggaaggaccatctctgtcagatgcatcaatgttgaaatgacccagcagaatcttaagagaatgacaaaaatggtatcttggatttttttttttttttaagacagagtctcattctgtcacccaggctggaatgcaatgatgcaacctccgcctcccgggttcaagtgattctcgtgcctcagcctcccaagtagctgggattacaggtgtgcaccaccatgcccagttactttttgtatcttttacagagacagggtttcaccatgttggccaggctggtcttgaacttctgacctcaggtgatctgcccgtctcagcctcccgaagtactgaaattacaggcatgaatcactgcacccagtcagtatcttggatttttgtgtgggact

SEQ ID NO: 2249 - DNA, 1124 bp, Homo sapiens
gcctgactccagcgcacatagtcttactaccatgctgcactacatgagagcaagtatcaatgcagcaaactgagagagaaggtaaaataagtcaagaccagaactaacatttaaaatgtttaataactagtacaacaaaaaattagccaggcatggtggtgcacgcctgtagtcccagctatttgggaggctgagatggaaggatcacttgagcaggaaggtccaggctgcagtgagccatgatcatgccactgcgctccagcctgggtgacagagtgagaccctgtgtcaaaaaaataaataactagtgcagctcagatattgattaattagaatggacaccagccataagcaagcagtatatctgtaccaacacattcttactcttagttcagaccacacttaacctccagtgcttctcctctccccactaggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccaggtgagattctatctgcagttggggcaggagatctggaatgataaagggcagaagctgggagccagggttccctacatacctaggaaaaggaatgaaggaattacggggactggagctgtaagttgaacactttgggattcccaatctgctttcttttgcatattgctctagaattggagcccattgtgtcaagagctccagtgcagggcagcatgttgactggaaataaaataatacttctaaaatcctttcatgatctttctaaatacacagaaatttcacagaatgaccaaaagaagtattctcttctagtccctttctatggctcctgtcagcctatatgaaatgtgcatgcacatctagtatagactctccctgtccctgccctttgttctgaagggcttatgataaaaagtgttgtgcaactcaaagaaagagaagtaatgggatttgtacatgtatattacatagtcagccc

SEQ ID NO: 2250 - DNA, 1053 bp, Homo sapiens
ggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaagggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtata

SEQ ID NO: 2251 - DNA, 1104 bp, Homo sapiens
gtaaaagaagtgtgagccggggtaggccagggtcccacttagggacttcaacacttcaacgacacctgcaagccacacatcctatccattgggctgttgccaacaaagacagtggtgctgttgcaaatggattagatgaagctgagactgagagaagtgatctcttgagtgataccttgcatggagaaaagtctacaggcagccaagatttaacagctgaggaccttagtgactctgattcagatgaacctatgttagaggttgaaaacagatctgaaagtcctattcccgttgcagagcaaggcactctgatgcgtgcgcaggagagagaaacaacatgttgtggaaatccagtctcaagtcacataagtcaggcaattatccaaatgattgtggaggatatgcatccttacaactatttctcaaccccagcctttcagaggttcatgcagattgtggcccctgattataggttgccatcagagacttactttttcactaaggctgtacctcagttatatgattgtgtcagagaaaaaattttcttaactttagagaatgttcaaagccaaaagatacacctgactgttgacatatggacccatgacccatccactgactattttattgtgactgtacactgggtttctttggaaactgcgtcttttctcaataatggcaggatccccgattttagaaagtgggcagtgctttgtgttacaggtttggctaaagactgtttgataaccaatattttacaagaattaaatgaccagattggtctgtggctttctccaaatttccttatccctagcttcattgtttctgacaattcctctaatgtggtacatgcaatcaaagatggtggttttacccatgtgccatgcttcctgcattgtttaaatatggtcattcaggactttttctgcgagcacaaaagcattgagaatatgttagtggctgccaggaaaacttgtcatcattttagtcattcggtcaaggcccgtcagatactgcaagagttccaaaatgatcaccaacttccatggaagaatttgaagcaggacgaaactggccattggatttctactttttatatgttaa

SEQ ID NO: 2252 - DNA, 1211 bp, Homo sapiens
aaaacccagtagacatttcccaaagattgtttctgtaattttaggtaatctttttaaaaacatacttaatgacccattatactgtattaactgtgcggttgttttggccactgaattcttaatgaaaactaagcagtcggtatttttatgtgttaggaatcattggtgaaatgagtgaattgatctcattttaagatccctttctactctgaaagtatgtttctgagattgagtaggaggccagaaaatgatgacttttagtaaaagtctattaaaagtttcagactgaataactaatgtgagatcccaatttttcctttttttcattttagatttggggatattccctgcccaaaaaattcctggaaaattgactagtattaagtgtgagtaaaaggtgtccacttttttttaagttttgattttagttttgtcttggatagtatttggcaagatttagcctagaaattatgtagtatttattacataagaatcaaaattgctttgttactgggctggtttcaaagtttagaactcatttctatgtatcaaaatcgggttttttttggttttgattttttttttttttaaattcttaaatggtaaatatgccattgtgaaatgaaatctcaactccaaaagtttacccttttactaactggagtaaatgtatacttacaaagtctttagctgtagccattagtagtaaagaatttggacctaggctgcgtaagcaagcctttccagggccactatttaatggcaaaccagtgatactggtgttgatacaaaataagaaataaattttcccttagataaagctttctgtgttttgacagtgccagtttagaatggctataatgctgctctgccttctacagcttgctgcaccactctgtagttactctattaccatacgtttctatcttttttggttaaacactccctgatgacgatgatggatatatatacatacatccatattatacataatgatatatgtgtaaggatttaccttcgtctttattttgtgggctgggcaaaatttagtgtaacaataacttcatgatactttggtataagagtaagttctttatttttataatgaacccaaatctaaagtcttttatagtgcattttaaaaggggaaacttatccaaatgttatatttctatacatttttgtgtatatgtgtgtgtgtataagccagt

SEQ ID NO: 2253 - DNA, 1054 bp, Homo sapiens
gcattattttttggggagaagtaatttctttaatcctctatttattcattatccaggtcttctgtgccttagtagtttcatagtgttttggttttgtttttaatttaatgtgggtcttgcatacttcttcattttcttcctgtatatgtgtttttttttttttttttgagacagagtctcgctctgtcgcccaggctggagtgcagtggcgtgatctcgattcactgcaaactccgcctcccgggttcacgccattctcctgcctcagcctcccgagtagctgggactacaggcacccgccacctcgcctggctaacttttttgtatttttagtagagacggggtttcaccgtgttagacaggatggtctccatctcctgacctcgtgatccgcccgcctcggcctcccaaagtgctaggattacaagcatgagccaccacgcccggcccttcctgtatatctttttattgtgaatggtctcttcctgtatatctttttactgtgagtggtactctgccatcatctgaatgattattgctggtatgaaggaaatttactgcttcttgtagatcttacatttttattattttcaatttgttttagttgatagattttctagtttgcaagcatgtaatctgcaggttctggatttttttcttttttgcctcatctttttttttttttttgatatggagtattgctctcgttgcctaggctggagtgcaatggtgctgtcttggctcattgcaacctctgccttccaggttcaagtgattcttctgtctcagcctcccaagtagctgagattacaggcgcatgccaccatgcccggctgatttttgtatttttagtagagatggggtttcatcatattggccaggctggtctcaaactcctgacctcaggtgatctgcccaactcggcctcctaaagtgctgggattacaggcgtgagctattgtgcccggcctgtctcgtctttttaatatatgtttgtaatttatgcctttttttccttttgaaaaaattgagtaaataaatgtcctattcatca

SEQ ID NO: 2254 - DNA, 1059 bp, Homo sapiens
ttgtgttttttagtagacacgaggtttcgcgatgttggccaggctggtctcgaattgttggcctcaagttattcacctgcctcagcctcccagagtgctgagattacaggtgtgagccacgcccggcgaatggtatttttgttgcatatcatcccgtggcacacagttttaattttctcattactggtgatgttaactttgatcactcaattaagatggtatctgccagattgcttcattataaaggctttctttttgtaattaataaatattttgtggagaggtacttttagaccctttaccccgtttctcatcagacttcaactttttccccgttattgatgtgaattaatgcaaacttgtggtgatacgtttggctctgtatcctcacctgaatctcacctctatcgtaatccccatgtgttaagggagggacctgatgggaggtgattggatcatgggggcggtttcccccacgctattctcatgatagtgagtgcgttctcgtgagatctgatggtttaaaagtgtgggactccctttgctcgcgctctcttgctgccatgtaagacttgtttgtgtcttgcgtcctgttcacctcctgccataattataagtttcctgaagcctccccagccatgcagaactgtgagttagttaaaccttttttttttaaataaatttcccagtctcagatagttctttatagcaatgtgaaaatggactaatacatgtggttttctattttaatcagtgtgtcgtactctgttactatcattacttttatgctccgattgacccagatttggcaagtaggagcctttcaaactgatttttgtgttcttttgatgtttccatcattctttgagcatctctgctttttggcctgacaagattttccaggctcatcctgtacttttcctacttcagccctgtattcggccatttatccaaggtgccctggtttcttttagtgaataatggtatatagaagttaagatttgggctgctcctagagtgtcatcactttcaggtcctctcagtggacagagctgagga

SEQ ID NO: 2255 - DNA, 1042 bp, Homo sapiens
gggaaaatcagccaacaggatgtcaaaaattaaactgcgctttccatcacaatagaggacgatatgttgatggccttttcctacctccgagcaaaagtgagatcagtttttaattttaaaagaatatcaaatgaacacctattatgcacactgtacaacagtacttttcagacattgactcctttcagtcttgtgaaacagcagaattatttccactttacagataagtgaactgaatcttattaaggttaaatgatttatccttggccttagaaccattatatatcttggcatgccatttaagttattatacttacttcatttctcatattcttatcagacccataaacgttttcaaaataaatttgattttctaggtcaaaggttggcaaaactggtcctctgcctgttttgtaaaataagttttattggaatatagccttgcccattcatttacatattttctattatcagttttgtgctagtgctatagaattgagtagttgagacagaaaccatatggcccacaaagcctaaattattaactggctctttacagaaaatatttgccaaccctactctagactataatctaaaataaaactaaaaagctagtggttattcccaaagttcattttaaagtaatttaaaagtggaattggccatttaaaagccacagttgctacgtgattaaaatttgatggctacatctttttacctcaatttaagggaaaaaagtagacttattcctttctggtttggttcaagtaagtgtcatatgcttgggtcttagaagctacttctttgctgagcaaaaagcctagaattgcagtattaaaattaaaggtctagaatttgtgaacaggtactatgcttcttctagtcttctgttgattctgttttgagtgcccactttgtgtttatgtacagtggagagttagtggagagttaattaggtaaaagcacatcttttccctccctgggactttagaacttaaatgaggaaatttagtataaatgctcataagacaaatacactata

SEQ ID NO: 2256 - DNA, 1893 bp, Homo sapiens
tgattgtaccactacactccagcctgggtgacaaagggagactctgcctcaaaaaaaaaaaaaaaaaaaaaaaaaaagcttgatcccaaatcagtaaaagaattatttctttatgtatgttcttaaaaacaaatttttgctcactttgtgtccgtgagactaggtgattcagccaactatttttaaaacggcagttttctaataatcttttttttcttacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaatatgggagatttcaggaggcaaattggaagctgagattgacctggatcctgggaaagatgaagatgaccttctgcttgagctatcagaaatgattgatagctgaaggtggtagtgaggacactttaaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaagagactgagagggagatcaagtgaaagggtgcaagcgaacttagtgactccttgaggtgtttgtcagttttggcttttttcttctttgttgtattctttatgtattgtcttgatgtacttaatattacctgagtttgaaatggatgaagacagctgctaccattaaggaccaaattttatgctaccactaaacaaaaatacccactcagtctgtgttaaattgtatgtctttttaaaggtatttaaagattcaactaagctttaaagagggctgagcagctcaggaagcctgtaatgtgggcataactctttggacctgatcttgatgcttctgctgctctgttagcctctgaagagcaatatctaatttattattactgtaattttttaaaaggctttaaagtgcctcaggggtcccctgaaactaattttctatttctgggattccctggattcattatatgagatggtgacatgattagaggaattcttttttagtatgaaaattgtcctttttcttcttcagtacttgcctccttgctggcattgaattaacacagggacaaaatttggttaattttttatttctaactctcccaacaaacccctgttgcccagtatttgtttggtggcctttaaccacctgagggaaaaaatgagcttattcaagctgccaatatttatctatgggctgtagcagtacactgaattgtactgtgccagggatattgagatgctctgggggtgtattgtatacctgccagttttcttcatttctgaattgagttttcttttcttgatgttggtttccttcatatcacctcaaggtttagatttgtgaaggaataagcatgatggaaataatagtcttgaaaggagatatgttgtatataatcaggaggaagaggaaggaaggacttacccattttgatattttgctgtaggtggccagttttgtttctcatagggaaatctgacccacctgtcatgttggctcctaaggaactgctgttgtaagcggctcatcaagagttgaacttcacgtagccttgttgggaatatggaaaaggaagaaagccacaggactgcccattcagtcttgggaagattgggatgattctgcacaagcaaaaatgactgaagtttat

SEQ ID NO: 2257 - DNA, 1033 bp, Homo sapiens
ttgttttttttaatggcagaggtagttgaggctttattttggaaaaaacaaaaaacaaattgttttatagctggagtcatgggccaggggggtaccccaggcaataaactccctccatgagtgggctgagagctaggactgagcctctcttaggtgaggctatgttcacttctgttccctatgctcccctgcacagtggcctcttccacaggctctggggcatccacaggaagggatgggctgggaggggctgccatggccatttacttgggcaggacatcagaggacttggacaccagcttcccatctcgcgtctctattttctttacaactacggcacctggaggaaccctggagaagctggtgcggctgaaggagctagagcccctgccagagccaaagctggagcctagccatagatgaggccagggcttgtgaggccccataggccaagctcagtgcacctgagcagccattggtggtctttatatatatacttatgttcggcatcccagactccagcctgttcttgttgccctccagcagcttcatgtaggtggcaacctctgtgtccagggccagcttgacattcctcagctcctagtatgcctgcttgggggtggtgtcttttaaaaaaaaaaattatttttaaatttttatttatttttttgagactgggttataagactagctaatttttgtatttttgttagaggactttgctgtgttgcccaggctggtctcgaactcctggcctcaaacaatccatctgcctcggcctcccaaggtactgggattaacagaggtgagccactgcagccagccgcattgctgtccttaatggcggctcccacgctgcttggcattcgtgatggcagcctccagggaagtcttctggcctttgaggctctcagtctcagcctggagccagctgatgttctggttcatttcagagatttttgtctttgtgcgacacatcatcttcatgcttcccagccagtgtctgcagttcctcgtacttgatctggtgtgt

SEQ ID NO: 2258 - DNA, 1069 bp, Homo sapiens
aaaaacagtgagggcttgcgtatctttttgggtgcttatacctagccacttaatttctatgggttattaatatttattacttcactcaacaaatatgtaagagcctacatatgttaggtagcctatgaggcactgagaatatggtaatgagcgacacacagtctgattttatggagtatacagagtagtgagtcagtagatgctcttgcccatcttagtcaaataatcacactaattcatggtaaacctacactatggcaagtgctacagaaaagagatacatgaagcagggagtgggtgggatttagagtgttagaggtcaagaaaatgttcttttgaggaagtgaaatttcagccaaaagctgaaagatagataattaagtagtcaatcagagagtttgaggttgattgaacaccatgtgtaaaggcctgggtaggaggaagcttgatgtgactaggttagaattttgtgaaataattgttggagagggaggaagagtgagcagatgagagaaatgtagaattgctgggcagttagaggttgatgatgagcctggtaagaatcacagtagggctaacctgacctgttacttttctccagctgcatggggtgtaagttattagcttatatagtcaaaagctaattagtaatttagaagctctctttctctatagctttgatgactgctgcttctgagctcattctgtcttacactaagacttcccttagctgggtgtggtggctcaagcctgtaattccagcactttgggaggctgaggtgggtggatcacctgacttcaggagttcaagaccagcctggccaacataagtgaaacgccgtctctactaaaaatacaaaaaattagctgggcgtggtggcgggcgcctataatcctagctagtagggaggctgaggcaggagaattgcctgagtccgggaggcagagattgcagtgagctgagattgtgccatggcactccagcctgggcaataatagcaaaactccgtctccaaaaaaaaaagactcccctccacccccactttccaattacaatgtgaaacttcag

SEQ ID NO: 2259 - DNA, 1027 bp, Homo sapiens
aacatgtaattccataatcctatttcatagccagtttatgtatcatttcccccagttatctcaaaaataccttgtatttttgtcttacttgaattaggatccaaagtccacacattgcctttggttgatatgtctcataagtgtctttaatctataaaacttaactttccttttgttttcatgtcatttacgtgttgaagaaatgggtcatttgttctgtagaatttcccacgctctagagttggcagattgtatccttgtgattttgtttaatgtgtttctttaccctctctatttttggtaaactggtagtgcttgaataaattcaagtttaaattttttgccaagaaagctttataggtaatgctttgtacttctgtttaatcacatcagagtcatgtaaggtctgcctgtctattttagtcagtcatgttaataatctgtgggctcaggtggtatcagtctgatccatctgttacacaggtcactcaagaaccttttacctaatggctttagccatctcttatctgaatgccaatttgtctaaccctttgcttgattctagaccttctaaatactgctctttaactattaggtatgtataggaaactggctgtactggagtctggagtctccaaaatggtggtctgtaagagataggtaaataaactggacagactgaacatagccatttccaaataatgaaactttttccctctccactactacataaagcccttttgtgagcttcatattaacattgccctttgaagaaagcccaagttagtaatctttttagattgaccatctttttttcttctcaggttgcccaggctggagtgcagtggcactatctcagctcactgcagcctggacctctcgggctcaggtgattctcccacctcagcctcccgagtagctgggattataggcacatgccaccatgcctggctaattttttgtatttttagtagagacagggttttgctgtgttgctcaggctgatcttgagctcctggactcaagc

SEQ ID NO: 2260 - DNA, 1080 bp, Homo sapiens
aatttaacatgccatataaagaatattttgttggttttgttttgttttgtttgagacaggatctctctgttgctcaggctagagtgcagtggcaagatctcggctcactgcaacctccgcctccgtggcacaagcagtcctcccacctcagcctcctcagtagctgggactacaggagtatgccaccacacctggctagttttttgtatatttttttgtaggtacaggttttctgcttgttgcttaggctggtcttgaactccaggactcaagcgatcccccttcttcggcctcccaaagtgttgggatgacaggcgtgagccaccatgcgtggcccatttttattttttaacttgtcgttttgaaaaaatttcagacttaataaagttgcaaaagtattgcatagagtttctctataccctttatccagagtccccaaatggtaacatcttacataataatagtatgatgatcaaaaccagaaaattgccccaagtaattctgattggttatctgttctgacttgcaattgcattggtgcttgtggatggccatctctgttgatttttgtgatttgggttgcttgtgttttatttgaaaggacaaatgagagaagtgcttttcatataattttatacctttgcaaatgggttaaacttttcattttggtcaagaagatgccattgtttaaaatggtagttcttttttttttttttttttgagatggagtctcgctctgtcgcctaggctggagtgcagtggcatgattttggctcactgcagcctccacctcccgggttcacgcagttctcctgcctcagcctcctgagtagctgggactacaggcgcccgccatcatgcctggctaattttttatatttttagtagagacggggtttcaccgtgttagccaggatggtctcgatctcctgacctcgtgatctgcccgccttggcctcctaaagtactgggattacaggcgtgagccactgcacccagcctaaaatggtagttctttctaaattgtctctccaaattttcccatgtatacaaatgaaataaatatgactaactttgtgt

SEQ ID NO: 2261 - DNA, 1364 bp, Homo sapiens
cttgtaactgttttaacctaagtaaggtagtaaggctttggaaatataaatgacagtaataggattgctttattaaagaattgctcctggcctgtgcggtggctcatgcctgtaatcccagcactttgggaggccgaggcgggtggatcacaaagtcaggagtttgagaccagcctggccaagatgataaaatcctgtctctactaaaaatacaaaaattagtcaggcgtgcgcctataatcctagctacttgggaggctgaggcaggagaatcacttgagccagggaggtagaggttttagtgagccgagattgcgccactgctctccagccagggtgacagagcaagactccgtctcaaacaaacaaaaaaattgctccatctgcattatatgttagtccaacttcgctttgaagaccactgtggtcagaaaatgctgtctctcaaactttttgttgtctccgtttgtccacaaaaatgtttctggaaataatgttttttataattagaattttgaaaatgtttgcttttttcaatagaaccgcattgacagatcagttgtaggatctgtatccttcctctagcagcctttatcagatggtgatgatattttccatattttatctctgaacctggtagtggttggtgaacctgacccacagtagacttattttgggtctatctcattcacatagcctcaaataatgaatagtccagattattaaattgtttgcagcttgatcttttcgtgtagccaagtttttgtcttttgttctacttgaaaaatttctttgtaagtccttggaatgcatttctcttttagattaatgtaatatctaagaatttctctgtactgtgttgttttccttggttctttttattggccttgagaaaaactttatttgctgctgcttcttaggaaatgtttatagtaactgggaaaaataagacaatgaaaaaaattaatttatatacaggtgatggtaatgggaatttaaaccataaaattatccttgacacttagaatgtcgctttagatgaagatgctattgttttatgaagcaaacggggaaaaatccagatttcaagatcccataaccctgtatgacttaacacttgaaagttgaaattaaatgtaaaaagccatacactcttttccttttgtttgtgagttaggcgaatttggtaatatataggaagagatgacaaaaatagactccattatgtcctgcttggaaccagttttcatataaaaatttaaaagcttgatatggaagaacatttttagctatttttcactgttttttttcccgattatattttggtaatatattttggatatggcctgtcttggtctttgtca

SEQ ID NO: 2262 - DNA, 1042 bp, Homo sapiens
ttagagtgtcacctgtagaagggaatttagggaatagattctatttacttgagcaactacaagtccttaccttttaaactcttcagtactgtttcttaggtgttatacctgatttagtgttaaaagagaaaagtccatgcctgacaccattatatccatccattagtttatccacagtaggtgtcaagtagatatatgttgaatgaatacatgtccactgaataaaggcaagatgttctttggcgatgtagtgtgacgacattgagttttgggttcatttgtgttgtttcaacatctctgataaacctctgaatacagaaactcatgtttgttttttttctgttaggatgtgggtactgccattgtttcagatactacagatgacttgtggtttttgaatgagtcagtatcagagcagttaggtgttggaataaaagttgaagctgctgatactgaacaaacaagtgaagaagtagggaaagtaagtgacaaaaaggtatgttgtggaaaaattccatgttgattctgtttgtgtgctcatagtatcatctgttgagatttctttgtatctgtttttacaacagattgctcacataatcccctttttaactttaattaatttttcaatccaattttaagattcacattaagtaatgttaaccagggctgccttaaaagcccctacttagtcaaaagcagtaagctactcttttttcccctgattatagcaacaagctaccttttctctccctttgctaacaaggtaaggtgctaatcaagcttgtccaacccacagcctgtggaccacatgcggcccagaacaactttgaatcaacacaaattcataaacttttaaaaaacattatgagttttcttgcgattttttttctccttttagctcatcagttatcattagtgttagtgtattttatgtgtggcccaagacaattcttccagtgtgacccagggaagccaaaaggttggacacccctgttgtaaatgaacagcagtctgtaggagaaaacttatttcttggaaatct

SEQ ID NO: 2263 - DNA, 1091 bp, Homo sapiens
tttttttttttttttttttttttttttttggaggatagggagtatggctgttgtgaaaagggaggtaaagagaaatggtagatctgaagaggcctcatcagagcacatattttaggacaacacatatggaaattggacatctttaagttggtttccatagagctatgcatgtatccttacccccatgggaaaatgttggtgtgttctcaagggtatgcatgtgtcattttgaagaccaaggccctagaattgtcaaacttaaggatcataaaaatcatgagggttgcttgttaaaaatgtccaaacgtgcagagactgatctttgagatctggaccaggaatttgcatttgaacaagtgttcctggaatctctatgcaagttttatacagaacatacttttggaatccttgccctagacaggggtgtccaatcttttggcttccctggtccacaatggaagaagaattgtcttggaccacacataaaatacactaacactaacaatagctgatgagctaaaaaaaaaaaaaaaaaaaatcgtggaccgggcgtagtggctcacgcctgtaatcccaacactttgggagatcacctaggtcgggagtttgagaccagcctgaccgacatggagaaaccccatttttactaaaaatacaaaaaattagctgggcatggtggtgcatgcctgtagtcccagctactcaggaggctgaggcaggagaatcgcttgaacctgagagggggagattgcggtgagctgagattgcgccattgcaccccagcctgggcaacaatagcgaaactgtctcagaaaaaagaaaaaaaaaatcgcaaaaagaaaaatctcataatgtcgttgttggtttttttttttttttttgagacagtctcactctgttgcccaggctggagtgcaatggcatgatctctgctcaccgcaacctctgcctcccgggttcaggtgattctcctgcctcagcctcccagatagctgggactacaggcacataccaccatgcctggctaatttttgtatttttagtagagatgggggtttcactgtgttggccaggctggtctcgaactcctg

SEQ ID NO: 2264 - DNA, 1034 bp, Homo sapiens
ttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaa

SEQ ID NO: 2265 - DNA, 1260 bp, Homo sapiens
gcttgagcctgggaggtggaggttgcagtgagctgagatggcaccactgcaatccaaggtgggtgacagagacgctgtctcaaagaaattgaggtcaggcttccttcttacagaattatttttttctctgtagtttgcctcattttttcactttcttttcaatgagaatcgaagtgtttcttttgggtttttttttcccccttttaaaatcaacaggaaatgtttcaaaggagggatgaaatgcttcttggcttcctcagcacttggcaaggtagacctcatagcaaccttgaatatgactttctttagtctctagctatgcactattaagtgcctcttgggtagaggtagagttaagtattgagtgccagtcttgacgtccgtatgcctcagtttttctcatatataaaaagcagtatacatacctacccttttctacctcatcatttgttgtagggattaaatccgggagagcaattctgaagcctataaatttccttgaagagatctaagaacctattatgctcttggtgtaccaagctctggggtatatattcagaatacctcatgttctggaagctgagcactagctcccctttattgcctgcctggcagagcctgtttgattactgcaggcccttttacccatgcttctagtttaggtattctttctttgatatgaggctcttgaccagaaaagagttctttctctaggtgttctgagagaagtttgtaaatttggatagtacattctatcctgataaaaccaccttgctgtggtcttgatgtacaaaaaaaaattttttttttgagacagagtcttactctgtcacccaggctggaatgcagtggcgcaatcttggttcactgcaacccccgcctcctgggttcaagcgatcctcctgcctcaacctctcaagtagctgggactacaggcgtgcaccaccacacctggctaattttgtatttttagtagagacagggtttcaccatgttggccaggctggtcttgaactcctgacctcaggcgatctgcccgccttggcctcccaaagtactgggattacaggcgtgagcaactgctcctggcccaaaacatctctttctacatacacttgagtaggtggcataaaatgcactgtcaatatatagaaaacatgaaattttccaaatatttccgatcagagaatcacaagagcagcaaatgtggtttcatcaagtgggaagaaagcagcaatttaaaataactttttgggagac

SEQ ID NO: 2266 - DNA, 1029 bp, Homo sapiens
gaggtccctattaggcagagatcgaagatagcagtgaggaaggggaattctcactggggtgaggtcagtgagtaggtgaaagggtgtgagatccagaagtcagcatcgtccttggtcacaaagagtcacctctgggaggcagaaatgaattcttactttgtttttattttctatgggggaagaaaccaaaggtgcaagtgtttattgagagcaggaggggaggtgggaagggctggcttgaggagggcagtaaagctttggcttggggcagagcaaggctctgagcaggaactcacgggtgacctgtctggtgttgtagaggctggtaatttgtgctggcagcaccctagtggttgcgatttgttttctctctagtggtcctagccagagggtaggaacagagctgaacgattatcaggctaatccagggttgggggttgctgggagggcatgtaagggtgacaaaggagttgggggtttgtttgggtcagagaatgctcaaaaggttggaccttgaaacctcggctagcagagaaggaggtggggataggagaaggctgatgaatgtggagaaaaggagatgggggtactgagggaatgagggagcaggtacattaagaataaagaggagtgagagagacaggagagggcattggagtttacaatttggggggtgggatagggaagacaaaggtcagagtatactcatagagcatgacagacaaggaatgaatggaaagataatttgcagtggcaagagctgagaggctaggttgtgggatgggctgtccacatgacatggagatgcccccttggacagtggtcaggaaggagggcagcaggtctctttgatgactggagggtgggggagaagagtgcaatggcagggacctcgaaggccaggctgaagcaacactgagtacagtagaatgctggtcccgtctccagagggcacaaaatgagggaggaagaggaagaaaaaatcactgcgattaatgagggctccggggcaagtggagctgcagtaag

SEQ ID NO: 2267 - DNA, 1061 bp, Homo sapiens
gcctggcatataataaataatgtataagtattaaaaagaaagtagaaaaaggaacaaaagaacagaaggaaagaaggacctcttagctatactttctttcttactgtcctaagtcaaagcccacaattccactcctaatttacaaggccccaactggacttcttttcttttcttttcttttctttagccagagtttcactcttgttgcccaggctggagtgcaatggcgcaatctcggcccatcgcaacctccgcctcccgggtaaaagcgattctcctgcctcagcctcctgagtagctgggattacaggcattcgccaccacgcctggctaattttgtatgtttagtagagatggggtttttccatgttggtcaggctggtcttcagctcccgacctcaggtgatcctctgccttggcctcccaaagtgccaggattacaggcatgagccactgtgcctggccaactcctttcatttcatgaaggtttcaggctctcatttgccttatagtctttgtctactgtattccctgtctggcacaattctctcccttgtcccccaactctttgcctagctaactcactgtttttttgtttgtttgttttgtttttaaatttaagagtttttttgaggtataatatgcaataaacagcacagatttaaggtgtacaatttgatgttttgacatgtgtatacatcagtaaaacatcactacaatcaagataaagagtatatccatgacccctgtgtttcttcctgcttcttttaatctttctctctcaacccatgcgttgggccacctgccgtctgtcactacagatgtttttcatttctagaatttcatatgaatggaatcatgtagtatatatcttttttgtctgatttctctcattcagcatacttattctgagatttatccatgttatgtgtatcaacaggttgttcctttctgctgttgagtagtgttccatcatatggatgcacctgtttgtttattcattcacctgttgatggacatttcagttgtttccagtttggggctattacaaataaggctgc

SEQ ID NO: 2268 - DNA, 1066 bp, Homo sapiens
atctcctgctctgaaatccattcaataatttgtcctccgggagaattatcttttttcttgagataggttctcactctgtagcccaggctagactgcagtggtacaatcacagctcactgcagcctcaaccttctgggtttcagtgatcctcccacctcagctcctgagttgctgggaccccaggtgtgtggctaagttttttatttttaaatttttttttgaagagatggagtctcattatgttgcccaggctggtctcaaacttctgggctcaagtgagcctcctgcctcagcctcccaaagtattgggattataggtgtgagtcaccacacttggccaagaactatctttccaattgtctttctcttaggacagaatgcctagctagactatctctaagccagtctcctactgtcccacttactagggctaagagagggtagggaaggcaactgcccagggtgcctacccagttttctgtggcacctagaaactttactatcagacctcacatccaccaacctgcctccccacagtgaaacaaaacagagcaaaacaaaacaaacaacaaccaaactacatatgtaatctcaaagatgaaaggaaacagagtacctacccatctcccatttaaaaaacaaaaacatgaaagctgttcttaagctcctattcaaatattttcactctgtctacagaggatttaggatggggaaatcaagtctggacgtgataagtagcagagaggtaaatggaaatcatcctcccaaaccccaggattgaaaatgtgctgaagaacccacaaaaatagtaattcacacagagcagttaaaattggtgctcacatcttggatttccatagtgctttcttctgagaagtcaaaacacgcatccacctttgacctcatatgtgtctgcatttcagaaaatgctgaggagtctccccattttgtaagtggagaaaacggggtccagaggataagccctctcccaaagagaggaagagctgggattagcacccaagggtaccgattccaccaggttctccccaatcacccaattatctcc

SEQ ID NO: 2269 - DNA, 1043 bp, Homo sapiens
tggacctagggattccaggggtttcatcagagagaccggaaggaaggtcactgtggcaagggagtagagaggagggaagagtgccaggacctggggagatgaaagccccagctgggtggaaaacagcccttggaaagggcatggagttggaatgaggctggaaaaaaactagtggaaagaagctcaatgaggggaattcagtgatttcctggccccatgagaccccagggagaggacaaaggttggcacctgatgaaaggcaggagaacccagggctcacattggtcctaactaccccccactcccccaaccccctcaatgctgggtggctctgggcaggatgtcaaccttctccccgctctacaatgaggagtgtgcctctctccttgcatgaggacaattaaagtcctctctggggaagaacttaggagaaaggaccatagaagtccaagtgccactgacccttgatgatctgtggcacagaactgcccctaaccctggtatattctggaatgtattactcatctgatagtcactgggttgtctttttggatcttttttttgtttttgaagcattgggtttaccttttgaattccttttagctcagcctgatgtttaaataagctggcatttactgtggatgtcagacattctgtgtaacttctactcacccttcagctttcagcttaaacattactgccttaggaagccctgcctgattcccagatggggtctggttccttgttatattctctaacaagcaccaggttcctcttcattatagcactcatcgtggtttgcaattatacattcatttttaaactgatgtttgtagcagaccattgcaaggctctggcctcaactcttttctctcctagctctctgcaccttcttcccatgggcttttattgaatctagaggttcccatgatgttaatgacactccagcctatatctctagttcatatctctctccagacctgaggtatttataattgcctatttcatatgttataagcttctcaaacttccaaattatgata

SEQ ID NO: 2270 - DNA, 1126 bp, Homo sapiens
tttaaatatgcttatttgccattcatgtttctctggtaaaatgactgttcatatctattgcccatttttgtttagagctgtcttcttattgaattttaagggtttctatatattgtggagtctaaaattttgtcagttttatttaaattataaatatttctcttcatttgtgtcttgtgtttttatttttttaatggccttttgatgggttgaagtcttaataatatagttgaatttattattatattcttttataattagtgatgttttcttgcttaaaaaatcttaacaaatctagtccaaggtcataaatatatatatatatatgaatttttagtaaaaaatagcttaatctctaccaaactttaaaaatttttaaaaagatactttttattttatgtatttattatttttaaatttattattatttttgtagagatagggtctcactattttgcccaggctgctcttgaactcctggactcaagctttttcccttatcttcgaattagagaaaacaatagtgcctacctcatattagtgttttgccctctgcaatacgataatgaaggcaaaagaactttttgtgcacagaggactgtagaaaaaaaaatgattaattcatgttcagtctttcatctctgaccatttgactctgacaggtgccatccagattccaacagtgacttttagctctgagaagtccaatactacagccctggctgagttcggaaaatacattcataaaggtcagctgcaaatcaggggcaaggggtgggtggtagaaatagcaatggagacacagttcttttacaaagtgataaagaagtttattttgtgactgatcagaggacaatctaattcccatgggcagagtagagactgtagatttgctcttggaaaaactaagccaccatatgtagggcaacgattgagagttcatccagccattgcattagagtataaactctctcaaactttgccctacatatgtgtcattcaataaatgttaaatcatcaaaaagtagaactaggatttccttctacttgtgcaactgcccagaactatgttccatgctcctcccacccctacctccttacacacccaaacacaccggtacatata

SEQ ID NO: 2271 - DNA, 1097 bp, Homo sapiens
ataacacatacactagatgtgtggctttttaaaaagaaaaatgtctctgaactttttaatataatatttaaatataatttggttaatgaggcctactaatttaatataataatttaatataatttggttaatgaggcctcctatggtcaaaatttaatgcatccctcatctgcatagccctttaacacatacttgtgatagcatgttataggtctgaccaagcctgagcttgagatattgaccatcttagtagtgagtcttttttttttgagattgagttttgctcttttcacccacgctggagtgcaatgaacttaaactataccctagaacaaatggacttaactgatatttacagactattctacctaacaattcagaatatacatttttttcatcagcacatggaacattctccaagatagaccatttgatcggccacaaaacaaatctcaataaatttaagaaaatcaaaattatatcaagtactctctcagactacagtggaataaaattggaaattaactctaaaaggaaccctcaagactatacaaatatgtggaaattaaataatctgctcctgaatgatctttggatcaacaatgaaataaaaatggaaattaaaaaattctttgaactgaatgataatagtgacagaacatgttaaaacctctgggatacagcaaaagtggtgctaagacgacatttcatagcattaaatgcctacatcaaaaagtctgaaagaacacaaatagagaacctaagatcacacctcaaggaactagagaaacaagaacaaaccaaacccaaaaccagcagaagaaaataaataacaaaagtcagagcagaactaaatgaaattgaaacaaacaaacaaaaaacaatacaaaagataaatgaagcaaaaagatggttctttgaaaagataaaaaaaattgatagaccattagtgagattaaccaagaacagagagaagatccaaataagctcaattagaaatgaaacagaagatattacaactgataccatagaaatacaaaagatcatttaaggctactatgaacacctttatgcacacaaactagaaaatctagagg

SEQ ID NO: 2272 - DNA, 1786 bp, Homo sapiens
aagaagaattggtaccaatcttactgaaattattccataagatagagaaagagggaatcctccctaagtcattctatgaagccagtatcaccctaatagcaaaacaagaaaaggacataataaaacaagaaaactacagaccaatatccctggtgaacatagatgtgaaaatcctcaacaaaatactagctaactgaacccaacagcatatcaaaaagataatacaccatgatcaagtggatttcatgccaggaatgcatggatggtttaacatacacaagtcaataaatgtaatacatcacataagcagaattaagaacagaaattatatgatcatctcaatggatgcagaaaaagcatttgccaaaatccagcatcactttatgatgaaagccaccagcaaagtcagcatagaagggacataactcaaagtaataaaagccatctatgacaaacacacagctgacattatagtgaatggagaaaagttgaaagcattccctctgagaactggaacaagaaaaggattcttactttcaccactgctactcaatattgtactggaagtcctagccagagaaatcggacaagagaaagaaataaaggacatccaaattgcaaaagagaaagtcaaactgtcactattcactgatataatgacatgatatgatgacataattgtatacctagaagaccctaaagacccatccagaaagctcctagatgtggtaaatgaattcagtaaagtttcaggatacaaaaacaatgtacacaaatcaggagtacggctatacaacaccaacaaccaaactaataatcaaatcaagaactcaaccccttttacaacagctgcaacaaaattaaatacttaggaatatacctaaccaaggaggtggaagatctctacaaggaaaactacaaaaaactgctgaaagaaatcatagatgatacaaacaaatggaaacatatcctatgctcacaaatgggtagaaacaatattgtgaaaatgagcatactaccaaaagcaatctacaaattcaatgcaattcccatcaaaataccatcatcattcttcacagaactaaaacaaatattaaaattcatatggaaccaaaaatgagcctgcatagccaaagcaagactaaacaaaaagaagaaatctggaggcatcacattaccagacttcaaactatacaacaatgctggtagaagaggtgaggcaggactagcttgtctgtcataatgtaaaagagtcttggaagatgtctggggtccagggtctaaaacccttcgtggcctttggaacaccaagctctatgccaaagggtggaaggctgccctgacatgccaaaatctaagcccagggcataaaaccccttgtggcttgtatggaatccggggctcagggcataaacccccttgtagcctctggaatgtgcacagacttgttggttccttgcttcttacttgtaaacatgtcctccattatctcaagcagcagagcatattctatatgcatcaaagaaaatgctaaaccatcacagctacgcttaatgcaccactacctttctacccccacgtcctcatgccctcacctctttacccccacatctgcacgtcctcaccatctgcttctttgtttggtctccaataaatagtgtgggctcccagagctcagggccttcgcagcctccaatctagtgttggccccctggacccaatttatgcacttttaacttgtcttttctcatttctttcaccccaccggactttgtagcctgatggc

SEQ ID NO: 2273 - DNA, 1051 bp, Homo sapiens
gctgcccttaacatttttcccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcctcactttcaggtacaccaatcagacatagatttggtcttttcacatagtcccatatttcttggaggctttgctcatttctttttattcttttttctctaaacttcccttctcgcttcctttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtgctcctgtagctcagagtaatttgatcgtctgaagccttcttctctcagctcgtcaaaatcattctccatccagctttgttccgttgctggtgaggaactgcgttcctttggacgaggagaggcgctctgcattttagagtttccagtttttctgttctgttttttccccatctttgtggttttctctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctcagatggaaatgcagaaatcacccgtcttctgcgtcgctcacgctgggagctgtagaccggagc

SEQ ID NO: 2274 - DNA, 1086 bp, Homo sapiens
gagaactcctggaagaaacagccaacaggatctagtgctggttttttaagcatagactccttttttaaaataaaaatcttgcatagagcctcaatatatgaaacagatcaaagcagtatttttattggtataaatctgcttttaaagtacaaatttatagagtacttattatactgtcagtcaatgagaacaatgaggctgttttcatgaactaaaaatattgagatcaggattatgaatcagttatagttttatattcatttcagcatctggttttggtttaggtagtcagtccaatatcaagaaaattctgattagcatagataagttattgtaatcttgagctttaaattgatttagatggaaaaaagaagatatttttgttttaaagttgagtcactatcatcacctagcagctattccccttcataaatattaattggataagccccaacatgtataataggcatcgcaacaactgatgatgagatggtatgatattaagcatgttgattttcgctacccaaccacggtctaacatgaacccagcctaggcccttgagccttctatggcatgtgattgaaccttgctgctgtgtgtcaagttataggctcacctgtacagctttattggaggaggcacacacaggcttgaatgaaaaaataaacctatgcaaagctacatgtattctaattaatagcatattgttcagaagttccaaggcatacagtgattctttcttccagggtttacataaaacaatgctagcagcctgcgagacattgcagtggtatctaatgcagggagactgggtcctgggtctcttgctcatgtcagtgagggttgctcatttgaatggatgtgtcaccgttttttaaattgaaatgtgattttctgctaattccagagtatctcagaacacagtttaaaagctcctgctctctgaaaccaatactaatactgtaactatcgcacaaaatgctgtaaggatggaaataaatacatgtgaaaagtacttatagcaccttgcaagttcttttttcttttttttcttttgttttgagatggagtcttgctctcaccca

SEQ ID NO: 2275 - DNA, 1164 bp, Homo sapiens
aggtctctcaaaactttctgtgggatgatgatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttagattcttattattgcttacttgtatgtaatatatcatctttttgtttgtttgtttgtttgttttaaagagatggagtctctgtcccccaggctggagtcctgttgcatgattacagctcactgtagactcaaacttctgtgctcaagcaaacccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaattttttcctcaatttgagaaaaatttttggcaaatatttttttctgtcccatctctccttcctgttttgctttgttatcaattgcatgtatgttagactacttgattcagtcccacagcttgttaatattctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagt

SEQ ID NO: 2276 - DNA, 1044 bp, Homo sapiens
ggcacccacactatcatgtagcccccttgctggcccttcagagctacagagggtccttgttccccatcttgtctcttccatgcggttgtgtctgctctattcattggccaggccctgactcagcaccaccactgcctttgggttgaacaccccagtgagtcacacagcgtgttcatgtgcagcctggaaactctgctaattactctcgagttagtcccttcagggctaccagtcattgtctcccctcagagaccaatacctgccctcaacatgagcctcgtctgtgcccccagagctgggagcatgacagtggtgagcaaatggggatgaggggaaaacagggagggctgggggactatatgtgacagtacagtggggagaaacaatagaataagcatccatgcagggttgctgcttgcagagatggcagccactattgaagacagcataggaattgcaccaattcaaattattcattttgttttgcttttattgggtttttttctgattgaaacgagattgatttgctcatcaaagtgttaacattaaaaaaatgcagcattaataaagtgttttctaaaataataaatagaatgcaggacacaaatgataaagcagaccacctccacaggaagacagcagctgacaggtgtgcacttccggacaggggtagcaatagttggcaggtagctcccgatgcagactctgcctgggcccagaccatcaggaccctttttcttcattgctgtgagtcctggatgtatgtgtactttatttctggctactgtttgttcttggattggacacattgtcaatctcaaggaaccaaaaaagctaatatctcagtttctgtgggtctggaatccaagtacagcttagcaggggccctctggagaggtaattgcatatcattaaaaagttaaaaatccagaaaagtgcatgctaaaaagtaagtttcccaacaccaatcctggcgccccaaaaagcctctgttcctaaccacaatgctgaacctttttatgaagcacaaaagatgagttcaaa

SEQ ID NO: 2277 - DNA, 1028 bp, Homo sapiens
gactgggggacagcactgaaagggtgtgatgactacttgtttatagagttcttgaaaaggtgtcttcactgggacccctctgcccgcttgaccccagctcaagcattaagacacccttggattagcaagtctgtccccagacctctcaccaccatagacaaggtgtcagggaaacgggtagttaatcctgcaagtgctttccagggattgggttctaagctgcctccagttgttggaatagccaataagcttaaagctaacttaatgtcagaaaccaatggtagtatacccctatgcagtgtattgccaaaactgattagctagtggacagagatatgcccagagatgcatatgtgtatatttttatgatcttacaaacctgcaaatggaaaaaatgcaagcccattggtggatgtttttgttagagtagactttttttaaacaagacaaaacatttttatatgattataaaagaattcttcaagggctaattacctaaccagcttgtattggccatctggaatatgcattaaatgactttttataggtcaatgcatctttgttattatcgtcagatgtatttcaactgatgtattatactattggtttaaatctctttctctcaagatagaaggtgtagcaaaagtatcccaactactcctcgcttctagtgtccctcggcatctgttctggaggggtaatttgggatgtggtgttagttgtggctgagagccagtgctaggtcccttgccccactaggccattctctaggctcattctaggtgaaagagctcacagcagactgtggggtgggggagcaccaggaagctgttggtgacctggacaactggtgtccctggttttcagtgactcgctcctcttcccttcagttctctgatgtttggtgttattattttatgttgttattttgcctctgatttgtttcctagtcactcaaagcattttacagaagccttaccactttactaaataaccctgtaaggtactgatttaaaaactgagtcata

SEQ ID NO: 2278 - DNA, 1023 bp, Homo sapiens
aggaagtttgacttatgaccatattagtatgctttattccttggtgtttaagggagttggggcagacaggttagctggctaatgtcattacaatttagtttttgtgacaatctgttaagaagggggcttattgcataatcaaaaaagaacaataaaaaaataaaaatttctactgtgaaactatttcaatctgtagcagctggtcatgttaaaacactttctgttttgcttaattcgtaactaggcataattaaagttaaatgctaaattttaggtagcagctgataaatggttctaagctttcctgacagaatactcctactactttggtgaatcatggaaaactctttctcctttatttttaattatttcttttccatctgttattgatgtcatcaacacggaagttggaaaggtgacaatgattgttctagactgcctctgtaatgctttttctcctctgagaattaaaaatacatacttacaccttgagccaggtagaattgccagaacatgttttcctccgtgtcttcggtctagatgaccaatctgtagaacgctataacttactatgcgtagagcagcggcaggcattcatgctatggaaaacctggagtcagtacaaataaggagtaagaaaaggccagggattggcaaatcaaagaagagttctcttctgccagggattagcctcctagttttaaatatatttttaatatccccattttaacatactccattttcaccttcaacctatccttcctgaagcccaaacttttaaagaatttacttccagacctggccttcagcctaatatgattagggtgtttttctgagtgtctgtcaaattatgctggctaatttcaatgagaaaagattttagagtcacagtgaacccatccataaaaggactaaaagctctctctggtccctgagatccacaacccctgagagaagccagaactacaaatgcatcgtctagactttgaagaagcagggtatgattcttaatatagcccaccc

SEQ ID NO: 2279 - DNA, 1018 bp, Homo sapiens
gacaagaggggaggtcagcgaagggggctggatgggtatttgctgctcctgagaacagtccccaaagttggaggggaacttcaacagtagcttcatgcatttttttaaccactccctcccccttttaagagagtatttgataggcaccttacttactattttttgtacaagaacatgggaattctattatttttatttttattttttttgagacagagtgttgctctgtcgcccaggttagagtgcagtagcacgatcttggctcactgcaagctctgcttcccaggtccacgccattctgcctcagcctcctgagtagctgggactacaggcgcccgtcaccatgcccggctaattttttgtatttttagtagagatggggtttcactgtgttattcaggatggtcttgatctcctgacctcgtgatctgcctgcctcagcctgcctaagtgctgggattacaggtgtgagctaccgcgcccggcctgtattacttctttgataaggacacctagtctcaacccacttgtgtattaattagttgtattccccgggagggttcctcagctgcttgccgcttcactgtgtcatggtgacccttaggtgttagctcaacaaatttaattaaagactgtatcgttgttctctgctgtgcaactctgattaggtgaagcatgttactgctttataaaatatagaatgttgtcgtaacttatctctgtgtatctttccattgcgtggattagagaaaacaaggtcctgtagtttcttttcctttcctttctccagcattcctctctccctaggtcatggaagtgccactgcgatgtggcttcctttgttctggtgaaggggagatgattggagcctctcatgattattctggatgctgttggagggaaatgccagagctcccacatccccacagtacaggcaccatctcctttccaacacacctcatactgtgtacctgtggagggcaagacagttagtgtggctaggtgagaggcagtgtcc

SEQ ID NO: 2280 - DNA, 1046 bp, Homo sapiens
ctccccaaaaatactagtttatttctctaccaactgaatgtgtaagagagtgccttttctccccagatctttgcataaacctgggagttttattttggtcaaacattaaaattttttttttgccagtctggtgaaattatcatcttttttataaacatttctctttgagctacactgagtgtcttccattcagccatctgtgtttctcttgctttgaactgcctgttcttatcgtttggccatttttatattaggttgttgatcttcaacaattgatttgcctgagttaagttagccttttatccatcatgtgttggaaatattttaaagatttgtcatctacagtgcgatttttaggcctcttgactttttgttgagccctaggcttttgtgactgcctgtgacagctctggagagggggccgacaggcacagtggcccgcagtcgagccaggccccatcttctgggcagtgacgcgtggttgttttaaggcttttggtactgggattccccgttgtaagttttagctttgttttgggtagggacttttccccatcatattaatgaacattaataacaaatagagacttgcttttgcctcccaaccaaatgtttgggaatgtgtgcacccacgtgaagggtctgtgtgatatctttatctcatcaaccttctaaggcttttaaaacctgttgttagatttatgtttagatcatggttctaggggagaaccatcgtcactcctcattgagctttgcagaggctctgaaaggaggacatactctcttccccaatcaatgtagaggaacgtcagtagttcagccaagattgctctatctgccacctcttatgcttccaagctgggctaattgagaagtgtgacatcttgctccagcctataagcagctgtctgtaattttgagagatgagaaggattctcccttaaaccattgctgcttttgtggcagcatcttatttctttcctttgcagcacaaatcacagtgtataattaaaactattttctttgagcttgtttttggtgtacct

SEQ ID NO: 2281 - DNA, 1027 bp, Homo sapiens
ccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctggtgggtcagggggagtctttgcaccaaagatgtcctgactttgcccccttgcccatcagccatttgccatcaccccaaacaactcagcttcggggccggtgaggggaggggcctcccccagcacagatgaggagcagctggggtaggctgtctgtgccatggccccccactcccccttcccttggagggagaggtggcaggaatacttcacctttcctctccctcaggggcaggtggtggaggggcgcccagggtcgtctttgtgtatgggggaaggcgctgggtgcctgcagcgcctcccttgtctcagatggtgtgtccagcactcgattgttgtaaactgttgttttgtatgagcgaaattgtctttactaaacagatttaatagttgagagtttttctttctctttcttcctggggctcaggccttaccccccaccgcctctatgtgcagaggggttttgttgggtggtgagggtgtgggttgggggtcctgggagaggagcggagggcctcctgggcgagcaggagccagcacctcattggtgaggacctgggcaggatgtgtgtagggcatccttaaagcaggacagggaggctgcaagggctcaagcccatcttcttttgccaaatgcagaatcaggagccaagctctttttggcatatgattctttgacctacatagccaccaccaggtgctggcacctttagcctgcgaaagccagctggtatagggtccagggaagagggggtgctggtgaatttggttgaaatcctggtaaagataccaggggagcaggttagtgtagtaccggcactctccaggaggcggtgataggggtcaggcagaaaccaaag

SEQ ID NO: 2282 - DNA, 1206 bp, Homo sapiens
ttgtttccaaagaagttggagttaaggacacaatatatttgtacccctagactgaatgggtgagtattccatatgaggatctgggtaatcctctttgcaacccacatttggtcttcagagacactggcattttgaagaaacatatgatatagctgtttggaaataaattcatctatgttactttttttttcttttttttttttttttatgagcaggagatcttaattgacagaaactcattggtggttggagtggccaatgggcacgggaaaaagtatccagtaatcagaagaattgtatctgggttatgtaatcttatgcacattccattgtctttgccaagcccagaagccatgttgtgttcattgttaagaaatttgatagatttacccagcttttctatgtattttgacttattgaaaatatgtaacaactgagtcgggttgcagcactggtggggtagaatcgactttccctgaaggtgacacagatgtcagaattgtgtccagggatttaatttagacccatactgtccaggagactgtctctagttggatctctgtgctgactgactgacagacagactttagtgtctgtgtgctgactgacagactctagtagtgtctatatgttgaccaactggtagaccaggaggatctgtgtgctgattgactctagtaggatctgtttgtcactgacagactgtagtagtgtctgtgtgctgactgatagatagactatagtaaaatttgggtgttgcctgactaacggtctagggtctgtaagctgacagtctgcctgctttctgattgtatccattgaagtgtatgtacattatggtaattctctgtctattaaatgtgtctaacaaaggaaggaattaagcactccacgtgttttctttataggggagttctgtacactatgattttaaatagatatttcttatatagtagtggccaaattctcattattttgtacaagataaaggttatgcatcacttttatggtattttgtgaactcagctaagggaatgcctgttcagagcctggagttgttacctttacttgaagtcatctcatccagtcccctgctttagggcaggacttcagttccactgttcatttctgaagcttctgtgtccccagcttaccctgttctgaaatgttgtattccattggacagggctgctatttttagtcagc

SEQ ID NO: 2283 - DNA, 1011 bp, Homo sapiens
taaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtaagttcttcatctttttagaaaagttctgggaatggaatgtatcttaaatttatttttatatacctttggagtgactagtaattgatagttctctagcgttactaaaccccagggtataccctgttggcacgtcacactccagctaattgaagacatttaccaccctgagtaggtcctgctgcttcattaagagtttttcttcctaacactgtacctcttgaacgaactagtagagaaaataaacaataggtattgtttagggagtaaacatataaaatatatttggcaattgccttgagacacatagcgtaaatgatatgttttcttaagtattttataaagtaggacttaccaaatacaactctgtggtggcatttttaaaagctctcaatatttacttcaaaatctgttatacttgtacatatttatagggtacatgtgatatt

SEQ ID NO: 2284 - DNA, 1033 bp, Homo sapiens
aggcatttataagcatctcttgttggtaatgctgaatttagaaaaatgatattttgatttctttaaaatataatctttaacatgttttgatcttatttgtaaaaatactttactagttttatttatttaaaagatgttggaattgttttttaagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggtaatcactttggatagttatatttttgctttattcttaccctcaggtctatatgtgggttgcagacattcaatgaaccccctaagaaaaaaatgtaaaatgtttacatatacatatttgtatttttctgtgggacacaatttttctacagcttctcagaagggtctatggcttgtatacacacacacacacacatactcacacatattatgatgtgtatatataaaataggcctcatatttttggcaaatttgcttacatttgctgttttataccatgttgctttcagtaagttaatataggtactttgtttatacaaagagatataaagtggtttattggagggagaatcttagattgaaggctctagatagtgatcatacctgttgcaacaactgggaaactcttgccatctgttgacttcactgaattaacattcaattcttttctgcctccagaatttctattattatccattctccttcatccttctagacgtttttctttcaatgtctttttatacccagaaggtactctcagaatccttcgaactgctttttaaatatattttaaaagaaatatttagaagatcagtgaagctggactaaacattgcctagtatcaataggtggcgtttaagtagtggtgaataccaacatgactcaagcatttgagtatttacttttataa

SEQ ID NO: 2285 - DNA, 1558 bp, Homo sapiens
agtggcatgatcttggttcactgcaacctccgtctcctgggttcaagtgattctcttgcctcagcctcccaagtagctacgattacaggtgcacaccaccacacccagctaatttttgtatttctagtagagatgaggtttcaccatgttggccaagctagtctcaaactcctgacctcaagtgatccacctgcctcagccttgcaaagtgctgggattacaggcatgagccaccatgcccgcagtatggcccttttaaaaatatttattcttcctatgcatgagcatggaatatttttccatttgtttgtattgtctctgtcttctttgttttgtatttctctatagagatcattcacctccctggttagctgtattcataggtattttatccttttgtggctattgtgaataggattgcattcttgatttggctgtcagcttgacattgttggtgtatagaaatgcttctgatttttgtaccccgaagctttactgatgttgtttaacagttctaaaagcttttgggcagactatggagtattctaggtttaaactcatatcatctgtgaagagagatagtttacttcctctcttcctatatggatgccttttatttccttgcctgattgctgtggctaggatttccagtaccatgttgaataggaatgataataatggacatccttgtcttgtactggttttcaaggtgaatgcttccagcttttgctcattcagtatgatgttggctgtgggtttttcctggcggctcttattattttgtggtatgttcctttgatgcctagtttgttgatgacttttaacatgaagggatgttgaatgttgtcaaaagccttttctacaacaattgagatgatcatgtggtttttttgtttgtagttctgtttatgtgatgaatcacatttattgatttggatatgttgagccaaccttgcatcccaggaataaagcctacttgatcgtggtaagttaggtatttgatgtgctgctggatttgatctgctagtattttgttgaggatttttgcatttactttcatcagggatgttggcctgaagttttctttttttgtcctgtctctttgccagattttggtatcagtgtgatgctggccttatagaatgaggagtccctcctccttgatttttggcatagtttcagtatgattggtaccggctcttgtttgtatgtttggtggaatttgtctgtgaatccatctggtacagggctctttctggttggtaggttttttaaattactgattcaatttaagaacttgttattggtctgttcaggtatttaatttcttcctggttcaatcttaggaggttgtatttttccaagaatttaccatttcttctacgttttctagtttatgtacatagaggtgttcaaaatagtctctgagggtgttttgtatttctgtggggttggtggtaatgtcccctttgtcatctgagattgtgtttatttggatgttctctctctttattaatctagctagttgtctatcaatcttatttattctttcaaaaaa

SEQ ID NO: 2286 - DNA, 1050 bp, Homo sapiens
tttgccatgtactgtgttaataatgagaggtgatcaaatgagataataggtggcaaactgctttgcaatgttttcaacactgcaatacagttctacatgatggggaaccttactaaaatactccttttgtgggggagaaaacctttttctaacattatgttattttcccacctaagagctcttcagtttaatcttaggaacattggaatcataattattatttcattcattatttcatactttcatttttcccaagttgtataaatcttaatgttgattcacctttggttttctgtagataccaagtgaattttgagatcataaacagttgcctttgaacctgaaagttttgtttctaatttgggagataatatgctcttattaatttactgagaagatacgtagaattttgtttttcatatttctgtgttttgccttggttttctgttaaaccatcagcctctacactttcttctagaactatgtatatgtgttgagcattgttctgggaatagccttttacttctgtcatctggatgttctagatcactctgaattttctgtcttgatttagtattcaaataaaaaataagatattgaaagtggtggaattagtgggaactggtgacagaaagggggaaacccaaaattttttaggagctgtgatttatttcatggatagtctctctaagttaatgatacaattctaggggatcagttaaataaacttctaaagtaaaatactgtaaaaacttacctgtggtagaaatagctgttttttaaatcacaattttcacatggcagtgcaattgtacagtgtctctattttgctgatttggagccaaatacactcattagtcacgttagattcagttactattctagtgtcatctgtcatttcctttgtagtaaagaccaatagagttgagtccaaggacactgggcagggttggtgggggtggtggtgggaggggggctgttggtgaggaaagagagaatgaggatggtgagagaaaagggcaaatgggtgcatttgagaagaaagattgt

SEQ ID NO: 2287 - DNA, 1029 bp, Homo sapiens
ttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttgg

SEQ ID NO: 2288 - DNA, 1022 bp, Homo sapiens
atgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagtattttgttataacagcccaaatagactaagacattgggcaaccagcaccgccaattaattccggaacactttcatcatcccattcctgttttagagattagactgtaattttctttcttgtaatgtcctcataagattttgatatcaaacttatgacagtcttataaagccagctggtagtgtttcatatatttgcttccttgtaagagtttatataaaattggtattatttcttctttaaatgtttaaaagaattcactggaaaagccatatagcctggagtttactttgttgggaggtctttttttattccaacaattttcttgtaccatgtagactttttgctgaagtataacatatatatgtagtaaagtgcacacatcttaattatgcagttcagtagatatttacaaattaaatgcacccatgtaagtggcactcagattaagatatagaacattatcagcaccccagaagccttcctgatgccctttcccagttatcttcccaaagtaaccgctattctgatttataacactaatagttttgctgcttcctaaattttataaaggaatcaaaaaataggtactcttctgtgtccggcttctgctcagtgttatatttggaagtcacttttgttgctgcatgaaggatggtcagtttttttattattatattgtatttcactgatgatcttgagtaccttttcatatgtttgtgaagggcctattccaaacttttgtctgttatttactggtttgtctatgattttattgttttgtagaagttgtttaaatattctcttgttttctaataaatgtaacacaaatgttgtcttt

SEQ ID NO: 2289 - DNA, 1033 bp, Homo sapiens
ttgaaaaaatattggccaaaaattatccaaattagatccaaaacaacctcagatccaggagattcagtgaaccttcagcaggatgaataaattattaaaatttaccaccaccaccacccccctgcagtagtttggtaaaaactaccaaacaaaattttaaaaagcagccagtgagtggggaaaacaacaaaaacccgtattacatttaggagggcagggacaagtaagaatgacagccagccaagttttcttaagaaaatgtggttacaatatggttatctctgttagtgctgaaagaaaaataaaacaccctagaattctgtatgaaggagaatatattagttaacatttaaagtcttttaaaaaatgtttttaacatcttgcattccattccttgtctctgttcacactggaaattactactttgtactactttttctgctaaagcagatatccattaattctgaggtttctctaattttccagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtacaaaggttatcttttttctgtcttggtttgttattgttgttgctgttcattttagactttatttctttgatattaactatcagtcatacaaaataactgaaaagaaacaattttagtatttaactctgtcttgtattcatttctatgccagatgaatgacacgaaattcacataaaattctgctgttgtgattttttgtgcttttccagggttcttagcacgttatgtacattgcatgggtatatgcttttaatatttttatgtataaaaagtgaattacaacaactttttggaattgaaacatgggcatttttatctaagtaagtcaacaatggcataattcatataaatgaaatgagag

SEQ ID NO: 2290 - DNA, 1101 bp, Homo sapiens
gggcagtatagccattttaatgatattgattcttccatccatgagcatgggatgtttttccatttgtttgtgtcttctctgatttctttgagctgtgttttataattctcattgcagagatgtttcacctccctggttagctgtattcctaggtattttattctttttgtagtaattttgactgggattgcctctctgatttgactctcagtttggctgttgttggtgtataggaatgctagtgatttttgtatattgattttgtatcctgcaactttggtgaagttgtttatcatctggagcagcttttaggccaagactgtggggttttctaaatatagaatcatgttgtctgtggacagagatagtttgacttcctctcttcctatttggatgccctctgtttctttctcttatctgattgctttgcctaggaccatcaacatacttttatgtgtaattatacatgtagtttggtgttttctcttttcttaaaaatgatattatgctgtacatatttttctgcaactttttccacttacactcttagattgtagttgtgtttagatttattctcatactttctaatgatgacttaagtatataccataccttatttaactattctcctatcagaggtcatttatatgttcagacgttttatattaataggtagttggatgtattgatcttttccctaatggctatgactttggtgtctttcttactaaaactttaggtcttctgtatgctgaaattgtatgaagatttcaaccatgtgttctgactttggtctttgcacttaaatcattagtaaatctgaaatttattctggtgtatataatgagatatatggttccacctcgccccaccccagcaaccaccatccaatagctaaatagcaccattttttgaataagttgtcttctccccaactgatttgaaatgtcaatttgtatcatacattgcattcataggtgttccatcctcttttctcctttgaactttgtccattcttctattcttgtagcaaaagcaagtctttttttttttttttttttactgtagtactatatgttttaataactgccgggaacactt

SEQ ID NO: 2291 - DNA, 1040 bp, Homo sapiens
actagatatgcatttccctaaaaattagaaatgtgttgagaatcttttcatgtgcttattggtcatttgtatatcttctttagagaaacatctttttaagtcttttgcccattttcaagttgggttgacatttgttactgagttttaagagttatttatatgttctggatattacttccttatcaaatatatgatttacaaatatttcctctcattctgtgggttgccttttcactctgttgatagtgtcatttgatgcacaaaatttgcttttaattgatgaaatataatttttttcttgtcttgcctgggcttttagagtcacatccaataaatcatagccagatcaaatgtcaagaagcatttcctctgttttcttctgagagttttatagttttacctcttatgtttaggtctctgatctattttgagtttgtgtttgtatatgataagggtccagcttcactttttttgcatgtggatatccagttttaccagcaccatttgtagaagagactccctttccccatttgactgttccttgtcacgcttgttgaaaaccgtttgaccatatatgcaggggtttatttccgaggtctctgttctattccattggtctgtatgtctgcctttttgtcattaccattgttttgattattatagttttggaatcagaaagtgtgagccttctcaactttgctctttgtttctaggattgttttggctatttgtggtcccttgagatttcatatgtattttggaatggatttttctatttcagaaaaaaaaaaccaaaaaataccatcatcaggattttcataggggttgcactaaatctgaagattgctttgtatagtattgacagtttaaaaatactaaatttttccaatccataaacacaagtgtctttccatttattttatatctttaattttttttagcagttttgtagttttcagtgtacaagtctttcacctccttagtttattcctaagtattttattctttttgatgctattacaaatgatattgttttctta

SEQ ID NO: 2292 - DNA, 1066 bp, Homo sapiens
taaaaccatcagatctcgtgagaacttactatcatgagaatagcatgggggaaactgcctccatgattcaattacctctcatggggtccctcccacaacacgtggggattatgggaattgcgattcaagatgagatttgggtggggacacagccaaaccatatcaagtgtttagatgatctgattgaaataaatgctatctggagatccatgtgttcaacatcttggaactgttttctttctcagatgtttgggtcattgctgtgattgttattgccataggtaagtatcacaaattttgacaccacttaagtcaaaaaattattgtgaagacatgcattttaaaaatagtttttcagtttctatagttttttcagcttgtaaattggttaaaccgatttaggaaaacctgactttttatttgatatacttaactacctaccttgtgttagtgattttatactctgttatattctgtatatctacttagtaacaaagcctaagtaatacatattttctcaagatgatcagtaatattagttggcttcccaaatgtgcttttgatagttttctaaattaagcaaggacttttctctgacttactatggactgtgtaagtgattatggggagttggatttagatagcaaagagtctggatggaatataaatgtgtaggtgcttaaataacatttgaccactgaaatgtaaccaacatttatttcttctgctagatgttgaatcttggtgattagttttcagaattatatgtcatttgtttcctggtttcttatagttgttggagttgcagtaatttgtgttgtcccgtacagatatcttcaaaggaggaagaagaaagggtaaattaaagcatgtttcttttaacttcttggtccttcttatacttaacatgcttttgtgcagcttcagtttgtaatctgtattgcatgctatcttttttttttttttaaaaaaatgcctgcattagtttgtcctaccaattgcatttctttgctaaaaatattttcagctacttctaacatcactgcaacataaaaacatctgtgca

SEQ ID NO: 2293 - DNA, 1028 bp, Homo sapiens
ttaaaacatcaaactcaaattttagttaaagagcttacagtttaacaaaagacttagaatgaatcctggaacacagactaagattaggtgctttgaaatttctgaaagataatatacattcatttttactgatttttaaaaactgttttcccctatagttttagaaatagctttgaaatcaaacctaataattttaagacttttggtactcatggttttatgatatatattccttttatactgatcatcaggtttgggctaagtcataaaagtacaagctttactcataaggaactcaaacttttttcatattacttggttatcttttgaaatacccataatcccttcacttgaatcttaaatcttgtattaatggaacacgatatgcatatttgatttatctatcagttgtatattctaaaagttacatatctacaacgtgagtacaaaatattatcaatggaatatttttacaaatccataaggtttgcgtagaaacaagttctaaagaaaacaaaacaaagtcgcattctgcttattttccttctttgtttaaaatatcactgcatcagaatttttaaaggttcattaacaagtattaatcaaactctctctagctagcagttaatggtttttctgttgttgttttttgcttttttgtgatggagtcttgctctgtcacccaggctggagtgcaatggcgcaatcttggctcgctgcaaccttggcctcctgggttcaagggattctctgcctcagcctcacgagtagctgggattacagtcgtgcaccaccaccaccggctaatttgttgtacctgtactagagatggggtttcaccatgttggtcaggctggtcttgaactcctgacctcaggtaatccgcccacctcggcctcccaaggtgctaggattacaggcatgagccaccgcgcccggccttaatgggtcttttaaagctcaacagttatctgactgttacactcccaaatgaaaggttcaatagcagtagtgaactgagattccaa

SEQ ID NO: 2294 - DNA, 1048 bp, Homo sapiens
agcatgcgtttgtctccagtctttcccattggccctacatcaaaatgaggacatagttactaagtactttgtgtgctactgctctatttcttgttttggaggggatcaaaaatataagacagggataaaggaaggttttttttacagtgagaccagttgaacatttgaaattattttaaaagaataatttatttcccaggttggtggctcattactatatttttttaattgttcattttctgaataggcttctggaatttaatttctgtacttaattatatttatctttgacatgatctttataccttggtttgcaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatc

SEQ ID NO: 2295 - DNA, 1491 bp, Homo sapiens
tctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttcatgatgatgtgtttatttctagtgggttttgtctcaaattgaagtatgtttctaattgggcccatcttctaaccattccactcccacagccattcctcctgtccctcctagctcagacccttaagtatccccaggcttctccactcccaacccatcacatagatactgcacagatatccagtgacatcacattacctactggatgaagtccacatttcttagcctgatacttgaagaccttttacaattaaatcccaactttcttccccaagcattttctattgcacttcttcaaataacctactctcagtcaagcctgaccatttcccctgtgctttctgctgtattcctagttcattgttgcttgaaacacctactgtcctgttgagatcctatgcatcttccaaggcccagctcagatattac

SEQ ID NO: 2296 - DNA, 1049 bp, Homo sapiens
tcagccttcccagtagccgagactacaggtgcacaacacaactccgggctaatttttcttatttttttgtagagacagggtctccgtatgttacccaggttggtctcaaactcctgggctcaagtgattctcccaccttggcctcctaaagtgctgggattccagatatgagccaccgctcccagcttagagggacattctaattaagaaatttgctagaaaaacatgaaccccgaaatcttttatttagccaagttgtatccttcttttggatgagagccttgtgtgactctagggtttgtcatgtgacctccttaaacttttcatttgtcagttattaaccatattcttgccagccctgcccaagtgcatgtgtaatttttgcatgactatatctaaaatgtatttataatgttatattctgcctttttcatttaacatctcatttgaccttttcctaatttctacatactagtagttagaatgtaacattgcctgtttctttttagggtttccagaaaggaagcaaagccacagatttgtcaactggtaatgctttctaccttctttttaatagttggttttgggttgttcccactaagattatatctaataataaagcttgattacatttctattccttttgatttcagatgcaagctattattttggcagtatcacttaattttaaatgcagatgtctataaaaatgccattgtgatatctaatacagaagccacagtttgaaattgtcccaggagactagcctattaggccctgttacagaggcttatcagagggctcttagtgaatcctaagagggaatatcttttttggttagcataaaggagtcacaaatacagtgcaaaatgaacaaagggcctatcatattacaacaaactaaaaaaaaaaaaaaagaaacctgttttcttttgttgttttgtaattatcctgttgttctattaaacctgtggcctaatgcctgggacataaattaaatctcataacctgaagttttatgttttaaaagtggggcagtagcagtttgg

SEQ ID NO: 2297 - DNA, 1050 bp, Homo sapiens
atgccaagtctctgtcgcccaggttggagtgcagtggtgcgatctcggctcactgcaagctctgcctcccaggttcaggccattctcctgccttggcctcccgagtagctgggactacaggcgcccgccaccacgcccggctaatttttttttttttgtatttttagtagagacggggtttcaccgtgttagccaggatggtctcaatctcctgacctcgtgatcctcccgcctcggcctcccaaagtgctgcgattacttacaggcgtgagccaccgcgcgcggccaccaccaagtgacattctgaaggagaattcaagcaacctgaaaagcataacgtctcatatgtcaggatcatttaaggcatatttttcactcctttgctgccccgtttatccttggtccattgaggtttgcccagagagattaaattcttagtgtcagtacaaataaaaattaatttttttttcttgaaacacacgcatgcacagagaagcagcataagaatgcgtgagtactgaagccaagctgcctaggttcaaatctttgctttaatattttctagctgcgtaacttttggcaaattccttaaactctctgtacctcagttgctatctgtaaaatggggatggtcatcataatacctgtcttcagagttacaataactaagttacttaatccatgcagggcacttagaacaagaccagaccttcttttccacgttacaaagattagtaaaattttagaaaattaactgttattttgtattattcttacttatatgcctcatactcttcaaaggaaagaaaagagattttgagagagaatggttcagaaaaacagctgtagggatcttttttacttagcaaattccaactcttaggggtgagggcgcttatgcgttaggaacaccaggtggcgctgtaaacaagtacagtaaggagatctgcacctcccctcgggtgccggccttgggctgtggggcttgtgcctggcagctctcagagctggagaagacagagacctaggcctcttttttttattttattt

SEQ ID NO: 2298 - DNA, 1025 bp, Homo sapiens
taggagtacaagaatctagagtaatccaaataaaaatggagagcaaatgggtgatgaagactatgagagcccatcctgtacctcactaagttctcctttactctgaaaaagccatctaaaagtgtcattttcttcttcccttatttcttcctctaatggctgtatgagttggagttttgcaagtgtaaaactaaggtgtttacagaatgatgtctgtggaccaacttcagaaatttaaagcctgtttgtttttcctaacccttctgcattattcagttgagttatggacttaataaatcacattgaaatggaacagaagttcatttattgctaccggaacagaaagactagaatgttgtttatctgcctggcccttggttcaagggaggtgatctaggcattcttttactctgaatagacattatagttcagatgcccagggtgtgtgtaaaaaagaaaatctttttttattcttgagagaagaggaatagagatggattgctgagatggtcctgacagaattggtgtcatacataccatccactatagtttctttggtaagggtccaggtattatacaaaatgtcccattgccaatttagtttagatttctctctcctaaggtcttttccattggaaggagggtagggaagagggaaattttcttgttttatcaacctatttcattctaagacttaggcagaggaatgggatatatactaagtaattttggcttatgtatttgttttacctaaatgaattatatatgtaaaaatatgtatggctgggatcttttgatcaataaaattaattttctggttatttattctggcctgtcattttcatgaggagaaaaaatatctacagaggacagttttcatacatcaactgaaatatgactcatcttttctacatttcaaccccagaagttaggtaaacacaaacaaacctttaagaaatatatctacaaaatgagagtgatgaatctgatgaaatgacagatttggtgatgatttcctcaaagaa

SEQ ID NO: 2299 - DNA, 1096 bp, Homo sapiens
ttctagttttatttgcatagagatattcgtagtagtctctgaggatctttcatatttctatataattggttgtaatgtctggatcatctcactgtttttcttttttaatctagtggcctatcaatgttgtttatcgtttcaaagaaccaacttttggtttcattgattcttcgtatggatttggggtctcagtttccttcagttctactctgatttttagttatttctttttttctgctgcctttcaggttagtttgttcttgtttttctcgttcttctaggtgtgatgttagatcatgaagattttttctatttaggtaggtgtatagcactatgaactttcctcttaatactgcttttgctgcatcccaaagatttttgtatgttgtgtctctgttttcatttattttaaagattttttaaatttctgccttagttttattgtttaccccaaagtcactcagtagcaagttgcttaatttccatgaaattgtgtggttttgagagatcttcttggtattgatttctgtttttatttcactgtgatctgaacgtatggttggaatgatttcagtttttttgaatttattgagacttgacttatggctgagcatgtggcctatcttagagtgtgttctgtgtgcaaacaagaagaatgtatattctgtggttgatgggtacaatattctgtagatggttattaggttcagttggtcaagtatcaaacttaagtccagaaattctttgttggttttctgccacgatgatgtgtctcatgctgtcagtggggtatcgaagtccctcactattattgtgtgtctaagtcttttcataggtctagaagaatttgttttatgaatctgagtgcctcagtgttgggtgtgtatgtatttaggatagttaagtcttgtttaattggacactttatcattatgtaatgcatttctctgtccttttttattgttgttggtttaaagtatgtttcatctgatataagaatagcgactccagctcttttttttttctgtttgtgtgatagatctttcatttcattttattttattttttattatactttaagttttagggtacatgt

SEQ ID NO: 2300 - DNA, 1033 bp, Homo sapiens
ttcgatcattcctctggttcttcaaacccatggaatatatcatcataattgttagtgtccctgtctcctaattttatcaattttctgagtcagtttcgattgattaatttttctgctaggtttttttcattttgcttctttgcatacctgataatttctttattggatgccaaacattgtgaagtttcccttgttgagtgttagatctaatcgtgattagttcttgagctttattctgagataggttaaattacctgagactttcctttcagtcttgcttttcacctttgttaggaggggcaaaacctgcatttagtgtaagattaattttctgaagcaaaatccttcatatgtcagtctaatcagtggctcataaggtttgagattttaaaattctggatcttcagaatagtccccatttcatgctctgtgtaagatttggcatgtcttccctctaatcctcttaggcagtttttttcccagcctctgattgtttccttacatgtatgtgctaagaagtactgaactgtatcttaggagtgactcagtgcaggtgtctggagttctctgtctacacagctttttattccgggactcagccacatgaacttgagcacacttggcttcttcatactcccaggtttatctcctcaacactcacctgactgtacagtgaccgcactgtcccctttctccaggtagtaagcttggaaaatcatagtcatacagatgatctcattttttttcttcctctgaatgatcactcctttattgcccatcttcagtgtcttgagtgccattgtttcatacgctctgtcttgttttagtgttttcaggtggtgggagaaatctgtccatgttattttatcttaactggaagtagaaaatgtgattattagaatggggtcatttttggtatttaaatagactatataaaaatctgcagcagcgatttcaggagagactgggaaattacacaggaactgagagtcctggattagagaacaagatatggtgaaatttaagaggagac

SEQ ID NO: 2301 - DNA, 1063 bp, Homo sapiens
ggcaagggaaaaataaaaggcatccagatagggaaaaaaagaaaaaaaaaagtcaaatggcttctttttgctgacgatatgattctacacgtagaaaatcctaaagactccaccaaaaggctgcaagaactgatgaacaattttagcaaggtttcaggatatgaaatcagtgtacaaaaatcagtagcatttctatacaccaataatgcctagactgagaatcaaatgaagaacacaatctcattcataatagccacacaaaaaatgaaatacctgggaatacatctaaccaaggaggtgaaagatctctataaggaatattaaaaaacactactgaaagaaattggagatgatacaaatagaaaacactctattctcatgaattggaagaattaatatcgttaaaatggccacactgcccagtgcaatctacaggttcaatgctatcactattaaactaccaatgtaattcttcacagaattaaaaaaaggctattctaaatttcgtatggaacgttggatactcagggacataaatatgagaacagtggacactgcagactactacagagggcatgggggcatgggttacaaaactacctattgggtactgtgctcactacctgggtgcaatataaataaccatgtaacaggcctgtatatgtacccccctgtatctaaaataaaagttgaaagtaaaaatttattatttaaaattgctttattactctgaagttggatattttttcaattttaacggtgatttaacatttaagaattcaacattcttctttggtgactactccatggaaattattcttgaagatttataatgttctttatttaaaaagttaaaggcttttttgagtaattttttaaaaccatatgttaaattttgccgtcttttttgtttaactttgaattttgattgcgtgtttttaagacagagttttcatatttgtacacaggaaaaaagtattaatcatttttatttctagggtttttttgtttaattttatgtagtatttctatacaccaataatgagtagctgaaaaaggccaa

SEQ ID NO: 2302 - DNA, 1047 bp, Homo sapiens
ttatttccacatttaaataaattattcacttgcttaatagaatgtatggctactcatcatgattattatctttatacccagatatgagggacagaataatatatcctagatatcatttttatcattatacataaacacaagctatccttgattttgtagctgtgacttaatgttttagggcctattactattgatgacttaaagttttatcccagcatgtacagttgtcaaagggggtaaatcacctattgctgtatttggcttcatgccaactaaagattagtgcacctcaattcttatgtctgctagtacacagatataataataaattaatcaaatactgaatgattactatatggtcattatgagattcaagggaagaagtaaaaaatatctgacaggtactctaccctcaaaaatacattttagtactagggaaaataagacatgtgcttactaagttaattaaataatacaaagcagtaaaaccagtccccaagttatgtacacccctggtacatgaatagtagagcaggaagagaatgtgttttgagatctggtccttgttaacattctggccatatctcttaatatattagctgtgaaacctttggcaatatagttcattgtttttagatttctttcattgtctgtaaaatatgaataaaactgaactggcagggttgccatgaaaattaaatgatatatgtggtacagtttttagcatagtgtccgatagctaataggtaagtgatcagtaaatgtagccaattataatggtagtgaaaagagtgacggtcatgagcaagccctgagtgtgcattccctttttgcaggtacgtttcggatttattttctattcatttctctttcctctcaccccaactcccctctgctgtcttgagcacttctcggtagttctgttagtctagcctgactttatagcctatggaaagagcagtgaggagagaggtacacaatctaggtgcttctactattcttgccctaacctctgcaagtggtccaagtgccccagaatcaccttct

SEQ ID NO: 2303 - DNA, 1029 bp, Homo sapiens
ccaggctggagtacaatggcatgatgtcggctcactgcaacctccacctcgcaggttcaagcaattttcatgcctctgcctcccgagtagctgggattacaggcgcctgccaccacacctggctaatttttgtatttttagtagaggcagtgtttcaccatgttggccaggctggtctcaatctcgtggcctcaagtgatctgcctgccttggcctcccaaagtgctgggattacaggcatgagccactgcacacggcggatcatagcagggatttttatgaccatttccacatgatgctatggtcaaacgctgataaaatattttgttattatggttatttatgtgaatgttctatgattcatttttcttctatcttaaatcttagatatgttaatttttagtgttaatatgtagtgcttaggaaagaaaaagtgatcattttctacttctattgtagctcttcctttcctaacctgaatgtcagagctgtgctccatgagtgtggtaatatcgtgattctgtttcattgaaccatcttttcatcttccttggctcctgcaaggctaataactgcacagcaagagcctgtggagggtacttacaattggagcaacagcaacatcacctgctccccagtaatgtggataacagtctcactgaagaccaagggggagaaagcagggacagacaactcagttgaatgggctctgtagttgacgtctgttttttctgcctagcattcatatctttcttatgcacacagtacccagattttggttgggagactaacctgcccctgtattatgctgaagcggactttattgcaaagccctagaattaaatctcatgggctctaagcagcaagttccaggatttgggtttgagcaagtaggatgctgtcttcctctttcccatgacactcagagctgccggcaactaggagggaaaagtctgccaaagaatgaagccaaatttgggaaacaaacctgagaaatggataaaggagaactggttcctagtaacatgg

SEQ ID NO: 2304 - DNA, 1038 bp, Homo sapiens
aaataatgttgtcattgaattaagctgttttgtgactgctgatgtatcactgtgtttgatttggtgacagcttgaggtctggttaatataatcttaaggtaatcagcttgatagactggaattactagtttattatcaaaaaatgaatgtaaaaatattgctcttttctctccctgtttagactagtatgtgcctttttaaaaatactccctttcttcttccctgccttttttccccactcttattcatatacactcaaactagataccagagttagttcatcaaagctgaataatacctatcaaaaagtgataccctgacttttttctcttaatcacctgtactggaccatagggaggaccaaataggctttcttggggactacagaaagagcaaagcgtaatactctttaatcatagcatgtttgttgttgctgtttcggtggtggtggtggtggtggtggtggttgtgtacttaccttgaatagtgtgaagtatcctaaaattatgttgtgtgggctgggagcaggaaggaaactgattattcgtctaacaaaggtttggcataattttattgtaaaatttcaactgtttatgacatgaaaatttctaattaattataagaacaaagtcactgtggtggcaatagttgtacaagatgtttgacattatttctatgtcagtttgatagtctgtgttataaattgtcttattaggacccttcttcaccctcttctttattattctgattatcagtaaatccagtttgtactgttagacatttgagtttgtcttttaaatattgaagactattttaaaaagaaaaaccataacatctttctgtttattacattaacatgtgatctctcacctgacgatgtgtttaaaatgaattaatagataaaatataatactccgttatatactgaaaaaaattttcaaactttgtctatatattcagatattgctagcagttcatattaaatatgactattttgtttaatgagaaaataggaatttttccttatctctgagactt

SEQ ID NO: 2305 - DNA, 2049 bp, Homo sapiens
cagttataacagctacagattattgctagtagcattccatacaattccatattaatgttcttaggagctaatatttgataaaggggaaagctagttaaaaactaattaatttgtcaaatgtagcattcttattatgagtgtaatatctcatggagatttaaatatgaacgaaaggacttatccttctgctttttaaaagccccagcattactagatagtgtttttcttgaaggccaaagctgtaaaatgacaaagttggtgattttcagcagcactcacctgagctgtgagcgcctgcacctgttcggtagaacccactagaatcacttctctgtaggataagtgatgcctttgaatccagcagcataaaaatctgttctttttagtcatcaagtttttgtttccaggatatttctagcattgcaaaaaaaaatttcttcaccaaacactaattcctaaacacccatccaaaccacaaaaattctcttgttagtaggcgagagtgctaggacttcctgtgttcacctcccatgcacccagcattgtcttttatgcatgagatattccattagattttcctagagtggccaggacacccttcatagtaagttatatctcttaactggattctatagttttatctcgagcaacttggaaaagctaagacatcctccacccacactggtatctacgcgcctggaagctgcaccttctctcattgctgtgctctgctttaaggaaaacctgatatgacagaatcaagactattaaaagataaatgaggggaaatcttcatttaagaaagttgccttgctccccaagagtgcctttaattgctattcccctaggcatctgggtgcatatcattaatgaaatcattaacctttgtctctggtccttcctttctaaaaacagcagattatagaaggtggtctggcaaagggattttcaaagggcaaaagtctcatcatcatctttccactcaaaatcctattattctacatttcactttgcaggggtcctagggacaggattgcagggacaggggacatgggaggaagacagaaaaattcaaaaccagcagatgccactacctggcaatgaattgaaaattaggggaaagcatctttggcgtgaccttttattaagacaacagaaatttagaacattttacatgcttctttgttaaatggtgaagcaagggaatgaaagtatttatttttagagctcatagttaactccatcaagacatggctacccacccctccagttatgaacttgtattacagctccacttggtgacttcctttctgtgtatcaggagcagagcagaggacaacttgtagaagacatgaccattaagagacatcaacttcgcaacaaatataagacaaggatacaaggattcctatgtgatgcagctaggtttttatatccttctaacaaatggtgagcaggagacttttttggaaataattagttgtgaaattccatttttctgacagccccttaaatttgaagttatttcatttgtagttaaggttatcacatccctgccaattttactagattttttcagagacaagcattcagcatggcattagtaatgatggtttaaactaggtgcagaactgtcccatgaagagaagaatgatatcagtatttaaataataaaagaagagacaatgtatggtttatagtgattcattttaagattgctgtattttgattttgtggtttaaaataaatgcattaaggatcttttaagttactacaagatgcctctctgttgctttcttagctatagtgcctaagcaaggtatattatcttgacatggctaaaatgtctcaattctatgtgatatagctacacgacctggggtgaaagagttactagtttggagattatttcccagccttgggtacctgccatatttgagctgggagaactcacttaggaaaagcacttgcaaagatgtaagttatgaacacttgaatctcgcatcctgccataaagtgcatcagcaagtgactttaataaaacatgct

SEQ ID NO: 2306 - DNA, 1068 bp, Homo sapiens
ggtaatcattcaaagacttgaatagttgtgcagctgtggtgttggttagcaacaaaagtgcaagtgacatatcctcgtgcacctaacatcttcatgtatatcctcctgaaaactgtatcacaaaaaaacaagcattgttgccttgtcaacactggtagactagtcaacccagattgcgtaccgcagtgactcattaatcctctctaccaattgtgcctcaatatccgctgctatttcaattcgcctagtttactcttcaccaatagtaaagggcttcttagctttagcaatacggttagccactaagaatgatactctcattgcagacacatttgatgaaatggtagccttcaataattgcttctgttctttgtgcttatgttttttcttttgaaaaactccgaagccttgtcttttaatgcagggtgcttggtctccatgtggtgaagcagttttgaaggtttcatggcttcattggatagccagtggccacatattacacaaagtgggcttggagaatgtgagtcacctgttgcaatgaacctgtaatttgagtatgactcctggtattttcttttaaatgcagcttgctttttgttggcaatcttacagtcttctgtctcatcattgggtcttcccccttttcaaagaagcttaccagtgatgtttgttttttactcatttcggctagggttagcttgtgggcttaccaaaactgtgactgagacaaatgtgcagtgcaggaaacaggcacacctggaagtggtaaataatgggcgggccatgagtggactaaaataagtgtcggattctgactgaaagcctgcccacagatgcagctgtacgatggaagtacatcaactcacttgccactataaagcctgccaccaggcagcattaagctacttgttacttgacactcactgataggattttgatatgagtctgcaagcaattgatttattatggtctctgtgtagtcaaacctccctcttaatgctaatttgtatttgcagccactccccagtgctagcatcacttgtagtcccaactacttgggaggctgag

SEQ ID NO: 2307 - DNA, 1029 bp, Homo sapiens
tcacattgcagatgctatttttttttttttttttttttggagacggagtctcactctgtcacccaggctggagtgcagtgacatgatcttggctcactgcaacctccgcctcccgggttcaagcgattctcttgcctcagcctcccgagtagctgggactacaggcatgtgccaccatgcccagctaagtttttgtatttgtagtagagacggggtttcaccgcattagttaggatggtcttgatctcctgacctcgtgatccaccagccttggcctcccaaagtgctgggattacaggcatgaaccaccacacctggctgcagatcctatttttacgttaggcagagagctacaattcctattcctgttctcaccaggaaatcactaacatcttacatttttcctacctgtccgcaaatttacatgtcaggaagaaaatctagcatggatgagactagacaaaaggtcatgtactgatgggtaaagagccggcattctttgtgttcacaagaaggaagcaaacctgaccttccatcaccaatcatgggtttcttttttttcttatttatttttttgagacagagtctcactctattgcctgtgttagagtgcagtggcacaaccatggttcactgtaacctctgcctcccaagttcaagcgattctcgtgcctcagcctcccaagcagggcctacaggcatgtgccatcatacttggctaactttttgtatttttagtagagacaggttttcaacatgctggctaggctggcctcaaactcctgtcctcaagtgatccacctgccttggcctcccaaagtgctgggattacaggtgtgagccaccctgcctggcctaatccatgggtttcttgcccctgacattttggagactcttcaacccacattctttggaggggctggcatggaacacaggaatctgtctctgctaagcaagcctctctgggaaggggaaaaactgtataaaatccagttttctggtaagacaggctgaacattcacgcacaca

SEQ ID NO: 2308 - DNA, 1064 bp, Homo sapiens
aggtatgtgcatgggagggatcgtggttgggcagctgtgccctaagggctacctctataatggggactgccctgccatgatgccagttggattgcaagacatgggaggctgattctgctctagcaggattttatttacttgtttgtttgttacttattttgagatggaattttactcttgtctcccaggctggagcgcaatggcgcgatcttggctcactgtaacctctgcctcccaggttcaagcgattctcctcttgcagtattttaatggtgttttggggataggattcattccaatagcatttttatagacaaagtatgaaaatcaacattttagtgggattctaatatatacaacagtttcgtgtaggtgattctttttgcattattcacatcttttcattgcctgtgcatcatgaatgtatatagtagagttgcttgtacttggggagaatcaatgggtaatattaagatgggtagagaacatgaggctcatgtgagagcgtgtcctgtgatgtcttagaacagtattaagtgtcgtctgcctgtactgtttggcagtagggaaacagtgggggatgaatatgggacaaatttttctgccccaaggtggctttggagaccactgttaaattcatcatagtctctcaagtaaatggggtttacacagcactatcaagtatttcctgaagcttctttcagcattttccaagttgaagcagcttcagtctgtggtaagttcccaaacgaatcccagcaaacaggctttttccaaagggatcaaatagcacttaataaaaacataactgtgtctatgtatgtagccacacatgcacaaaaaagaattccattggtaaatgctgtaggtcatgttggaaaagaagcccctttttttcatttgttaaaactacctcttaaaatagtctttggccatgtattccttataattggactctgcccagaggtgagggtttgaagcaaatttatgtggctgttttctgtgggtagtaggatggaaaaatagtaaaaatgaacttcacatttctctggttttcttggaac

SEQ ID NO: 2309 - DNA, 1020 bp, Homo sapiens
gtacctggagcttccagactctcactgttgattagtagctggattttcactgccttgagctccaaagcatcaagacagccaaatctaggttccctagtttttcctgagtgtctgatgctgacgggtactgagtatcagtttcttgaacctatcagtttcttctttggaagtaggagaaaccaactttggatgatttatgcagaaaataagattcattaaaaggaaaatgagtagctcatagaatcacagggctctgaactcagaggactgaatccaggctatgcagccaggactcaaaccccacaatatgccacagtttgtgaggatgccaccccctcctagtgtaacttgaactagccactgcgtgctgccactaatgtcactgccactagagtgtgcttgtccagtggacagggcctattcaaagtgcagaggaacctgcagggactgtgtgatgtggatggagggtaaggaatgaggaacaggagagggactgtggtcaagtttcacaaatgcccatgttgattttagacagcagcagcttgttgaatggcttgagaatctgagttgcaaatgaggcctcatgggagttacataggaaatctgaagcctgctgggcccagagggacagaaaactcagtaattttttttatagaggtgctggtctgaatgtcaagtgtctttgccaaaagagaccttgctcgcttttccaatcaatctttctctgcaccctctggctgtcaagtagttacctaagtgagttttttggtggttattctacaaatatgataatttttcaaattatttgcattttaatgtcagtgaaagtcaagcttgtctttagattttgacaaggatagccctatggctcaccaaagatattagttcaaattgttctttttaatagtatagtgataatagtaatatattttcgtcaccatgaaagtggaaatgattggtagttggaaaaagtatttgttcattgacatcttctccaatttgtaattaagagcaacaaat

SEQ ID NO: 2310 - DNA, 1050 bp, Homo sapiens
tgttttgaagattaaataacctaatgcatgtagagcaggtggtatataatagatgtttacaaatgttagctttaacacttgtgttattcctatgctctgtggacatgatagatacttttttctgaaattttctttcttttctagattttgacccatagtcttatggttggtgtggagtctcttttccttagtccccctgccatttcagattgttgttttctacgtgatggacttgttgctgtgttcctcttatcgcttccagagtgtaacaagtgacaggattgagtttgcaattgaaaacctaatggaagaacctcagggtcagcactggcacaaccataggagtcggtgccttattcatgtggctcattcctttttattttttaatttttgagacaagttctcactatgtttcccaggctagtctcaaactctgggctagatccttccgcctcagccccccagtagttgggatcacaggcttattcattcttaaatttcatctctataggcaaaaaaaccaagacacaggtaggggaagagctcaataaatactgccatatctaatgttgccattcaaaaggaggtagttagcactcaacatcctgatttttcatagtaacttattacagatgctgaatttatcaaagcctctctaaatacattttatttttggtctagtttgcttcttggagtaagaaatttcatatggttattgcaaggaattgcaaggaatgaattgcaaggaattgcaaggaatgaattgcaaggaattgcaaggaatgaattgcaaggaattgcaaggaatgaattgcaaggaattgcaaggaatgaattgcaaggaattgcaaggaatgaattgcaaggaattgcaaggaatgaattgcaaggaattgcaaggaatgaattgcaaggaattgcaaggaatgaattgcaaggaattgcaaggaatgaattgcaaggaattgcaaggaatcgcaaggaatcgcaaggaatgaattgcaaggaatcgcaaggaattgcaaggaattgcaattgcaaggaattgca

SEQ ID NO: 2311 - DNA, 1057 bp, Homo sapiens
ataaaatgctgtcttttgccatagtctgtatttcctatgttgacctgagacttcctgggcccatcctccagcggcatgcattccaggttctgtgtttctttaaaatgtaaatgttgccatttttgtgtgtattgaaagactcagcattagaatccaagaaggaggttgtgtttctttattgagtctagtggataagagtgagtctgacgaggagggaaatgtggtgaacttgcctggttggagtccacacttcttttcttcctaacttggcctcacctcaggtgtttttttttttttccgttttttttgtttgtttgtttgtttgtttttgagacagggtcttgctctgtcactaaggttggagtgcagtggctcaatcagggattactgcagcctcaacttcccaggctcaagtgatcatcctgcctcagtcccccaagtagttgggactacaggtgtgggccaccacaactagctattttttttgtttttttttaattttagtagagatgaggtctcgctatgctgcccacactggtctcgaactcctgagtgcaagcgatccacctgccttagcctcccaaagtgttgggattacaggtgtgagccactgtgccgagctcaccccagttcttattaactaggcagacccttttgagtcctggccaggccctggcaaggctgtgtactttgtgttaggcttaccttgccatccatcatgctgtaccttatcctggttttctggccttcatccctctacctttaatgcaggaacttctggatctcttcttgcacaggggttgctgaggaagacttagcagtgccagccaagcctcctccttcactctgcctaactacatttattgtgatatgatcaccctgtgtttttgtgggatgcatcttgcaagagtggtttatcagagtcctaaccaggaagtaaagccagagcctctctgattgggtttttacctccacctacatgacagacttccctttcaggatgccatggggtgacctgagggcaggggaagctagaacatgggactgaataatttca

SEQ ID NO: 2312 - DNA, 1054 bp, Homo sapiens
tgaaatttgagctgctacagagggcagaacccggggcccactgtgttctttgagcacagagcccagcgtgtgagcacctggagacatcaaggtgcccggccattgtaaactgctcccagccaagcaggcagtcccaggcctggccctgcctatggaggctcccgcaactcagtgcccttgcctgtgccctccaagggggctgcagaacacccttcaggctggtgcagtattaactgcctcactcgtgtagatctataagaaaaaggcagcagcctgtaagaagaatggggaaagggtacagagagttctcagaaaaaggaaatgcaaatgtctctgaagcaaatgagaagacactcaacctcactctgcaaaagagaaatgcaaattgaaagtaggacaaggtactacaccaggttggcatagatcaaaaattttacctcatagattcctgtagaagtataaagtgccagctcctctagagagagcagtttggcagtatctctcaaaagtgacccggcagttccacttctaggactttgacatccagacataatttcacacatgtgaaatgaaatatacaaggatatccattgtaatagcaaaagattggaatagacataaatgtccactggaggccaccaggtgaatcacttacggcatatccattctgcagaattctactaagccattagaaagatcaaaacagctttatacatacatacatacatacatacatgggacaattcccaagatatagaaccttaaaaaataggaaggaacagtgtgtgtagtacttaggttcaaaaacaatacatattttagaatgaaaagtcaactaccagctgggtgcagtggctcacacctgtaatcccagcactttgggaggctgaggccggcagatagcttgagcccaggagtttgagaccagccttggcaaaaaatcatacaaaagttatctggatgtgatggtgcatccctgtgctcccagctacttgggggagaggggtgctgaggtgggagaattgcttgagcctaagaagttgaggctgtagtg

SEQ ID NO: 2313 - DNA, 1031 bp, Homo sapiens
accttttgtattttatattatgcattatctggtcaaaaagagattaaattttttgaaaaaaatcttagtcatgctggaggccagagcagctgaggtgctggggcaggagctggagggcagaccttctgcttgttgagggagggtcttcatggaggatggaaaccaccagaaggtgtgcctgtgacagtggaatagtgtgacgggaatagtgtgacagtggaatactgtgatgggaatagtgtgacagtggaatagtgtgacgggaatagtgtgatgggaatagtgtgacgggaatagtgtgatgggaatagtgtgacagcagaatagtgtgacgggaatagtgtgatggaatagtgtgacggtggaatagtgtgacgggagtagtgtgacaggaatagtgtgacagcagaatagtgtgacagcagaatagtgtgatgggaatagtgtgacagtggaatagtgtgacagcagaatagtgtgatggcggaatagtgtgatgggagtagtgtgacagtggaataatagtgagccatggttggcctttcccttcatgcactggcgaccaatagaatcaaggcagtccccatttctacacgtccttagccctgtctgttcctgtgtcctctccaccggctctcagtgttctagaacccacaccatgaatgcctgggtccctccctccactaaactgtagctctccaagggcagaagccagttctgtcatcccatgtgccctggctcttggcatagtgcccagcacacagaaaaggcataataaatgttgaatgaatcattcattaacatcaggaaacaccctggggttctgatttattgttttacatcagattcttttctccctaccccaactgaaaggcagccttttaatcgctggtatcccagcacttagcctactgctctgtatatagtaggagctcaataagtgttgaatgatgagagtcgcatgatggttagtttatcttcagatcagattgttcccagccaaatggcaagaacagagccatatcttcccc

SEQ ID NO: 2314 - DNA, 1026 bp, Homo sapiens
aatgcctacatttcacagtcattcgtttcttttaacacacacaattggattgacaaaggtaatgacttcctagctagccatattcaaaagaaatgtcaaaaatttaaatttataaagctctctgtgaaatgttgtgatgccccaatcaaatgaccctcctgatcttgcccggcaccctttccctcttggctgctggcgccttcctgtctcattgccaaggacaagccacgtctgcatgtctctatcccacccctcaccacttagaattcttgaaacctctggggaggctgaccaagaaggacagaggaccctatatttgggcttctggaacctaagtgccccagggctcagagctcctattagtgttatttcacatttactacaagtttaaaaaaaaaaacacacaacggtgatgatgacggtgatttttgtgtcttgtccatgaatcacacaatattattctagggggaaacgtaccctgatttcaaacaactcatctaaaagtacagattttggaacatgacctacatgtttacagtgccacatgagactacactcagactcatggacttttttcctttttcaattactaactgctttagtcctctaaacgtggattcttctttttttttttttttaaaccaatactgggtctaactctgtggcccaagctggagtgcagtggcacactcatagctcactgtaacctctaactcctgatctcaagtgatccttcctccttggcctctcaagtagctaggactacagaaacatgccaccatgcctggcttatttattatttatttatttatttatttatttatttatttatttatttatttatttatggtagagatgaggtttcactatgtttcccaggctggtctccaactcttggactcaagtgatcctcccacctcagccttccaaagtgccgggattacaggtgcctggctctaaacatggattcgttaaaagcttgccctatttctttttttttttttttttttatactttaagttttag

SEQ ID NO: 2315 - DNA, 1027 bp, Homo sapiens
caggttagttacatatgtatacatgtgccatgctggtgtgctgcacccattaactcgtcatttagcattaggtatatctcctaatgttatccctcccccctgcccccaccccacaacagtccccagagtgtgatgttccccttcctgtgtccgtgtgttctcattgttcagttcccatctatgagtgagaacatgcggtgtttggttttttgtccttgcgatagtttactgagaatgatgatttccaatttcatccacgtccctacaaaggacatgaactcatcattttttatggctgcatagtattccatggtgtatatgtgccacattttcttaatccagtctatcattgttggacatttgggttggttccaagtcttagctattgttaaccaacttaattgacgataatattttgcctattttgaaacctaaatagaatatttgaggaggaaaaaaatcactgaaatgttactttttttaaagtcattgaagtcatattttcaatttatttactcagactaattgaattttattattagaataaggataaacatcactttctgtaagttcacttactcattttctgcttaatagtcttctacagaagcatgctaaacctaaggacacaattaaaactagctaccatttaaacttaggagggcttttcttatctggtaaaagctaatcttatcaatcaaatgtagattattagttattgggcattttttacagggaaatactgggcctctgtcattcaacattatactgctgatctattttattcttatttataagtgttgtgctgttgtgtgaagtttttcacatcagtataattaggtgagaatataaacattaccttgggaaaaataatagatgaaaagttttttttgttttgttttttttttgttttttttaggcagagtcttgctctgtcccccaggctggagtgcagtggtgcgatcttggctcactgcaacctccacctcctgggttcaagcaattctgcctcagcctcccaagtagc

SEQ ID NO: 2316 - DNA, 1032 bp, Homo sapiens
aaaagtatgttcaagtcttccatttaaaagcgtttctctggccgggctcagtggctcacgcctgtaatcctggcacttcgggaggccaaggcaggcagatcacctgaggtcaggagttcaagaccagcctgaccaacatggagaaaccccgtctctactaaaaatacaaaattagccggggcgtggtggcacatgcctgtaatcccagctactcgggaggtcgaggcaggagaattgcttgaacccaggaggcggaggttgcagtgagctgagattccaacattgcactccagcctgggtaacaagagcgaaactccatctcaaaaaaaaaaaaaaaaaggcatatgtcttaaccactctagaaaacaaatcatccttcttagcactacgtcacttttgagtttgctttagtcaggcagcttctgtcccaccacttcactgaaactgctgacaggttaccagtaatttcctaaatgccacatccagtgatcagttgtattctgcttgtgctttctgtatcaaattactgactgctcccttcctgaaaagctgtctttgactttcgtaatgccattctgattcccatctacctttttaaccattgtgtctcaattttagtggcatctttttcttactctattccttttatcattattctttttaattctgtctctcaaaaaactgtgagatttgatctctctgttcttctctgtgtgactgccttcttcttaggttctcgtctcctctgaattatcctaacagttttctctccgattatctccgtgcctccctttccaggttctccacaccaccctttccagtccattgactgccctgttgccaaagcaatcctttgtaaagttgctgattcactgcttgcaatccttacatggtgtcgtctgtaggataaaacacaaactctccagttaggcattccttacccttccccatttatttcagattactaacagtgttttagatatgtcgtttagttccctggcttttgtcctatgattatgttggtcccttttt

SEQ ID NO: 2317 - DNA, 1094 bp, Homo sapiens
gaacatatgtttacctaatttttcctatctcctttttcttttttaacttttttagatttgttgtgctcttttattactgtttctttatgtctctcatagtttttgtcctattctcccctttctcttttcctttttactgtttttcctttgccttatcaccaggttcctaaccttgaggcgtatccactgtctactaccttgcctgccctgctgtccctttttaatctcctcatctggaatacagtggttcgttttaggtttttctctccttaattctaactccgtttttttactttttcatttctcctctaacaaattttttttaactttgggtttttgtttcattcttcattctgagtacttgcacctccttacttttggtgagaaagctggtgttacctagaacctctgtgtgctatagaaactcttattgctaagaccataagtgaggtaagacctaaacgccccttctcaaaggaagccctctttctgttttgcccaacatgcctcggtattacaccaagccactttatcttggcagttccttctgcaaacccctgcatgctggtgtagttatttctgtccatctactgtcaaaggtccttgatttaccactcagtgggtatacactaatgaagtctgattagatatttgctgttgtaatattaccatactgaaaatcctaaatttaggatttttgtggggagaaatattgggggtgtctggagaaaaaaatattcttaccaggatcactttctgcttcagaaattttaagaaatattttggctgggcgcggtggctcacgcctgtaatcccagcactttgggaggccgagacaggcagatcacaaggtcaggagatggagaccatcctggctaacacagtgaaaccccgttgggaaatgggaaactaatagactttctcatgttttgatatctctaattagagcataaatgcgaatgttgttccttcttgcaaattggtacatttccctttcattatctttctgcatgggtaaaaggtaactcagaatatatatttttaatctttctaaaaatggaatcttcatgaatcagagttgtagtaatctcatg

SEQ ID NO: 2318 - DNA, 1020 bp, Homo sapiens
aattatagtacaaaacacctttttaaagtgtgtagaggctagaagcatggtatacagtatttgcattttaattataagccacctcttaaatatattcatttcctagtcattactgcttaaaaaaaaatgcttcccaactaaaatttatgctactttaggataaacaaaattttttccgattgtataaagatgtcaactttagttattttttatataattattttttatatttagttattttttataattactaccttttaatataaaacagaaaatgacagaactatgttcaggtggcttatgcttatagtaaaagttaccttttcttgtagttcattcacctttttaagataaatgaagttgcaagtctagaaattgtcttctctcttgtactaacaaaaagatagaagggtttgtaaaggagaaaaagtagatttggcagttgattaaaaataaaaggatggtaacatagtacatgaatgatcaaaaggaagtggaacaaggagatgcatatcttttcatctgaaaagcacccttttgctttagggattatttttctattataacagacaccataagaacggaggttcaaaagtataattgtcagccctctgatacacttacattaaataattaatgattcaaaatttccagcatttttgtaatggaatgtaacttataatgtgattttgacttttagccccttccatgtatacatcagtcactgttctgctgctattgctaccttttctacctcttaatatggaattcttgaagagatttacaggaagtggaaagaaatacacgctcccaaatggcttgagtttaaaacatatgtcttaatgatagaaaagaatcatatccctggagtttctagatgttattgtattcctattatttcaaaaatatatttttgaaaaattaatgtttcccagttaaactaagtacatgttcactttaagaaattttgctgtgaaagccagaaaaaaaatcctctgaaatttcactacccataagcag

SEQ ID NO: 2319 - DNA, 1614 bp, Homo sapiens
cacagagaaaattatgaaatttgtcacaacacactagggcaagcagatgaagctgctcttgtccaaatgagactgccaaggagctctagctattccagaccctgtccagccatccttcaggatgaggggattagaacaaatgtggatgagaacaggatgagaacaaatgtgcctagatatttgttggaatatctaggttggaatatctgaggttggaatcctcagccaaactacagaagtctacagtgtggtctgagctttaagagtttagactggcatacatgagttaattataagcatattatagttaattataagcatacctgggtgagttagaaaaagttgttgacattgaacatctctagaaacactaaagctcttacaggaagtagttttgagtttaaggtgtataattttacaaatgtaacaatattgatgacaaggtaaagtccattgaacaagggaaaattaagaagtggaagatcaaaaggagtatagtcagaagaaggggcacttatttaatggaatcagacttggggacaacttagagttttggaatatattttgcaaaataagtgttctgaggtttataatatctttagacttggagtcagagttagttttaatgtgacttcttcctaggaatacagtctaatcctagacttatttaaggttttcacttctaaactcgtgtattcagtaggtttggccattgctagaatgtaaattaagcgtcccttatgaaaattagtaactgatagaacactatatttggtttctaattagtagttattcttcactgcagcaaactcaaatttagaatttagaaatggcacagagactcacccttataagagttgctattttctaaaatgtaaaagtagtagagaagtacttgaatatataacagtaactcctgtgaaataaccttggatttttattaccaaataaactctcagtggaatctagtcactattagaatttatacttaactgtgaagttcaaactggaaatcaacctcatgggtttaaagggagtataaattcatttatgctgataaaacattataaacgatgtctatcattgttactttattgtcatgtacatgtattttcctttgagaacacagcaaatgagcatagcttacaaacccaaaactctaccttaaaaatgggatataattagaggataataatgtcagacctcctgtccagaatgctcttaaaggaattccccttagagtcaagcccagctagtttaatgtagtcagaaatgcttatttccaaattctcaatttaaaataaagcagaatttaaaagtgggattgttacatcatgatagtgctttagggtaattgagtatttcatattaattggtattggtaagaatagcatttctgctgggtattaacatatccatatattattctctcatctgtgatcatatacatgttattaatttaagcccccatatttttgtctcctttctcatctctttcattagtgagttactgttttctggtatttttaaaagcagttatcaaattataaaaattttcagcaacttttctattttgagctaagtgcatctccttctagaatgagtctgtgaact

SEQ ID NO: 2320 - DNA, 1060 bp, Homo sapiens
tactgtatataaatttcagtaaattttactgaaaaattttttaagaaaaaaaccaatagtctagaatctcattttaaaaactcaccccgacctcagtaattcctccaaccactatgccatttttctgctttcatggtaaaatatagtttattgtcttttatttcctcacttcccaattcactctttttaaaaaacttttaaaaacatttagcaacataatatgtgcacatgattaaaagatcaaattgcatgtaagagttgataatgaaaagcaatagtctccatcccacctgctttctcctctttctggatccacatccctagagacaaacaccgtaaacattttttatgtttagttattttggtgattgtttctgcatttctaaatagtatgcccatactgttttttctcagtcaaatttatttattgtcctctgagtttctgctgtgatagatgagggctcatctcaattttaacagcctctgctcctgctggctgctttctccacagatttcataaagtgtttttattttctcttttgtttactcttgtagacttaagcaattaatatatataagcacatatttcttgttctatcactatcacaagttttatcactctctcttgatttcataggatattagcattcctttcccgctaccttttctttttcttctccacctttcgtgtcctgacagctctgcctttacatttatagcattataattggataagttaacttttgttctataactgttatgaacacttcagtgttttcctctgtaaattggattcacatgttaaaaaccaatgaaaatagttaggctcagtggctcacatctgtaatctgaacactttgggagacttaggaaggaggatcgcttgagccctggagtttggagctgtcataagctatgattgcaccactgcatttcagcttgggcagcaaagcaacaccctgcctaaataaataaataaggtaaaaataaataaaatgaaaaaataaaaactcaaaataacattttattgtgactttataaatattattcattgcaagtc

SEQ ID NO: 2321 - DNA, 1037 bp, Homo sapiens
gcagtagcatgatcttggctcgctgcagccttgacctgctgggctcaagtgatcctctcacctcagcctgctgagtagctgggactacaggtgcactccaccatgcctggctcatttttgtacttttggtaggggcatggttttgcgatgttgcccaggctggtgtcaaactcctgagctcaagtgatctgcctgcttcggcctcccaaaatgctggaattacagatgtgcaccaccatgcctggcaaattaaacagttttatctgctatttgtatcttgtaagattcttccaacaagcataataaagttgattaaaatatcaattattttaatccttcaaattctttaatcagtaaaataatttttaatgttagagctgaaacttccaaatctttttaaacttttagatgctgccaagggaaaaattaagaagaagagaagagagaaaacaaataaatgggaaaaaagaaaggttagtaattgtgagtaatataagaataagatttggctattagaggatattgtacgtattaattaagaaacagaatctataaggaatttgaagagataaaagtcaaagattggttaacatggtagttaacatggtgctaagcttatagtgtcctttgctgcttttcaaatacttctcagaaaactatgcagacgggtaaaaccttataattacaattctttagattctttttaattttggtgttaacatagttataaaatagcctatgtgctttgaaataaatgcaagtaatagagacataaattaaatgaaaggtaaaatagctacactcttttctctttatttaatttccctatgggtatcactcaagtatttgctgtacaaccttagatttttcctctgtgcacatggaaataaataaaataaatataaataaatatgtatagttttatgtactatataatacacatataattttatgctaacaaaaatagtctatcaatttgcttctctaaatttatttcatataatagtttatgaactatgtgtaacatatataaaaca

SEQ ID NO: 2322 - DNA, 1035 bp, Homo sapiens
atggatcctaacaacgtgtgatgtctcccccggacgcccagctttaaaatttctcttttgtactctgtccctttatttctcaagccagccgacgcttaggaaaatagaaaagaacctacatgattatcggggcaggtcccccgatatctggcgcccacgtggtctttcttttttcctaagtgcatgagggaacccgattccctttggtaggtgcggtgaaacatcaatcggcttggtccacagataagcgtgttcaactccccgacgagtggtgagtaatctgtgtaaggtctgggttaactatgggtcatttgtaatctaagaaactcctgttaaaacaggtaaccatgaaaaatatgatcactctattcaggacagtagaaaaatactgttcttggtttcctgaaaaaggaaccgtgtatataaaattgtgtcattttgttatcactctattcagggcagtacaaaaatactgtccttggtttcctgaaaaaggaaccgtgtatataaaattgtgtgattgtgttcgtaaagcattccgaaaactggtctcggcagggtattatgttcccatcactgtttggggtgcttgggccttggtgcatgccatcttagtggcttgccaatctcgtgaccccctgcagttgccgcagttttctgccttttcctcagtttctctgcctttttctcaaccttcctctaccacatggccttcgttcagactctcccttcagctactcctcccctacctaatgattctgaaaattcgatgtctaactctggtaactttggcttaaagttaccccctacttttcttacttcttctcacgaaaagccagtacttcaaactcctgcggctgcgactcacacagcccggtgccatagatatgctaattcttctctcttcaaacctccagcatcaactaatggctctgggaccaaactacaatttacctatcattctccaggccctcccccatccactacagcccctcaccctcctgtcgtttcagttcctcaaccggtctgcatcga

SEQ ID NO: 2323 - DNA, 1045 bp, Homo sapiens
cgctgggagctgtagactggagctgttcctattccaataaaattgttctttaatcaacacaattgataaacctttagctattctgagcaagggaaaaatatagagaaaagacacaaataccaaagttaagagtaaaagataggacatcactaccgactctatggaagttaaaagtattataagggaatattatgaatgactttatgtcaacaaattagacaacttaaatggccaaattactagaaagatgcaaattaacgaaactgattcaagaagaaggggaaaatatcaataggacaataataaatgaagaaaagtaatgtgactaaaatgaattggtaattagaaatcttttcaaaagggaaaacccaggcctggatggcttcttttaaggaagaaagattaccaatcctacagtatttttgggcggaaataaaaaggaaacaatttgtaacacattttatgagaccaatattactcagatatcaaaaccaggcgaacacatcacaaggaaggaaaattgcagacaagtattcttcatgaacatgtatacagaattccttaatgaaatattaggtaacagaatccagcaacatttgagaaggattaggcaacagaatgagaccatgccaataaaaaaataaagagaagaagtctgggcatggtagctcactcctgtaatcctagcactttgggaggccgaggcaggcagattgcttgagaccaggaattcgagaccagcctgagcaacatggtaaaaccccatctctactaaaaatacaaaaattagctgggtgtggttgtgcatgcctgtaatcccagcttcttgggaggcagaggcactagaattgcttaaacctgggaggcggaagttgcagtgagccaagatctcgtgttgctgcactccagcctgggcaacagagtaagactctgcctcaaaaaaaaagaaaaaagaaaatgattatataccatattccaggagtacgaggatggtttagtactccaaaatcaattaatgtaatatgccactttaataacggaaaac

SEQ ID NO: 2324 - DNA, 1058 bp, Homo sapiens
gacaatgaagatgaatattgttaacactgtagaaaaagtacctaaagacaacatgattgtctaggcctgtttgtgttgctataaaggagtgcctgaggctggttaatttataaagaaaagaagtttactttggcctggcgcagtggctcacacctgtaatcccagtacttcaggaggctgaggcagaaggattgcttgagcccaggagtttgagaatggcttgggcaatgtagcaagaaccgcgtctctacaaaaattttaataattagccaggcctggtggcacatgcctatagtctcagctactcaggaggctgaagcaggaggatctcttgtggtcagaagttcaaggctgtagtgagctatgattgtgccactgcactcagcctgggcaacagagtgagaccctgtctctaaaaaaaaaagaaaagaggtttatttggtttatggttctgcaggctgcacaagaatggcgccagtatctgcttctggcaagagactgaggctgcttccactcatggcagaaggtgaaggggcgcctgcaactgcagatctcatggtgagagagaaggcaagagagagaggaagaggtaccaggctctttcaacaaccagttctaggtgaactgttgtgggaactaatagagttagaactcactcattactgagagaatggcaccaagacattcatgaaggatctgcccccatgatccaaacaccccattaggccccacttccaacattggggatcagatttcaacatgaggtttggagagtcaaatatccaaacgatagcaatggtgaaaatgtgtgctgggcttattgaaggaatagaacagtgtacatttataaaagaacaagaaatcatcacagtttataatgtctaagagagagttctaaatcaaaagcattgttaatgaggcagatgactctggaggaaacattttaaaaagccatccagcagaaagccttcttatccttagaagacccacttcttggtctctcacctgcttctgataacttagaaaaatggtgtatagtaaccttttaatcaaaacac

SEQ ID NO: 2325 - DNA, 1047 bp, Homo sapiens
cgaccctgatgctcttcaattcggtgctccgccagccccagcttggcgtcctgagaaatggtgagtaacggtcccaaccgctgctcggagctggcggaattcatttcccccgaaacacacgccacctccgaccagggccgactccaattctgaactcagcttctgagttctcccatggcaagggtaaattagtgttagcagggactactaaagaaagctgtactttcatcccctcgggacacttgtaatcgtaatcgggcttttaaaatcgtaacgtaggcagggacgtcgaaataactgccttccaaggccccttacagcttacatctccattgcgcgttaacgggaaaatgcatgcatttgtgtgtatatgtttccttcaacggttatttgagatgctcaaaactcctaatcattgattaattcattcgtttgttgtagaatcttagtgagcccagctatgtgctataggtatataccagtgaatatgacccgctgttaaggaactcagtcaagcagagaagacaggatatctgcttctaacaggaacaaaatcttattttccccgtttactacacggtcataaaaatttaaattatagagtgaaagatgcctgtaaccacatccgccagagatgacccctgttaatagattgaagtatattattccagatgttttcgacgctagaggtaatacctattattttcagaaatcggatcaaaacgtccagttttttcactttaatggtataagttgaacgtattcccatgttaatacgtagaaatctaacttattttcttacgctaaaacattggcaataagagatttgaggttagatttggatgtcatcaacttaaactttttggtaagtttcagataagggagctaactacccagattaaccttggacagaaataaaatctcactcatgtgaaggtcgactatagccagaggttctttttccccttgaaactatgtggaaaacgaacctgagaagggaatttttatattcagcgatgagtctaggaaaataatattgagaaagag

SEQ ID NO: 2326 - DNA, 1115 bp, Homo sapiens
attatctctagcttgtccctgaaagtcaagagtctttgataagtttttctgtaatcttgcacataaggtaaagatttataaacagctacaataccattgttcaaccttgattgttcattgaagttaaaaccttgtactgggcactcattaactatttgtaaaacagagttactttaactctgcttgtaaaatctaaatgagctataaggctgataaacaacataatttttttctacctaaaaatttatcatgtatttggtttaaatggcctgttttttgttttttgtttgtttgtttgttttttgagacggagtctctgtcacccaggctggagtgcagaggctcgatctcagctcactgcagcctccatcccccgggttcaagcaatcctctccctcagcgtcccaagtacctgggagggattacaggagcctgccaccacgcccagctaatttttgtgtttttagtagatctggggtttcaccatcttggcgaggctgatcttgaactcctgacctcgtgatccacctgcctcggcctcctaaagtgctgggattacaggcatgagccaccacacccggccaaatggcccaattttctattatgttttcaactattacttaaaattgattttcctatgtttatattgttataatggacaaggaagatttaagagttatataacacagcacagtactgtagcagctagggaaaaacttatcagtggtgtctgaataagctcttcatttctgtttttgtttgtttgttttctccttccatttgtttctcactaaataattttttttaaatggaccaacaaacatttctctcaaaggagtctctgaagtaatctgactttaatctctgaataatagtgacagacattacaatctcctttatcactaaaaaaaaaaaaagtactctgttttaaaaatcaaatgttttcatttattcacctgagccatttaggaggttaagctggtttggactggttttttgtttgtttgtttgtttgtttgtttgtttgttttttgagacaaagtctcactctgttgcccaggctggaatgcagtggcgtgatcttggctcactgcaacctccacctcccaggttca

SEQ ID NO: 2327 - DNA, 1026 bp, Homo sapiens
ttcaacatatcaaaaagtgaacccacaattcctccctgaactcatgatttctccctggcaatgccatctttttcctctcctctgatatcatttccttgaacaacgtatttaacttttcttatagtgtgagtctgatggtaataatttaccttagtttttctttacctgaaaatgtccttatttcatcatcattctcgaaggacatttttgttggatatgaaattcttttttttttttttttttttttttttttttttttttttttttttagcccagaggtcctttattttttttttttaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagaatgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccgttcccttgatgtctacaatatcacctttcttatagattcgcatatatgtggccaaaggaacaactccatgttttctaaaaggcctagagaacatatatcgggtgcctctcctctttccctttgtgtttgtcattttggcgaattactggaagatggcggttccggccgaaaagaagctggatatgaaattctgggtcaacagcttttttttcctttcattgctaaagttgttccactatcatctctgctttcattgagaactctgtggttgttaaaatcatttccctgtatataatatgctgtttttcctgactattttcaggattttttgtctttggtttctagcagtttgactgtggtatgtctagtc

SEQ ID NO: 2328 - DNA, 1030 bp, Homo sapiens
ccccactctgcatgtcagtactgcagcatagctgctgctgccccttacctgagcattccactggaagcctggggatcaccccacccctgccttccatagccagcacctgcatgcaccaccagggtcactgagggcagttccacctagcctggcttcatacacgccactacccaagcacaccctctgggaggcctgaggattgcccagttcagttcatcaccagtggtgcctgagcactcctcctagagtctaaacttgggcctactcaatctgctgctaccaccatagctggcaccaacctgtacatgcaacctgcaagtctagggactggcctgcccaacctgtcacagccaccgccaacactagtacggaacacttgggttccaggggattttttcatcactgctactgtcatcatccacaccactccacacctcctgcccaggggctcaagaatttgcccacccacctggcccactgctgccatttccaatacctgagtaagtcatctgaaggcccaagaatctacctgcctggatccattaacaccagtgccagcgtatgctgccttggggccaaaggacacacaggctcagaccactgctgccaccactggggcctgaagactggcccacctggtatttcaatttctggcaaaacttaaccagtctgcactaaaaaccacactctaatctaccaacgaaaccagataccaatgactctatggccaaaagaaatgatagagactatgctactgcttgcatccagaaccaaagccaagtgtcctctccaaccatcaccatagatacatcttcaggaaaatgttctccactacaaaccaaattcaaaaaattggaaaaagcaactgttacaccaggtgcacaaatatcaacataaaaacacagagaaatcaaaaagcaaggatatgtgacacatccaaaggaacacagtaattcttcagcaacaaatcccaatcaaaaaggaattctcaaaatcctggaaaaatgatccaacatactgatactaagga

SEQ ID NO: 2329 - DNA, 1770 bp, Homo sapiens
aaggatgggaattctccctaactcattctacaaggccagcattattctgataccaaaaccagacaagcacaaggacacacacaaaaaaactacagaacatacggacatagatgcaaaaatcctcaacagaatactagcaaactgaattcaacagcacattaaaaaaaaaaaatacaccatgatcaagtgggatttatcccaggaatgcaagaatagctcaatatagacaaatcaataaacatgatacatacgtcatcaacagaatgaaggacaaaaaccatatgatcattttagtagatagagaaaaataattcgataaaattcagcatctcctccgaattaaaaaactcaaccaactaggcatggaaggaacatatctcaacataaaaaggctgtatatgacagactcacagttaacaccacactgaatcgaaaaaagctggaagcctttcccttgagaactggaacaagacaaggacgcacgcttttcaccactcctattcaacatggtactggaagttctacccagagcaatcaggccagagaaagaagtaaaaagtatccaaactggaaaagaagttgtattttccttggctgatgttatgatcttatatctagaaaaacttaaagactctacaaaaaaaaaaaaaaaaaaaaaaaacctcagatctgataaattcattaaaagttgcagaatacaaaatcaacatacaaaaaaaatagcatttctatacatcaataatgaattagctgagagagaaatcaggaaggcaatcccatttacaatagctacaaaaaaataaaacacttaggaataaatttagccaaagaggtgaaagacctctataaggaaaagtatgaaaccgatcaaagaaattgaagaggagacaaatggaaagagacctcatgctcatggatgggaaaaaattattatttttaaaatggccatactaccccaagcaatctacagattcagtgcaatccccatcaaaataccaacatcatttttcacagaagtagaaagaacaatcttaaaatttatgtggagccaaaaagaacccaaatgccaaagcaatcctaagcaaaaagaatatagctaatataataactaaaacagcatggcataaaaacagacacagagaccaatggaacagaatagagaattcagaaataaatccatatatttacagccaattgattttcaataaaggtgccaagaacctacaataaacggtgctgggaaaactgggtatccacatgcagaagaatgaaactgtacctctatctcactatattaaagaaaatcaagataggccagacatggggctcatgcctgtaatcctagcactttgggaggccaaggcaggtggattgcctgagctcaggagttcaagaccagcctgggcaacatggcaaaaccccacctctactaaaatacaaaaaattagcttgacgtggtaggcgcgcctgtagtcccagctgcttggaaggctgaggcatgagaatcgcttgagcacaggaggcagaaattgcaatgagccaagatagcaccactgcactccaccctggttgacacagtgagactcagtctcaaaaaaaaaaaaaaaaaatcaagatggagtataaagacttaaatgtaagacctgaaacaatagaactactagaagaaaacatagggaaaacacttcaggatattggtttaggcaaagattttatggctggccaagaactcaaaagcacagacaacaagaacaaatagataaactagac

SEQ ID NO: 2330 - DNA, 1030 bp, Homo sapiens
cctctgtgctccagttattcatccctacctccctctaagccctggcaaccactgatcttattacttcccccagtcacatttcctccatgtcattttatggctttatcaagctcatttctttccagtgctgaataatattccattgtctggatgaaccaaagtttatccattcacctactgaaggacatcttggttgtttccaagttttggcaattattaaagctgttataaacatctctccctttttatacattatagtctcaccacaggagatgtagtgcagctggctctgctggcttctaatttcaccaacttggtcaaaaattacttaatattgaagttttatttacacatgttatattcagcatgtaagaatcctgaaacctaaatttccttggaatatctttcagatgggttttataggcaagtgaatcaaatcagtggagctcacaatacctcagacaagcaaaccccttcaaaacccaagaagaaacagaattcaaaaggacttgctccttctgtggtaaggttttacagatgtatacatgtgtgcagatcttatctgtaggatagaataaatgggaggctattgattaagtgaatgagaatcttcatgattctcatttgatatcagtggtttattgcttattcagtacctacatttgtggttctcaaattttaatttttggttcttctgaattataatgccatttacctatattattgatggaattaaaatatatgtagcctcgttgataaatatctttaaatttattttggttttaaagaattagattgaattaaacataagatgttgtctcatgccattaagcagaaagtggtttttttttttacaatttcaatatctacattttaaaaaattgataacataattttacatattttggggggtacactatgtataatgatcaaatcagggtaattgagatagccatcacttcaaatactgtgtgcatcagagttgcctgaggcacatgttgaaaattcaccttactcatccctaaaaatc

SEQ ID NO: 2331 - DNA, 1028 bp, Homo sapiens
ttacatggtgactttattttaatagagagtatctcctgaaattatgccctttggcctatatttagaattctctcaattttttatttaataagctgtggagtagataaagtgcttctgctcagcttttttcctctttaggggctgctggttaaaattagggggctgaaattttcatacccccaaaatagtttcagcctatctcagccttctccttaatgttagaggcccttttatttctagatgttttccccagcctcaccttttttttttcctcaaaactttaaaaatagaatctgatacttaaaactaataaataaatgatagttttaaaaagaaaacccaagtttctcaagcatgctttcctcttttttttaatcctctcccctccctcttccaaatcaccagcctcaggcatgctttaagagagttatttgggttacattatttttaagaacatcaatttcttaagcaacatcttagtagcctggttattcctcatctatagatctttcaaaaacactttgaattccataaccaatcctcagagttacccagtttccactaaagtaaaaagtgctgataaacaagaaatctcaagtacagaacttgttttattttatttatagatagatgtagatatagatataaatttttttttttttttgagacggagtttcactctgttgcccaggctggagtgcagtggttcgatctcggctcactgcaccctccgcctcctgggttcaagcaattctcctgcctcagcctcccaagtagctgggattacaggcgcccgccaccatgcctggctaatttttgtatttttagtaaaggcagggtttcaccttgttggtcaggctggtctcgaactcctgacctcatgatccacccacctcagcctcccaaagtgctgggattacaggcgtgagccaccatgcccggcccagaacttgtcattttagctgagatcttacagaattttccaaagatcaccccaagcaatcttattaggactttagtatcggtgg

SEQ ID NO: 2332 - DNA, 1031 bp, Homo sapiens
ctttcaaggagttttgttataaaggaaagaagagaagtgaagtggtagctggagaaagaagcagggttgaagtttgctggggtttttttaaataggaatataacatttcacagtgattggcaggatcgtatagagagggggagattgatgcaggggaatttgctggagcaatgttaagcatgaggggatactatctgatacacagtaggagggtaggcctttgccaggaacatggatagttgacccatagtaattggagaaaaggtggaatatataagcatggtgcaggtaggctactgagagatggtggggagagaggtggagagatgagatggccataacttacagaagcttccttctgttctgatgttaaaacatgaatcagggttattaactgcgaatgaggataagggagaaagggagtagagattttagaagagataagaaagtctgaaattgtcactgagagaatagaggaataaatggacaggaaaatatgattgttgggcttcaagagtcaacttgaggctagcaataattaattgaaagtgagcactccacatggttgtgtgtttgctatgcaagtacaagtatactataggtagagagctagatttaaccagggatgtggtttagcaatgcaagtgaagaaggaagttgacagtggatgcaaagaggatgattatgactataagatataaccttggtaaggaggcatattagtccattttcacactgctgataaagacatgtacaagacttggcaatttacaaaagaaagaggtttaatgacttacagttccacatgactggaaaggcctcacaatcatggcagaaggcaaggaggagcaagtcacattttacatggatggcggcaggcaaagagagagattgggcagagaaactcccccttataatattgtcagatctcatgagacttatttgctgtcacgagaacagcatgggaaagacctgcccccattattcaattacctcccaccaggtccctcccacaacacatgggaattcaa

SEQ ID NO: 2333 - DNA, 1026 bp, Homo sapiens
ccctttggagttgacttccaattttattccactatggtctgagagagtacttgatataattttgattttcttaaatttattgagacttgttttgtggcctatcatatggtctctatcttggagaatgttccatgaatgttctgatgaatagaatgtatattctgcagttgttgggtagaatgttctgtaaatacctgttaagtccatttgttctagggtataagtccattgtttctatgttgacttactgtattgaagtcccccactatgagatgagattctatttttgtgtatttcaaggttttgctctaagatttagaactccttttagcagtttttgtaaactatgctggcttggtagtggcaaattctctcagcgtttgaaaaagactttcatcttttcttcatttatgaagcttagtttcactggatacaaaattcttggctgataattattttgtcagctaataattatttaataaggctaaagataagacctttatcccctctagcttgtagagtatctgctgttaatctgataggtttttcctttacaggttacctgatgcttttgcctcccagctcttaagattttttccttcatcttgactttagatagcctgatgactgtgtgtctaggtgatgatctttttgtgatgaatttcctgggtgttctttgagcttcttgtatttggatgtctagatctcgagcaaggccagagaagtttttattcttttgcctttgtctttgttgaattgggttaattcaagagccttgtctttgagctccaaaattctttcttctacttgtttggttctattgttaaaactttccagtgtattttgcatttctctaaatgtgtctttcatttccagaagtcatgattgttttttatttatgatatctatttctctggagatttttttcgtctacatcctgttttgttttatttttaaatttaagttggttttcatctttctctggtgcttccttgagtagcttaataattgaccttctaaattctt

SEQ ID NO: 2334 - DNA, 1061 bp, Homo sapiens
tggtcttgtaatttatttgaagctaacatttcttaaaaattttttacctttatatgatgataatgtcaaccttcagaagagagtaacatcttccatttgaatacctatcttgtttataaattgggggggctgatttattcatttatttcaaaaaggatagtaattgtaacttatttgtttcttattaggagacttagctagtaaatgttttctattcacataagaagtctatgccttctttccctacatatcatctgttaagtttttactatagtcagtacaaatcagccaaaagagacattgccattgaaagtatttggagctgaaagcaggctaaacaatgaaatttctggcagcctaatttaaggtatgccttagtaataacttagtaacagttgaacttcaaggaaatctctgaaatctaaactttcttcttctaggtcaccatcacgcccagctccatgaggaaaatctgcacatacttccatagaaagtcccaggaggacttctgtggtcctgaacactcaacagaattatagattctaatctgagtgagttactgagctttggtccactaaaacaagctgagctttggtccactaaaacaagatgaaaaatacaagagtgactctataactctggtctttaagaaagctgccttttcatttttagacaaaatcttttcaacgctgaaatgtacctaatctggttctactaccataatgtatatgcagcttcccgaggatgaatgctgtgtttaaatttcataaagtaaatttgtcactctagcattttgaatgaatagtcttcactttttaaattattcatcttctctataataatgacatcccagttcatggaggcaaaaaacaagtttcttgttatcctgaaactttctatgctcagtggaaagtatctgccagccacagcatgaggcctgtgaaggctgactgagaaatcctctgctgaagacccctggttctgttctgcctccaacatgtataattttatttgaaatacataatcttttcactatgcttttgtggggttttttttaagta

SEQ ID NO: 2335 - DNA, 1080 bp, Homo sapiens
aatgacaggttgggcagatgttatttgtaggttttagaaaacaatagtgaagctaagataccagaaaagtaaaaaaacaggtgacagaagaggaagttgtcatgaaagctacaaggcaggtgttaagccactgaggagggcaagagaatgtgctggacaccagcgaacagttgagtggactgagccagcagtaaaacaggatgatgtgcccaagaagggtggggaagccggggtctggagaagctggggtcaggaggttggagaatgtcagcctgttctgaccctgaggaagagagatggggcctggtggcaggccaggttttcatttaggatgagaagggggaaggagtgtgtgtgaaaagaatggaggaggtaaggaaagggtgttcaccagatagctggtgctgtacagcccaggggcacagagacacctgcaaaagcccagggatagttagcagcaaaacgctgtcctggattactgccctgccaggaagtgagagtgagaggccaggttatgtccccacatagccctgccagggccctccactgcagtgcaagagacaggcttgcaggactcagcccgagaaagaatctgggctcctgagtcaaagcagcatcctatttctgctacattcagcctgctgagtaatggctccaaaggcaatgccagcagctcacagggcacaaggggaaagtgagaagcagggcctggcaccttatttttggagctgctgtcaaaggcccagccctctggttctgtgtgcctgacactcagcgacagctctcagtgtgagcttggataaccagccctgcaggcactggctgaggtgcccagagaggcaggccctgtgagaaagacgagttatgtgacttcaccgaagacagggagaatggagtctttacttcttaaaggagttcttacttcttgaaggagtcaatctcattggtcatcccagctgggctagtgcctcagcctgaagtcccttaggagtgagccttgtattctttcgctgctcacttgttctttgaaaattacctaaaatgatggtgacatgcggaacacacacaaacttgaggtgt

SEQ ID NO: 2336 - DNA, 1081 bp, Homo sapiens
gctctgtcatccaggctggagtgcagtggcgcgacctcaactcactgcaacctccacctcccaggttcaagcaattctcttgactcagcctgctaagtagctgtgattacaggcgtgcaccaccacacctggctgatttttgtatttttagtagagacggaggtttcaccatgttggccaggctggtcttgaactcctgacatcaagtgatccacctgcctcggcctcccaaagtgctgggattacaggcatgagccaccatgcctggcctaaggcaacgaaatactaccagagaaagtcaccataaggcagatgggtttctctataattcagaatctccaattccacatgggaccaaaggatgctcgaaaatatgactactgtgctctgaaaatctagtactatagctcactattcctactataatcaactatttcaaaccttctgcactctcccgatacctctgacactcccccaccccccactctccaccgatgtcataatctttgagttcttccttgtgttaccaaatgcttaaacccacccacacctgcacccctccttcttgcctcctgttgcaattgaagagtttctcttctgactgtctaatcaagagcagctccaccacttgtgttttacatcccattttctcccaccttttcatcaaccttctctctaaattacccagttcctctcttgtgcatttcatcattccctctctgttggatccatctcatggttatttaaaggagctgatatccctgtaaaaaaaaaaaaaaaatcctctgcctctacacactctaattcctcaaaatagttctacactctctagttccatttctcacctcccgttcacccctcaacccgctccaatctgacttttgctctcattattctactggaacagctcttgcaacagtcatcagtgacattcgtgttgtttcatacagtggtcacctttcaggcctcatcttggctcttcatcatttgacactgttgaatgattgaccatttggtctttcttatttaaagaaaaaaaaaactttccttgtcttctatgatgaaacactcttcctgctta

SEQ ID NO: 2337 - DNA, 1026 bp, Homo sapiens
atttacttagtcctccattgttggttatttaggtagtttctaatatttttacctttataaatagcactgcaataaacgtcctcatttggttctttttacatatgatttgacaggatgaataatgctaacattaattactactatccagtcagtaataaattactatagggaaactggggatgtttggaatgtacacttaatcttttgaggtcaataacatggagtgcaactactaagcaaccacaccagaacattgtccaggacggaatctgaggcaaaaaagaaaactacttgctctgtctagggtgatatatctgccttttcctgttctttggagctctcaatgtgagaggcatcaccacggactggcaagggcttccggccaaggctctgctcactctggaagtcacaggccttttgccttattcccaggctatactttggcggaaaaccagtcctgatggagtccatttccaaggcccggaaccagccctggaactgatcggtcaggcctggagctggatggccacagaacaaagcaggtcagcagaagtcagtgccagaaaggtggcaagagaaggctgaccgagcagacagggtgggtagagtcatgggtgtaagagacaatgggttgggagagttggcacaaacagctcaagagttcctcttcatctctccaaataacttaatattagagtgcccagggctcagtgcttggctttatcttttctatcttttttctctacactcactttcttattgagctcatcaagactcagcctcaaataccagccgtacacagacaattcccgattttatgtttctagcctggccttcagcctgaatgcctggcctgtatatccaactgcaaagctgacatctccactgggatgtttaacacgcatctcaaatttaacatgtttaaaactgagttcctaattttacccacccttacaaccccaaatgtgatctaacctcaggtaatagccatgcctctctcccagtttcaggccaaaagcttgaagt

SEQ ID NO: 2338 - DNA, 1033 bp, Homo sapiens
cagccatgccataggtgtgaggttggaccaagagaacctttaagatatcttccaagctctaactctacgactctgtaatcattatcaccataaactgggcaccttttccacaaggggcttgtgtaaaatgtggaacaatcaacttggaaaaggcctattcaagaatcagaacttcttgtgttctgagggatattcctacaaatctccgaggacataataacttaccaatatatagtctaggaatatttctgaatgtttcagtcactgagagtccaggaagcctctcttctggacagtgtctgctaattagctcccttgttgaaatagtctgtatccaccaccaaacaccctgagagtgctatcctttcctgatggatacattatagtttatttctgaaatagtttatctctcaaatctctctctaactcacacctctcccctgcttagattgttccaatcagttggacattttatttgtatttcaaactacctacacttgaatatctgttagacattttaaactgaaaataccccaaactcgtcttctgccaccaaacttgctcctcccaccaaacttgctcctcccacagtcttgcctgtttcaattaatggcaactctatcctttcaatatgctgggacaaaaaccttggagtcatttgcgacttattttacaccttatagccagtctttcagaaaaacctgttgttcctactttcaaaatatattcagattatgaccacttctcatcacctgcactgctgccacctggtctaaggccatggttctctctcaccgagattaccacagtaacgttttcaactcatctctctgcttccatctttcagtctttctcagcacaggatccagagtagggtgatggaaatgtactatatggctattgtggtggtggttacatgactccatacatttgtgaaaactcatcaaatggtactcttaaaattgacaaattttattatatacaaattatattgcaaggccagccatggtagctcatgcctataatcccagca

SEQ ID NO: 2339 - DNA, 1047 bp, Homo sapiens
tagtggtgacggggtttcaccatgttggccaggctggtctcaaactcctgacctcaggtgatccacctgccttggcctcccaaagtgctaggattacaggcgtgagccgcctcgcccagcctgaagcctcttttataaggacattagtgtcattcgcaagggcagagccctcataactcaatcacttcccgaaaggccccacctcttaatactcttgcattgaggattaagtttcaacatggattttggagagacacaaacattccaaccattgcaggggcttgtgtggaggtttaaagagctgttactttggagccaagcaggcttgccatggaacccttaattgacctgtagccaatcagagcattttccttcacacttgactagagcagtggcaataaagtctggtcttcagatgcaggagcgatgctccagtttcaacattatgaacctaattgtctaggtattcatgccaataacaggaaaaatgttccaaccttgtgttggtaccctgttaaatcattaagacttggaactgcagaattgcagcctggctagacatggtagcaagtggtaatctaggtgggttcatgaaaacataaaagtactccacaaagagtcccctaagtatttggtagaaaagactctgaaaataactttgatttcctgcatggatcttgacttcttttagttaagccagtgagactcaagagtttgtgagagctgggtattgacgctaatgggatcaccactatacacactgatgaaggccaaaaccagcagcttccattctcactgtgaacataatggaccttgctcacctctccagccttatctcctgcaattttctctgttctgaatatgttgagccagtaataaattcctccagccagtaatacattttttgtctactgtaactttgcgtatgctattctgtcttcccgaaacactcaatctctcagctgcattatttattggctaactcttttgagtcactgcctaattcaggaagtcctccttgattcctccagttggggcttcaggtct

SEQ ID NO: 2340 - DNA, 1044 bp, Homo sapiens
tttggaactgagtaacaggcagagaatagaagacactggagggctcagaaaaagataagaagattagggaaagtttggaacttcttagagacttgttaaatggttgtgaccaaaatgctgacagtggtatggacaaaggccatgctgatgaggtctcatttggagatgaggaacttactgggaactggagaaaagatcacccttgttatgctttagcaaagaatttggctgtatcatgtccatgccctagagatccatggaagtttgaagttgagggtgatgagctagaatacctgatggaagaaacttctaagcagccaagtgtttgagatatagcctggcttcttctaacaacctatgctcagatgtgggagcaaaggaatgacttaaagttggaacttatatttaaaagggaagcagagcacaaaagtttggaaattttgcagcctggctatgtggcagataaagaaaaaacttttttgggagaggatttcaaacagactatggagcaaccacttgctagagatatttgcataaataaaacagagcaaattgatcatgtccaaaacaatggggggaaaggccttgaaggaatttcagagacctttgtagcagcccctcccattacaggtccagaggcctaggaaggaagaatggtttcatggacagggcccagggccccactgccctgcatggccttgggacaccactctccacattctggccactccagctcctgccgtggctcaaaggagcccaggtatagcttgggctgctgctctggagaatacaagccctaaacgttggcagcttccatgtagtgctaagcctgcagatgcagagtgcaagagtggtggattcttggcagcctccacctaaatttcagagaatgtatggaaaagcctggctgtcaagacagaagcctgcttatgggggcagggccctcacagagaacctctactagggcagtgcagaggggaaatgtggggttggaggcccccagcagagttcccactgggcactgcctagtggagctgtgagaag

SEQ ID NO: 2341 - DNA, 1030 bp, Homo sapiens
tgtaagaagtatttgtgcaaaataatttagtaagtgggttgtgggattttaatggcaaaaatgttcagaataaattgttttataattgaaagtatttaataaacaacaagccttgttaaaaggcttttcagtctaacctattttgtttaagattctggaaggcttggtttggtaaagtagttgatgccttacatttatataacattttagcattttaaaattattttaccttaaaaattttcttaaattataaaacagtattgttcataccaagtgaaacaatccaaagatatgtaacccttaatccctgtgtatctcctgctttttcacacctagtaagtaagggtaatactgttgtttgataatccatggctcattgtatttttacaaacatcctattcattgggtcatccctgaactttttgcaaggtcagtattcccattttattgatgagaaagttgaggcctaaaaagaatagtttctggcctgtgattacttatctggatgatgttgcagctgacactgggacctaggtcaaatgatttcagtatttgtgctgttaactgttttatgtaaatttgaagcagtgtgatagagttgggtctctggggttagtcctgggtcaaaggtaaatttttaatctttctaagtcgttttccttatctgtaaaatggggataatacaaatctccccaggcctgtggggattaaggggaataatttaagtgcctaaaaataggcaaagaatgttagttcccattctcttaaatatttgaaaatccagattaaaaatatttttaaatgaaggattattaataggattacttacttaaatggtaaactttcctagtgtatttaaagtgattttatttataatcagttttcagatatgatttatgtgatctgaagtgcagctgcaacatctttcagcacgagtgtagaaatggaaataggattaagtcagactctttaaaacattaaaagctgtgataagatttttttaccaagcgaagaaatcaacctaaccagt

SEQ ID NO: 2342 - DNA, 1113 bp, Homo sapiens
catgggctaagaatccaaaatggtaggaatcatagcctaatgcactaactttatagccacaaaaataaaaaggaatatcttttatataaggttgagaaatactttcattgctttggcctttttcattgtgaatagttattatctttttagttcttatggataaaagagcagagggaaaaaacctaggctccctgtatttaaactattcaaggtttatgcacaatctgtgttttcacaaggattacagagaaaaacagattcttaaaaaactaagattttgttaatgtttacctcatcccaggcaatgttctttttgggtgcttaatatataatatctcatatagttgactatgcattaatttttatatgaattcttttatatattaaatcaattaaaaaccttatttacgtttcctcttaatagaggttggaaaacattggtcacctgtattacttgaaagcagcctcttaggtacttgtaggtctttaaagtttgcttctgagtctttgcctctctgacccaaacatttctattcctttagctttttgtataggtcttatttttcagatactttaatcatctatgctgttttctgttggaacttctcccaagtctttttaatggtgaagaccagaattctatgttttatgttaactcccttaggaaagacatggtcagaactcagtagaatagtaagattacactcctcaattccctatactttttagttatctttcactttttagggtatttttggtgtacagaagtagaaggactagccatacattgaacatagttgaagtttgtcattttattagtgaactgaattcactggtgaagtgcctgtttttctttgcaacactgtttcttagattcttggagcaagttatttgtatagaagaccatagaaggctgggcgcagtggctcacgcccacttgtaatcccagcaatcccagtaatcccagcactttgggaggctgaggcaggtggatcatgaggtcagaaggatcatgaggtcaggagttcgagaccagcctgaacaacatggtgaaaccccgtctctactaagaatacaaaaattagccaggcatggtggcacacgcctctaatc

SEQ ID NO: 2343 - DNA, 1045 bp, Homo sapiens
taaaaacttaaattgctatcaagttttatttcttgttatatccttaatttatgataaacacaaaatgttaggtaacattagaccagataagcatcactccttttccacagttgggcagagatacatcaagcaaaattgtatttgctcagatccccaaacttttgttagctgtagactgttactgaactcacagtagtaaaaatgtgttgttacttggtgaatgataaggcctagatctggtagtgcttttgtttgctctaaggtctattaatttaatgtagcaatctttcttttccctttttcttttctaacttctacatcaacctaactggctacctaaatgttcattgaatgactgtttttgctttgggatagaatcctccttttttatttttagggtgttaaattgatatagtattgtttaatagctaataagatacattttgggctaagtttctgctttttatacctattaggttacaataaaaaaaaactttagtcatatttgcctttctccttgaaagcaggtatgatagtgacaagctgaaccaaatatttaattctgatttgtggtagcaagtgaacatttgctattacttgtaggttgcttggcacttttatagaaggcctgctatgacttctagtttatttgctgtggttggtacacagacatttcttccctagccctgtacttacgtaatttggttcattatttctcaagtgtggataggatatgcctggttttgatttaattagttttcccactgtagttttatagaaagaccagaagtttttcttttcctttctttttaaaaattaatgatacactgcctgttttatctggaggttgttgactctgcatttaagaaactctgtagtgattaaattgaggtaggtagtagtccactgggaaggaacatcttcctagtgagtatggattacaaaataggaatatatttaattaagaaatatttaattttataggcattgtccttattttctagctcctgtaatttaacgttttgcatcaagttatgtaaagcaa

SEQ ID NO: 2344 - DNA, 1044 bp, Homo sapiens
attcagactatacttttaatgtccatagctcagtttgaggagaaaaatactgactcctccctataataaagtgattctgaaagaaagctgtttttcaaaaaagctctgcacaaataagataggcaatatttaattttgtggcctaatccaacaataagtgaccttgctttgagatgaatttccctaaaactatacccagtccataagaaggtgagctcctcttgttcccatctcatagttaccatagtttcaagtgtttcctcatttctagtccaatggctgtctttcctcccaaactcagaggaggattcctgcctccagtcctctgctcttttccccatctacgatgctttcctcctgtctaggtttactcatccttcaaagtctcagagctttccctgaccactaagctaaaaccctttctggacttcagcagagctatttatcctatgaatgcccttcacagttccttatggtctggaatcaataatttaaaacaataggattgttctctcactaactcttgaaggcagagttgtaactctttaaggcagagttcttatcttggatttctgacttccacaacctggtaagaatactttttttttttttttttttttgagatggagtctcactgtcgccaggctggagtgcagtggcgcgatctcagttcactgcaacctccgcctcccgggttcaatctattctcctgcctcagcctcccgagtagctgagactacaggcacatgccaccacggccggctaattttttgtatttttagtagagacggggtttcaccatgttggccaggatggtctcgatcttatgacctcgtgatccgcctgcctcagcctcccaaataaaatacttctaagctcaatttagcagggtgaccttagtatgcatttcattgttcacatatgaaaatggtgataccaccacttgactgctgtgaagctgagtaaagcatgcctcgggtactgggctccacttggcccataataggtacctcatactgaatatagtaggttaaaaaatgtttt

SEQ ID NO: 2345 - DNA, 1035 bp, Homo sapiens
ttcatttccagggagcacagaagccagagtgagcagcacttggaggtgtgaggaaagggagggaacattaggcaagtccttttcattccattttattttattttattttttgagacggagtttcactctgtcacccaggctggagtgcggtggcacgatcttggctcactgcaacctctgccttctgggttcaagcaattctctgcctcagcctcccgagtagctgggattacaggcaccaccaccaccgctggctaatttttttgtatttttagtagagacggggtttcaccatcttggcaaggctggtcttgaacttctgaccttgtgatccacccgcttcggcctcccaaagtgctagtattacaggtgtgagccaccacacctggccttccttccattttaaatgagcagattgagttaatctttgtcagtgttttacttcagcaggggcttttttcccctgataatgacatgcttctactcaaaagcctttcatgactttccattgcctgtagaattaaattcaaacttaatgatttaccctagttgaagcaatgagagaagtgttctttagtaaagagttggcattatagaacattacagaacattttagtgccatttaatgtaactactaatgatatcttggagatagttttgtattggtttatctattatttgataacaaacactgctgaatgggaatagatttggcttccaccaacatttaagaagagggaacatttttcttgtttgcatctttaattttttttttggagacagtctcgctctgtcgcccaggttagagtgcagtgatgcgaccttctccagctgccaggttcaaacgattctcctgcctcagcctcctgagtaactggaattacaggtgcacgccaccatgcccagatttttgtatttttagtagagatggggtttcaccatgttaaccaggctgatcttgaactcctgacctcaaatgatctgcccatcttggcttctcagagtgctgggattacaggcgtgagtcaccgcacc

SEQ ID NO: 2346 - DNA, 1028 bp, Homo sapiens
gccttgtagctggtagcagaaatgccagttgcagaatgaggaggtggcaaagcagttaacacaatggatgtgacggtggatgtataaaaacaggtgtgtgaattcgtctgatgcctgactcccagcagcctcggccggttcatacatgtccatcagcttccaggctgcaggacatgccagcccagttaaagaggcttcacttgactgttttcctgagaaaaggaagctgccagctctcatttggctcactatgaaaagcctttaattaatctcttcaaacaagttatttccttaatccacaagcagtggttacacttgctttgcattcttgtctggttcctaactctagagcccttctccctggcttagccagtaagctgagcccctggctgcgttcagccggcccgcctgagagacactaggggaaatagcttttgtgggcaagcagggtggccggtggtgctcagcagtctttccagtggctgtgtccctcctccaaatgtggacaggccatgacagagtcttagcccaagtcccacagatccccaaaagttctgttgattgcttcaggggatcagtgaaaattagggaattttgtgtgttgctatatacattttttctggggagatgagcttctcattgagatctgtgactcagaatcgactaagccaccataagtctggatttctccccagctcccaaggcccttttgggtccagaagacctgcatatgggctgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagt

SEQ ID NO: 2347 - DNA, 1608 bp, Homo sapiens
ggcgcgggggaggagaccttcatctgttcacgcggtagcgcggattgcggttcgcggcgcgcgccaccggggaaggagcggtgggccgaggggttggaggtggggccccaggaggacctcgggctgtgggccgggagagcggagtcggggagtggggcgggggagcgaggtggcgccggggagcctgggatatggcgcggccagacgatgaggagggggcggcggtggcgcccggacacccgctcgcgaaaggatacctcccgttgccgaggggcgcgcccgttgggaaggagagcgtggagctgcagaacgggcccaaagcgggcaccttcccggtgaatggggccccccgggacagcctcgctgccgcctcgggagttctgggcgggcctcagactccactggccccagaagaggagacccaggcccggctgctgcctgcgggcgcgggagctgagaccccgggggccgagagcagcccgctgccccttacggcgctctccccgcggcgcttcgtggtgctcctgatcttcagcctgtactcgctggtcaacgcctttcagtggatccagtacagcatcattagcaacgtcttcgagggcttctacggtgtcaccttgctgcacatcgactggctgtccatggtgtacatgctggcctacgtgcccctcatcttcccggccacctggctgctggacaccagaggcctgcggctcaccgccctgctgggctccggcctcaactgcctgggtgcctggatcaagtgcggcagtgtgcagcagcatctcttctgggtcaccatgttgggccagtgcttgtgctcggtggcccaggtgttcatcctgggcttgccctcccgcatcgcctcagtgtggtttgggcccaaagaggtgtccacagcttgtgccaccgccgtgctgggcaatcaggtaagtactggagtggtaggtgaaagtcagatccttaaaagaccggaaaaagtcataggccgtgagaactatggcctgtatggatgaactgccccaggaggtatttgtctataaaagaggagatgaagccgttgaataggaggccgtcttggattgaagtgggctataaatttctttgtaaggacaaaattttccaaacgaccttgtcatcttgctttgaaaattacctataaaataattaactgggccgggcgcggtggcacacacctgtaatcccagcactttgggaggccgaggtgggtggatcacttcaagtcaggagttccagaccagcctgggcaacatggggaaaccccgtctctgttaaaaatacagaaattagccaggcctgcttgcgggtatctgtagtcccagcaactcaggaggctgaggcaggagaatctcttgaacccgggaggtggaggttgcagtgagcggagattgcacctttgcactccagcttgggtgacagagtgagactctgtctcaaataataataataaactgtaaccataataataataataataattaactgtattggcttgtgtatgcctaacatggaaaatttgtcaatgcagtaacgaacaagacttggggtattatttttgtcaccagtgtatttgtgaaaggaaggtat

SEQ ID NO: 2348 - DNA, 1041 bp, Homo sapiens
gtcatttcccttatctaaaagtacagaagatggagtaggttgaactatagttgtttgtccaaaataatttatgactgatacttgagttggttgcatctgcaggtttggacagaagctattataaagttttttgtgtgtgtggttttttttttttttttttgtagaaatggggtttctccatgttgctcatgcttgtctcgaactgctgagctcaagctctctgcccacctctgcctcccgaagtgctgggattacaggtgtgaaccaccacgcccggccatgattacattttctttgtcacacatctctcagtttaaattcatttttaaatattcagtagcatttcttgatcccatttagagttgcccagtcactctctttacattattttactttaattctccttatagcactcatccctgtctcatatgttattgtttacatgttcatatgttacttacctattacttttctcttatccccaccattagattgtaagtttcatgaaaataggaatgtggtctgaatgtacacagctgtatcaccagcatttattactctccataaaaccatgttgaataaataaaggagcttcagactcatacagatactggccagctggatagtctacttggatatctcatgggaacacaccactcaaaattgctttctccttgctcatttccctttatctctaatgccactgtcttggtttgggccacccacagctctcacctagagcttgctaactgtcctccctatctgtagcccttgctgtcttccctctgttctcgcattcatccagcgtggtcttttacaatgtgcaaatctgttccgggcacatccttaccccctgcagtggcttccattgtccttaggataaaattcaaacactctagtgtgacatatgggaccctccagatctgcctcctgccagcccttccactttatctgtatgcacaacccctgtccccacagacatatgctttctctgctctgtgcagaactatgcctacttatagtttctcacaaggtcgtgcc

SEQ ID NO: 2349 - DNA, 1069 bp, Homo sapiens
tatgtaattatttgtttgaatttctgttttcagttttggggacatatacctaggagtagaattgctaggtcatatggtaattctatgttaaacttattaaggaactgccaaacttgtctgcagtggctgcaccattttatagtcccaccagccgtattcaagggttccaatttttccacattcttgccaacacttttatattgctattattgttattatagtagccatgctacctggtgtggagtggtatcttatggttttgattcgggcatgttttcaaatgcttattgaccatttgtatatcttctttggagaaatgtctattcaagtcttttgcccattttaaaattgggatattgcttttttgttgttgagctgtaatagttctttatatattctggaagctataccctgatcagatatataatttacaaatttttctgattctgtaggtcatcttttgtcagccttattttgcatattcttattccccttttgtaagcatctgcagggcaaggactgtatattacacagctttataatagcagcatcactcagatggtaggaactcagtaaatgttttttggataggagagatattggtgagcaatttccctttaacaatacaatagtaaaaaagacattagagcatagtagtttaggctgggtgcagtggctcacgcctgtaatcccagcactttgggaggccgaggcgggcggatcatgaggtcaggagttcgacaccagcctgaccaacatggtgaaaccccgtctgtactaaaatacaaaaattagctgggcgttgtggcgcgcgcctgtaatcccagctactcaggaggctgaggcaggagaattgcttgaacctgggagggagaggttgcagtgagccaagattgcgtcactgcactccagcctgggagacagactttgtctcaaaaaaaaaaaaaagaacataatagtttaattttcaaagcacctttataaacactagctgtcctctttatgttctgttaattgccagcatttacttttttctctaatgataatagctgttaacaggactatgtgt

SEQ ID NO: 2350 - DNA, 1092 bp, Homo sapiens
ctgtaaaggtgagagacaggagtttacttcctcaaagtcatacagtgagctgaggcagagccaggattcaaacatttatttgtcttataataacctaatatatgtaatatatgcctgaatcacacagggacaaataacgaaattttaaaaatgttaaaatacggttttaaaatgtaaaagtagccctaaacagcaatagatttgcaacgtattcatcacaggaggaaaagtttgaatgtggtgctcgagaatattttggctactttataagactaacaccagaagtggagaataactgcttcaaataatcagttgttttattggtgcaaatttttggttgggagaagacaatagaaagctattatttttctgtttcaaaggagaaagaagaagccatatttcatcctttgaaagtagcagttaggtgtaaacaaggccatagatccatggctttttgtttctctttcttcaagtagacttaagttcgactttcctacaacatgtagctggtaaatacaggcttgatttttgccaaaagatagtttgacttcctgaaactaacagataactcttgtattcaaaaaataaatgtaatggatttaaagactggtaagaagtattttcttttcttttcatttttgagacacagtttcactctgtcgcccaggctggagtgcggtggtgcgaccttggctcacagcaacctccgcctcctgggttcaagtgattctcctgcctcagcctcctagctgggattaaggtgcccaccacccctggctaatttttgtgtttttagtagagacaagtttttgccatgttggccaggctggtctccaactcttgacctcaggtgagttgcccgcctcaggcctcccaaagtgttgggattagaggcgtgagcctctgcgcccagccagaagtcagaaatattttcatttttgcatttcagttcagatttgggccatttagatttattttgccatggtaaataaaaaagtaagagacttaagattcattaaatacccatgactaccttgtaagcatagtttttattttctgaaactttgttttataactatgtgagttctgcat

SEQ ID NO: 2351 - DNA, 1086 bp, Homo sapiens
tacattatacatataggaaaacttgaggttttgcagaagaggaactgtttggtaaattgtcccaggataattgattgtccatatgggaaaaataaactaaaattagaactctacatcataccatgcataaaaatgaattatagtagagaccaaagagtaaaaataagaactttaaagttttaggaacaaatataggagaccatctttagtattcccaaagaatttctttgtcttttttttttttttttttgagacagagtctcactctgtcgaatttctttttttttgagacagagtctcgctctgtcacccaggctggagtgcagtggcacaatctcggctcactgcaacctccacctcccggattcaagcaattctcctgcctcaacctccccagtagctgggactacaggcgcacaccactgcgcctggctaatttttgtatttttagtagagacggggtttcaccatgttggccagactggtcacgaactccttggccagactggtgtcgaactcctgacctcgtgatccacctgcctcagcctcccaaagtgttgggattacacgcgtgagccactgcgcccagccaagaatttcttaatgcaaaaaacataaaccctaaagaagtatattgataaatatgattatattaaaataatcttttctaggaagacattattgaaaaagggaaaagacaggacttagactatgagaaaattgtctgcaatgcatataaccaacaaaggattagtattagttaaaaataactcctacaaatcagaaagagcaaacaatccaaggacaccagaagacatttgtgtgtctgtgtctgtgtgtattgttcttatgtgatattcagccttaacagtaatcaaggaaatacaaatcaaagccagagtaagatgtaatatcacacacattcacattggcaaaataatttaaaatctggtgaaaacaaatttggcaaggatgtggagcagtaggaactctgctggtagtatgaacggataacaactactttgaagagcaaattgcttatatctagaaagtagaaggtctactctagatatatacttagagaag

SEQ ID NO: 2352 - DNA, 2082 bp, Homo sapiens
caaacctgtataacatgttatgctactgaatgttgtaggcagttgtaatacaatggtaagtattgtgtatctaaatatatctaaacagagaaggtagaataaaaatacagtattataatcttacaggatcatactgtatatatgattcagagttgacctaaatgtaattatggagcacatgactatctatacttaagaatcctaacaaaaatcattgtacttctaaccatagaggattaaggaaaatttaccttttttatttcttctattattttaggctttttttctggttttaaaatataatgcttttatatattctttacctgccctcccctcccacactgacacatgtactaaatcttcctactgtgtgcttagttttatctaattattttcattgactatgaaaaggtgtgggaatgtgaagagtctgaattagttaatccatttatttgatcaacttcttacgcaaatttttttcagggagaagaagtcaatgctggaaggattgggctaacgctagtagtagctggaatggtgggctctattctttgtggcttatggctggattatactaaaacatacaagtaagtgaaagtaaatacatgtatggtgtataaccaaaggtattttgattttaaaggacaatttgctttttatttcaagaaatttaaaacatgttattacttaaagatacggattctaaacactagtaggttctcttcacttaacaagtgtttcttttttttttttttttttgagacggagtctcgttctgtcgcccaggctagagtgcagtggcgcaatctcggctcactgcaacctctgtctcccggcttcacgccattttcctgcctcagcctcccgagtagctgggactacaggcacccgccaccatgtccggctaatttttttatatttttagtagagacggggtttcaccttgttagccaggatggtctcgatctcctgaccttgtgatccacccgcctcgacctcccaaagtgctgggattacaggcgtgagccaccgcgcccagcaacaagtgtttcaatactctatgtattgtattattttattggtcacatttatttcaattctgagaacttggataccttatgagccccttctttctaacagtactcatacctaccacttccgaaggaattatttctattctaaaaagagccatttctgagaaatatttgacttttgatagactttatcttgttcttttttttttttttttttaggtggggtctcactctgtcacccaggctggagtgcagtggcaccatcttggctcactgcaacttctgctttccaggctcaagtgattctcccacctcagcctcctgagtagctgtgaccacaggtgtgcgccaccacacccggctaattttttgactttttgatagagacagtgtttcaccatgttgcccaggctgattttgaactcctgaggtcaggcaatctgcccacctcagcctcccaaagtgctgggattacaggcatgagccactgcacctggcctatgttgttctttttttatgttgtgggcttaaatacaaaaacaaaaaagtagttctttccaatcaaaaaattattgttgagcataaggctttattttggtaagaactttttggctaaagtacgcccagactacagtaccacttaactgtaatataatgcataatgtgaaaatgctggtttgacacaatgtcttatgcctgtaatcccagcattttgggaggccaaggcgggtagattgcttgaggccaggagttcgagaccagcttgggcaacatggtgaaacgccatctctactgaaaatacaaaaaatagtcaagtgtggtggtgggcacctgtaatcccagctactcaggaggctaaggaaggagaattgcttgaacccaggaggcagaggttgcagcgagctgagatagcgtgccactggtctccagcctgggtgacagagcaagacgctgtctaaaaaaataaaaaaaaaagaatatactctgttaattgtacattatatggaaccaccaaaaggctaataccaaagaaaatgaatgataccaa

SEQ ID NO: 2353 - DNA, 1026 bp, Homo sapiens
ttctgaagtattattactctggtctttaattttttcagttcatccaaagtttcttcaatattttaaactttaaaggattcattctatgcatataaacatgtaattcttaagaactattaaaaattatttaaaattggtttttggtataccataggtaaaaaatggatgagccttacttaatctgtgtaactttatttggttacaatcaacttataaaactagaagtaaatttttctcagaaaaaaatgtgtatttgttgcttccagttctgtaaccttgagctgattggtcaatgataatagttccttactttgacatagcaacttcaaaatattcacttatttggtcattagaataagcccgagaggcagaatgattgcatcagtatgtgattgtgactttctggtagttctttctgtaattctggatttattttcctagcttcttcatgactggttacctccctttgggttttgaatttgctgttgaaatcacttaccctgaatctgaaggtacttcatctggtcttcttaatgcttctgcacaggtaaacctctgatttctctaaacctgagatgattattataccagatattctagtgagtaatgagtttgaccatggttttatttgttgttgttgttgttttgttttttggagacagagtcttgctcagccatccaagctggagtgcagtagtgcagtcatggctaactatagcctcaaactcctaggctcaagcaatcctcccccctctgcctccagagtttttgggactgcaggtgcacaccagcatgcccagctaaattttttttgttattttttgtagagatggtgttttgccatgttgtccaggctggtctcggactcctgggctcaagcaattcgcctacctcaactcccaaagtgctaggattacagtgggtgtgagccactgcacccagcctgaccgtggtttttgttttaacaattcaacttttcaatgaatgtttctagaaaccaaatcatataaccaaaataagaaaagt

SEQ ID NO: 2354 - DNA, 1027 bp, Homo sapiens
ttgtgagtttgtgttaggccacattcaaaactgtcctgggccacatatgggctgcagaccacaggttgaacaagcttatactacaccatttcatataaaggccttgagcattcgtggattttggtatctgaggtggggtcttggaatcaatcccccgcagataccaagggaggttgtgcttcgttgatctggttataacttagttggaggatctggttataacttagttggagaatctatcagaaggatgtgaatcagaatttcttctactgtttgtggaatacctgatcattctttgtgaaaccttcaatatgaaatctcaccagtgatagacattttggatatacacaactacctaaggtcgctcactcaattgtatgaatgataggaacctgagcattcattcacgaagctaaaagaaagtgaatgcactctgtttcctcaaagaaaaacatcttatcacagggagtttttccccctgtccagttagtaaaataaaacatacaaaactgtgaaatatgtaatacattaactgctttaactattgttctttcataagtaattccatgttggttcttaattcctaggcaagtactatatcttatctaagattattactattggctggacgtggtggctcatacttgtattcctagcactttgggaggctgatacaggtggatcatttgatgtcaggagttcaagaccagcctgaccaacatagtgaaaccgtgtctctactaaaaatacaaaaaactttagccagttttatgggcacacacctgtaatctcagctacttgggaggctgaggcagaagaattgcttgaatctgggaggctgaggcagaagaattgcttgaatccgggaggcggaggttgcagtgagtggtgaagatcacaccaccactccagcctgggtgacaaagtgagactccgtctcaaaaaaaaaaacagtattattgttataccaaagaagggagcagttttgtaatcctccttcaaattacttttacaagagattcatgaa

SEQ ID NO: 2355 - DNA, 1031 bp, Homo sapiens
ccatagctagagaggaggaatcaatgtctggcttcaaaggacaagctcattctcttgtgaggggttgatgcagctggtgacttcacattgaaactaatgcttgttgaccattctgaaaatcctagggcccttaagaattaggccaaattttctctgcctaagctctaacaatggaacaatgaacctgaaccccgtagttgatagtacatctgttagtagcatggtttgctgaatattttaaacccattgttgaagcctgctactgagaaaaacattcctttcaaaatactactgctcattgaccaattcacctgtttacccaagagctctgatgaagatgtacgaggagatcaatgttgctttcatgtctggaaacacagcatcccttctgcagcccgtggatcaaggagtaatttcaactttcaagtcttattctttaagaaatacacttcaaaaggctgtagctgccagaaataattattcctctcttggatctgagcaaagtaaattgagaactttctggaaaggatgcaccatcctagatgccattaagaacattcttgattcatgggaggaggtcaaactatcaacattaacaggagtttggaggaagttaattcccattctcatggatgattttgaggtgttcaagacttcagtggaggaaatagctgcagatgtggtgggaataacaagagaactggaattagaagtggaatatgaagaggtaactgaattgctgcatcttatggtaaaacctgaagaaatgaagggttgcttctttttttttgggggggggtgccggaatgttgctgtgttgcccaggctggagtgcagtggcgtgatctcggctcacagcaagctctgcctcccgggttcaggccattctcctgcctcagcctcctgagtagctgggactacaggtgcccgccaccacgcccggctaattttttgtattttttgtagagacggggtttcaccatgttagccaggatggttttgatttcctgaccttgtgatctgcctgcctc

SEQ ID NO: 2356 - DNA, 2354 bp, Homo sapiens
tagtaattggggacaatgtgatcatccttggagagagatgtgagcaccaaggctgggtttgtatgtggtgggggaataaacacacttacttgaaaattaccatatgaactctaaatgcataattattattttgcttaattgttaaattaagggaaattttcttaaaattcttctgtttacatcatgttaacactactgtttatctaattagtatccggtttttagtctcatattgtatctgaaagtaagcttcttgacgtttactttttaaaagtcgatgtttttcttttttgtagaaaatggaagcttagaatactttttaaagtgataatatggggtgttcagtccccataagatataatagttcatgcagtttatatattaaagtatccagtggaactaaatgtacaatatattcctaattggctgcctttttcactgtgctgaccagctgttcaagccacttcagtttgagtacaacataccaacatgacactactcacccacaaaggacagcattgggatcaggctttcagatgacctctaagatttttcccatttattgtactcttgttacaaagtactttttaacacatgcagtcaatggctataaaaactattctgtgtacagattctacccagactttggtcttagaattatgttctaattaaggagcctggttacaggttcattctgtcttgagttcttttctgtgctgcctttctatcatggataaatgctaacgctgtattttttcactccaacttgagatagagtagttttgtacccattgccttttttttcttttaaactctctttttttttttttcctgatgtgtaactttctagtaagataatttcatcatgtatgttactggctatttcatgatttcatgtatcacatcgtatattttgccttgaagattcctgaaataaggaaatctataataacttcagatagcctacatgtccccatttagtggagacctcttgaatgctatttgaattctgcagtatcatttttatgaccattctcctttgaggaatactatgcccaggtacatgctctatcagtgtgccgggagagtggattcttttcttcactgcagagtcatcacactgttagaatagtctgctcttttacatgctcaggtagggaaaataggaccaaatatatttccacagtgcctaccactgtgtcatgtttacagtgagagtttaaatattgttgatgtcctgactctgtgagctcatagggagtatcttcatagtaatgacatttgatcagccataaaatttacattatgttcatatgcacccaaaaaagctagtcaggtaatgaatacccttgaagtgaatagcaattttgatttaggcagtgtgttaggccatccttgcattgctataaagaaatatttaggctgggcgtggtggctcacgcctgtaatcccagcactttgggaggctgaagcgtgtggatcacctgaggtcaggagttcaagaccagcctggccaacatggtaaaaccccatctctactaaaaaaaaaaaaaaaaaaaaaaaaaaaaaaaaaggccaggcgcagtgctgtggctcatgcctgtaatctcagcactttgggaggccaaggcaggtggatcacaaagtcaggagttcaaaaccagcctggccaagatggtgaaaccccatctctactaaaaatacaaaaattagcgcagtggcaggcgcctgtaatcccagctactcaggaggctgaggcaggagaatcgcttgaatgcgaatggcagaggttgcagtgagcgaaaatcacactactgcactccagcctgggagataaagtgagactgtctcaaataaataaataaataaataaataaataaataaataaataaataaaacctgaggttgagcacgatggctcacacctatagtcccagcactttgggaggctgaggtgggtggatcatttgaggccaggagttgaagaccagtctggccaacatggcaaaaccccatctctactaaaaatacatacacacacacacacacacacaaattagccgggcatggtggcacacgcctgtagtcccagcttcttgggaagctgaggcatgagaattgcctgaacctggaaggcggaggctacagtgagctgagattgcgccactgcactccagcctgggtgacagagcgagactctgtttcaggaaaaaaagaacagaaatacctgagactgggtaatttataaataaaagaggtttaagtggctcacagttctgcaggctgtgtaagcatggcaccagtgtctgctcggcttctggggagccctcagggagctttactcatggtgaaa

SEQ ID NO: 2357 - DNA, 1371 bp, Homo sapiens
ggccaaaaatatattttaaggtctctccccaaatgtttttatttttaaactatcaatgttgtttaaaataatcatgtacttgttgagttcctgaggtttggaacaaattacacataaaatttagaatactttatttctgaaaagcatatacatatatgttatgtttatttttccttgttgattagaaaggtgatggaatatgtgacaatgcaaaatgaattgataatttttctgtattttgagtgaaagttgtctgtaatatgtcaagcaagaatgttataattctacagtaatgtgtgacttcatgacagagctacattctgagaaatttgtcattaggtgatttcatcattgtgtgaacatcatgaagtgtacttacacaaacctaggtggtagagcctactgcacacctgggctagatggcaaagtctgtcgcttctgggctacagacctgtacagcatggtactgtattgaatactgtaggcaactgtaacacaatggtatctgtgtaatctaaacatagaacagataatacattgtgctacaatgtaacaatggctgtggcatcactaggtgataggaatttttcagttccattataatcttataggatctctgtcatatgtggtcaattgttgatcgaaacatgactgtatgtcgtattttcagaaaatggaataggtaatcatcacttgtgtgaattttaatcaaatgacttaggaaagaaactggatgtttcaaaagctgttgcatttattacaaatgtcacaaatacagctcttgccttttgagaatgttggagagatgtctttaaaaaatatgtttgtgtgtaaaaatgtgtctgtatgcaatagctagaaaaatgcctgtgtcttaagtcattactcatgttctaatttttgttctttgtactatttatctgtatgcttgttcttcagtatttcagactcaaaataaatttatttttttatgttaattttctgtgactttttgaaaaattctgatgcttaggtacacatggggagtttaaagggattataaaatttcagaatgggcaaagagggaatgaggtagtgcatggaacataaaatgaggaaacaaagtctaccagggtcagggctaaaatagatactaaaatattttattcctttaaaagtaactttagagagtgatgttagcaagatggcagaataggagctttatatcatcattcttccacagaagcattgatttttaccagtactttcagatggtagttcttttgtaggaatccagaagtcctacgtggaagttccagcacaccattggagcagaaatatctgagaataaatgcattaaagaaaaggaagaagaagattttcactttatct

SEQ ID NO: 2358 - DNA, 1051 bp, Homo sapiens
taggtgttgtactaaataaataatgaggatgataataataaataacataaaaataaaaaattgagtggctagatgtctttgggaaatactatgtatcttccttttggggatttactaggcatattaatgtattaaagggtttgaagaattctgctgtaaacaacattccttcttaaaaagaggtaaattgaattgattattaagcccttcctgtgagatcactgattttaaagaatactggtattccatgtaacatgttttgtgaagcactgctgtagggtaatacttttttttttgtatttttagtagagtgtaaggtaatactttttaagatgagttggtgataaatttctaaaaagcaagaagcatttcaagatatataggtagtactaactgaatcagtggcagttaatgcttgcagtggaaatttctgaactttatttttatttttatttattttttttgagacggagtttcacttggtcacccaggctggagtgcaatggcgtgatcttggctctctgcaacctccgcctctctggttcgaactgttttagtgcctcagcctcctgagtagttgggactacaggcacatgccaccacacccggctcatttttgtatttttggtagaggcggggtttcaccatgttggccaggttagtcttgaacttgtgacctcaggtgatccacctgccttggcctcccaaagtgttgggattataggcgtgagccactgggcccggccaaatttgtgaacttttttttttttttttgaggggttgtttcactcttgttgcccaggctggagtacaatggcgcaatctcagctcactgtaacctccacctcccgggttcaagcgattctcctgcctcagtctccctagtagctgggattataggtggatgccacaaagcctagctaatttttgtatttttagtagagatggggtttcaccatgttggtcaggctgttcttgaattcctgacctcaggtgatcctcctgcctgggcctcccaaagtgctgagattacaggtgtgagccactgcgc

SEQ ID NO: 2359 - DNA, 1035 bp, Homo sapiens
ttgtaagaagagataatccagcaaattttaaatattaaaactatgtgagcgtgaaaaggacaaagttaattcaattggtggttctgtaaaatacaggaatctaaaaagtttttggtgttattaagtgtaattatctgaaaaggaaacatttatgtagaaaatatttaagggaatgtttttaaaattaagcttttatttgtatgttttatatggttgtcactgaattaatatttcattgagacattttcttcagagtgactttaataaataagaaacttatggagacttggttcaataaagaaagaggttgttatagacctattttttcaatgggaaagtattgaacattaattagagaaaataatttctaaatgtgtctctgaggactttgtgtagtccagatatgaacatcagtacttgctgttgtagtggaagtatatctttgttcacttttgtattttgaagatttctggaaacctcagaacttagaaggagtaagaagaaaaggaggcagtggatgtgacattttgcgatgctgttaggtattttggttctgcagccctagagttgagaagaaggaatataggattgaataaattagggcatggtgaagaaacacagattctcacctggggggttctaattcttgctctgacagactatctactggttcatataccatggtattttaataattattatgattaaattgttaaattttgctccttaagtttgtcttgcagtatttaaaaatgacttaactagaataaattttttttttttttttttttttttttttttacggagtctcgctctgtcacccaggctggagtgcagtggcatgatctcagctcactgcaaactccgcctcccgggttcatgccgttctcctgcctcagcctccctagtgctgggacttcaggcacccaccaccacgtccagctaattttttgtattttttgtagagatggggtttcattgtgttagccaggatggtctcaatctcctgacctcatgatccgcccgccttggcct

SEQ ID NO: 2360 - DNA, 1055 bp, Homo sapiens
cctatgcagatctttaggataaaggccaaatcaaattgatagagtatttagctctttgctgttctttgttaataattgtttctatgtgtcagggagtctgttttttatggaaaaaggctttattattaaacaagaatattgctttatagaaattgtgaaaagctgtcatgcaaattaccacctgccatatggctaaaaaaaattagggattatggaagtcctattaaatactttaaacaatttaagtaaaagttagctgttcattgtatttcttctggatatgggaattcctgattgtaattgttgctggaagtcactgggaaatgagactgtcattttcagagtttgtgaaagattggacagtttaagagaagtcaaactaatcttggaaagtatcttagaactatctttaacagcgtgctaggcgggaacaggatactgatttgggaatatcagagcagtggtattcagtcattatctctatttaaatagagataatcaagcaagaaaaaaaaactcattccattagcttgaacaaaaaaaaaggtatttatttttcatatgacaagaagtatgaatgaggaaggtagtccaggactggtatggagctcagtaatgtcatcagtgacataggtttctgggtttaggtgtgaaagggaaaaggccaaaagaaacatggcagtttttaaaagctttcccagaaacatgatctagagatagtccttcttacatctcattggccagaacagggtcacatgcccatccttaatttgaaggagtctcggaaggtgactcttagctttctagttctgatcatggatgaaggctgtggggaaggttttggggtagctaattcacagggtgtgctatagtatcatagtttatttttctctttagagacattgatgatgccacatgcaaatgaccatatagccacttgcttacattgactttaaaaaaccacatacataagagtagaatgaatagtataatgaacttctatgacccatggcctggtttcagaaattatcagtatattgccaaacttgttttat

SEQ ID NO: 2361 - DNA, 1092 bp, Homo sapiens
taaaacttgttttgtgacctgacatatggtctgtccttggaaatgatcaatgtagtgaggcaaagaatgtggattttgcagcccttggatgaaatgtcctgtaaatatctattagatccatttggtctgtagtgtagattaagcctgatgtttctttgttgctttttctgtctggaagatctgtccaatgcagaaagtggggtgaagtctccagctattattagattggggcctatctctcttgttagcactaataatatttgccttataatatatgggtaccccagggttaggtgcaaatatatttaaaattgttatatcctctcactgaattgacccctttatcattatatagtgaccttgtttgtctcttcttatagtttctgttttgaaatctattttgtctgatacaaatatatcagaaaaaatattttttagtttccattggtgtggaatatctttttctatccctttattttcagtctgtttgtgtctttataggtgaagtgtgtttcttgtaggcaacagactaatgggtcttgttttttcatccattcagccagtctatgtcttgattgtagtttagtccatttgcattcaatgttattatttataagtaaggacttacaccattttgttattttttttctggtggtttagtggtctttcttctttctttccttcctgtcttcctctagtgaaggtgataggatttagtttcttgctttttatttttttgtatgtacattatatgttatttatttatttatttatttatttatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcacgctgccttcaagcatctgtttaacaaagcacatcttgcaccgcccttaatccattcaaccctgagtggacacagcacatgtttcagagagcacagggttggaggtaa

SEQ ID NO: 2362 - DNA, 1027 bp, Homo sapiens
gtgctgggattacagacgtgagccaccatgcccggcctttaattgttgatttctagttaattgttatggttggtgaatatagtttgcatgatttaaattattttacatttattgagacttgttttgtggccaagtacgtggtctgtcctggagaatgttctgtgtgtgcttataagaagcatatattctgctgtttttgtatggagtattctgtagattcagaattcaggttggttgataatactgctcaagttttctatattattactgattttctgtctctttgttctagcgattattgagacatatctgatgaatattgttgaattgtctgtttccttatttctgtcattttttgcttcatctgttttggagatctgttagtagatgcaggcatgtttatagttatagtttcctgattaatataaccttttaatgttataaaatgtctattattgtctgtggtaacttttctttcttagaatagattttgtcagatattggtatagctgttctctcttatgattactttttgcacggtatgtttccatttttttatttacaacctggttgcttctttgaatcaatgtatatcttctatagacaggatatagttagatcctgtatagtttttttttaatccagtcttagaaataatctctgcttttgattaacatgtttatgtacacttaatgtttgacaatgtatagaattcagccatttgaaatggcactagttaaatacatttgtagctgtgtaagccaggtaaatcagtactgtgacttcttgctactctcaccctgtgtttggttactagccttaacaggtaagatctatcttgttctcttgccttgtcttggcaatgtgcttgctattccagcacccttgaaactagggctctgttcagttttgatcagacccacctacagcttcctcaaaataaccatttgacctaaaactcaggcttggcagctgggaaactctcatttaagttgttataatactttcccgatctttgtgggaacaa

SEQ ID NO: 2363 - DNA, 1047 bp, Homo sapiens
gatggggtcccactatgttgtcccagctggtctcaaactcctgggctcaagccatcttcctgcctcagcctctcacagtgctgagattacaggcgtgagtcaccatacttggccagcaatgttattttgaagggagtaaataagtctttggattctctctttaaaattgcataacaaggaaaaataggttagggagcagaaagaaattgttgaatctaagaacactgtctctgtaggtatttaacactctatgatataatgatgtataatatttgttttcagttagtgttactgatagcagaaaaactgctagacattattgaaaacaatcataattgaggcattgcctgggcatcaatattatgacttttactattctttggtgactctctgaatttctagggtcacatgaaattggttttgaaaaaacattaatagggggttgactaaatgcaaatggaaatcagattccctgactggttcatgttatacatggaaagactgatggcttcagagttgtggtagatgtgtagaactataaattactgttcttctcaaggttgccttttgttgtcagaacacttagcataaggcagaaatggtaggctgtacctgaaaagaacaaaacaccattaaacataataaatcagcacttaaaaaaaactaactgtaactaccaaggccatctcaagtgtgagttttcttttatgtgactaaagttgttaacaacaacaacaaaaaagaaggcaaaaaagcagcaacaaacaaaaactcaaaccgagtttgatttggatgttctttctattgtgataaatctgaatgaaatcaagcatgcttgactaagcacagggcccattgggagagtatttgtggtgtagagaaataaagataagaatataataaaatgtgactaagtagagtcttatgtggggattaacttctgtgcatgtggcagaaatcaaatagagtcaaaatactcttaatagccccttaaaatttcccacgaaacacagatatagacatactgtctttcaagatgtttaaatt

SEQ ID NO: 2364 - DNA, 1686 bp, Homo sapiens
agacttagattttttcctatagagatgtttgagctccttatatattctggttattcatcccctatgagatgggtaggttgccaatattttctttcattctgtggattgtcccttcacttttttgattgttttctttgctgtgcaaaagctttttgcttgatatgatcctatttgtccatttttgctttggttgcctgcgcttgtagcgtattactcaataaatttttgcccattccaatgtcctggagagtttcgccagtgttttcttttagtttcatagcttgagggattaaagtctttaataatcaattttgatttgatttttgtgtatggtgagagatagggattcagtttcactcttttgcatatggatattcggttttcccagcactgtgtattgaagaggttgtcctttccccagtgtattttcttggcaccttttgtcaaaaataagttcactgtagatatatgactttatctgtgggttctctattctgttccatgatctttgtgtctgtgtttatgccagtaccatgccattttggttactatagctctttagtataatttaaagtaatgtaatgtgtttcttccagttttgttgtttttgcttaggattgcattggctattctgggtctttgtggttatatataaattttaggattgccttttctatttctgtgaggaatgccattagtattttgataaagattgcattaaatctgtagattcctttagtgtagttattttaacaatattgattcttttaattcatgaacatggaatatctttccctttttttgtgtgtcttcaattttcttgcatcagtgttttatagttttcatcgtagagatctttcacttctttggttaattcctaggtatttaattttatttgtagctattgtaaatgggattactttcttgatttctttttcagattgtttgctgttggcgtatagacatgctactaatttttgtatgttgattttgtatcctgcaattgtactgaatttgtttgtcagttgtaatagttttttaggggagtctttagatttttttcaaatgtaaaatcatatcctctgtaaacaaggataatttgagttcttccttttcaatttagatgctctttatttctttctcttgtctgattgctctagcaaagacttctggtactgtattgaataacagtggtgaaaatgggcatccttgttatattctcgatcttagaggaaaggctttcagtttttcccccattcagtgtgatactagatatgggtctgtcgtatatggtttttattatgttgaggtaagttttttcttcttttttttgagatggagtcttgctctgtcgctcggctggagtgcagtggcatgatctcggctcactgcaacctccgcctcccatgttcgagcgattctcctgagtcagcctcccaagtagctgggactacaggcacgtgtcaccatgcccagcttatttttgtatttttgtagatctgcccgattcagcctcccaaagtgctgggattacaggtgtgagccactgcacccagctgaggtaagtttcttctatccccagttttttgagggtttttatcatgaagggatgttgaattttgtaaaatgcattttcagcatcagttgaaatgatatgggttttgtctttcattctgttggtatgat

SEQ ID NO: 2365 - DNA, 1047 bp, Homo sapiens
tttctgcctataatagtatactgtagatacatacaatgtagcccttagagaaaacttaatggaaggtacgtgggaattttctgtacaatgtttgcaactttctagtgactctacaattatttctgaaataaaaagttttaaaaattcgtaacgtgtttattggtctgtcttttaaaattatttcaatagtttttggagaacaggtcgtgtttggttccatgaataagttctttagtggtgatttctgagattttggtgcatctatcacctgagcattgtatactgtacccattgtatagtcttttctccctcactgcccttccagcctttctcctgagtcctcagaggtcattatatcatacttatactgttgcgtcttcataacttagctcctacttataagtgagaacgtatgatgtttggttttctattcctgagttacttcacttagaataatggtctccaactccatccaggttgctgtgaatgccattattttattatttttatggctgagtagtattccatggtgtgtgtgtgtgtgtgtgtgtgtgtatatatataccatattttctttatctacttgttggtaatgggcacgtaggctggcttcatatttttgcaattgcaaattgtgctgttataaatgtgtgtgcaagtgtcgttttcatataatgacttcttttcctctgggtagatacccagtactcaggttgctggatcaaatgttagttctactgttagttctttaaagaatctccatgctgttttcgataatggttatactagtttacatttccactagcagtgtagaagtgttcccttttcaccacatccacaccaaaaaattatttttttttgattttttaattatggttattctttcaggagtaaggtggtattgcattgtggttttcatttgcatttccctgataatttgtgatgttgaccattttttcatatgtttgttggctatttgaatatcttcttttgagaattgtctattcatgtccttagcccactttttgatgggattatttgtttttt

SEQ ID NO: 2366 - DNA, 1019 bp, Homo sapiens
ctagcattcctatacaccaacaacagtcaagccacgagccaaatccagaatgtaatcccattcataattcccacaaaaagaataaaatacctagggataaagctaactagggaggtgaaagatctctacaaggagaactgtaagccattgctcaaataaatcagaggtgatgcaaacaaatgggaaaacattccatgctcatggataggaagaatcaatattgttaaaatggccatactgcccaaagcagtttatagataatgctatttctattaaactaccattgagattcttcacagaactagaaaaaactattttaaaattcatatggaaccaaaaaggaacctgaatagctaaggtaatcctaagcaaaaagaacaaagctgtaggcatcatgctacatgacttcaaagtatactacaaggctacagtaaccaaaacagcatgatactggcataaaaacagatacatagaccaatggaacagaatagagaacccagaaataagactgcatacccacaactatctgatctttgacagacctgacaaaaacaagcaatggggaaaggattccctattcagtaaatggtgctgggataactggctagccacatgcagaagacagaaactagactccttccttacaccattttcaaaaattaactcaagatgaattaaagactaaaatgtaaaatacaaaactataaaaacccttgaagacaacctaggtaataccattaaggacataggcactggcaatgattttatgtcaaagatgccaaaagcaatggcaaaaaacaaaaattgacaaatgggatctatttaaactaaagagcaaactttaaactgcacagcaaaagaaactatcaacaaacagaatgggagaaaattttggaaactatgcatccaacgaaggtctaatatccagcatctataaggaacttaaatttacaagaagaaaaaaacagccccattgaaaagtgggcaaaggacatgaacagacactttttaaaagaaga

SEQ ID NO: 2367 - DNA, 2207 bp, Homo sapiens
caccagcctgatgtttttgggtctaattatattatcaccagccctgtacggctcagttgaagaggtatatccagaggccaatttataatcatttagccaacacctgtttgggagaaattgacagtcaaagggcacatttttaaaaaatcacatatgttcttgtgtttattgcctcaatgtgaacgttgtctagttgcacacaaactttgtaggagaagaaagtaaatataaacaaagcagcatttcccagccatgtttatccatcttaatttgcttttttttttggagatggagtctcactcttgctcaggctggagtgtggagtggcgcgatctcaattcactgcaacctccgcctcctgattcaagtgattctcatgcctcaccctcccgagtagctgggattataggtgtccaccaccatgcccggctaatttttgtatttttagtagagacgaggtttcaccacgttggccaggctggtcttaaactcctgacctcaggtgatccacccaccttggtctcccaaaatgctgggattacaggtgtgagccactgcgcccagccggtttggcctttttatctgatctgcttcatgcttcatgactaagtgagatcagtaaggaggtatcactcctgatttgtgcaggtatattttgttgagtcaattaaggggcttttaatagggagaagttctttcctttggttatacagcttccatgccttttacctagtgagatgtgttctactttatatagatatgtcttgttcaaatagaattggctttctggtaagtgacttaaaagtcacacctcatgtaagctgggtgtggtggctcatgcctgtaatcccagcactttgggatgccgaggcgggcggatcacgaggtcgggagattgagactatcctggctaacacggtgaaaccctgtctctactaaaaatacaaaaaattagctgggtgtggtggcgggcgcctgtagtcccagctactccggaggctgaggcaggagaatggcgtgaacccgggaggcagagcttgaagtgagcggagatcgcaccactgcactccagcctgggcaacaaagcaagactctgtctcaaaaaaaaaaaaaaagtcacacctcatgtaaaaacaaatgagacttaaggaacactaaatgtcttcacagattcaacagatgttcaacagatatttattgagctctcctttgcagaaggaaggccatggtgcctccttttacattcttgatatgttgatttaactcttaaagttcacaaatgtgttttcatgttttggaggctcaagatttgtgttcattgtaactcaaagggcagctatggagagaataagtctatcctatctgaaaaataataaaagtcaaaccctttgtttcaactgatgataccactatttcattttagtgtttttccttcttctgacagactttactattgaaaggcttatatatgtcacctctattttcttatcactcattatgaactctgtgcaatctgcttttatcctcagttcattgtacagtgaactgtacaatgctgtattgaaagttacacatgacttcctaactgccctaaccagtgatggtttctcagtccttattcttcatggcttctctctgttgtttagcatagattacactcatcttaagcattctctttctctgtcacctgaaccactatgttttctctttgtacttttctcattacacttttggttattgtcttatttactcacaatatttcaactatgtatattttcaaaattcagaaataaatagtatcgcttagcaattaaagaggaagaaacctggagccagactaccctctaccacttattatctttgtgagtatggacaaagtcctgaggttaaagaagttccagtgtttcagagtgcactccagagagtacaatcagttttatgcttatttccttatctgtaaacttgattaataaaagatacctacctctttggattgttgagagaattacatgatttaattccttaaagcccagcacagtgcctgatataaaggaagtgtcccagtgggattcattcttgtgtctttagtttttatctttatggagaatgctcaaatataaatcattagtaccgacttattttctaagctctattcccatgtcgtcatctaccttacaaacttttagagttgaattcactaaccgtat

SEQ ID NO: 2368 - DNA, 1066 bp, Homo sapiens
ggccccaaggagtaaaatgattcttttattaattagttttctaaaattataaaactaatttataaaataaattcaaacaaaatagaagtctataaagtaaaaataaaaattatccctccctattcactttgttgcccagacctattccccagaaataggtactcttttaacagtaattatatatcttccaataactttctatgtttataaacattcactccctatctgtctgtttttaaaaaacttaaatgggtgttacatattgccttgagcttgcattttttcccccatctcaaaagtgtaccttggacgcctttagtatatctttatgagtatatttaggtccatattaagagaggcatacactatagtgattaaaaataaggactgtggagccatgctatgtgaatgtaaatgctggctcaccattactagtgtgactttgggaaagttatttaacctttctgtgtctcaatttcctcatctgtaaaatagagataatattaattacctaccttatagggttgatgtgaggattaaatagttgtatatgtaaaatgcttagaatagtacctggtacatggtaagcactatgtatttgcaaatggctattattaattgatatttaaattgtttccagtactcatataaatacatgtataaacatgtatttatacatacatgtttttgttgtattttttgagaattatatgtaggacagatttttttcaagttgaattgcttggccaaaagatgattttgattactgtgatagcagtgttttatcgtacatatgaaatttaagtcctaattctgaccaagcaaattaacaaacttactttgcaatcttatagaaaaacaatagacttaaaatctgaggagagacaaagagttttaattaaacattatgaattctaatttttaaatcttaaaatggttcaatatctacaattttatgtgcttcaaaaagacttagaaaagtatcatttacagtcttagagtgttaaaaattagacaaattttatgtaccttagcaataacaggttttttttaaggttaatatatg

SEQ ID NO: 2369 - DNA, 1375 bp, Homo sapiens
gctggagtgcagtggtgtgatctgggctcactataacctccacctcctgggttcaagcagttctcctgtctcagtctcccaagtagctgggattacagatggccaccaccatgccctggctaattttttgtgtttttagtagagacggagttttgccatgttggccaggctggtcctgaactgacctcaggtcatccacctgcctggtcctctcaaagtgctgggattacaggcgtgagccaccgttcccagcccagctttcttttcttgatgtagcacacgccacctgtgccagagcaaactgtaccttccagaggcagtcattgtgctttgcatggggagcactggaaggtgtccattccaccacctgagtttaggctgccttcatctcttgcctggaatagtgcagtcagctgactggcttccactctcaccctctaatctttgtttcttcctgctgctgagtatgctttagataatgttttaaactctttagcctacaacttgtaaaagtgcaaaaggacttgatgtagatctgcatgctcaatggaacttaaagaaaacaaatgtgatgagggctttggaggtgctttgaatgccttgaatggacagtgctacaaaatacaagattgatatatttattcaacaaacatttattaaatgcctcctgtgtcccaggcactgtgcctaggagccagaaataaaagacataattggtataatattgacagttacttttgaagatttacatgaaaaggagtctacccaaacagaagaaatatacaattggttaactaggatgttaatagacctttataggtgaatagttgtatttatagaatggtagttttctgagcaaacaaaagacatgcttagctgtcccccttcccacagtttagttccatatattgttggatacaaaaaatgctttcttctgtgtttctttctctttgctctttagtcatcggctgcagtggaagactaatgctcagcccctgcatagaaaatctttatacacagcaagagctggtgagagaaattgactaggattttgtaattctagtccctttcaattagcaacagatgctgcagggaaagattgtctgtgtaggaacacagtactaatgtttctgtgccctagctgacatggaatgctcattgcaaaaagaaagatgttcttttccttggtcgaagttgtcaccaatgacagattagatttttttaacctttctctactcctaaatccattaatgaagtctgattcccttggaagaaagttaaattcttgaccaattgtaacaacatttctaattgaacacttaaagaatttatagaaagtttagacattccagctgcctttctgatagtataaagg

SEQ ID NO: 2370 - DNA, 1049 bp, Homo sapiens
agtaactttcaggaattttgaaagcccagtagtatttagtatatgctctctcagcattaaaaaggtcaccttgctaatacatgttaattttgaaagtttaattgacctttggaattttaatatcaaccttttttggtgtggttagaggttggagcaatcactgaagaaactgaagcctgtgattggtggagtttgggtgctgtcctctttgaacttctcactggcaaggtaagcagtggcctggacgtttaataaatttactcagatgctaccttgatttcaaattaagaacattagccttcacccttagtttttaaatcagggactaagcaagaaaaactttgatatcgaaagcaagtagagaaatgcaagtttatcaagagtccagattttttttaaaagttggattgcattacattgaataaattgatggtaaagttattttatgtcacaatatttcatagtgaaatatgactaaaacttttttcttttaattttccatgattcagctttaacagggtcaaatctgtaaggtttatgtaaggatgtattaaaattctctggatgttttaaacatattgtctgaaaccaggagagaattcttatttaagaaaattaacgtagatattaaagttaacattatctttttctcagtaccataaatttttcctatctgttctagcttaaggacagaaattatactctcagatgaatgacttttgaatatgatgtttgagttagtagactttaataaagtattgtgcagattgcctcctgggaagaaaatgaaggaaatgaaggaaatgaacagttacacttttgtaaatagtcatctacctacgtgtgtagataatactgacctaagattgctggggagtttacaaatcacctttacatacatttaaactgtaaagtgctatatatgtatgtaaagtattatgactaacaaattctaaactctgtagggtttttaaaacattaaaacattttaaaggtatcaaatctctttttagttttgcgtataatttaagcttttctataatattctg

SEQ ID NO: 2371 - DNA, 1029 bp, Homo sapiens
tgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgtt

SEQ ID NO: 2372 - DNA, 1074 bp, Homo sapiens
tctatgctcctattcttttcccccctctactattaatacattgcacttttaaccatttatctcattggtatattatttctcaggaagagtaagataggcaaacaaccttttctatagttcccacaattctgaaaccagtgaggatctgttggtttgtagagagattgggcccacttttctcctgtctctacctctgtatggcagtgtgttcttcccttgatttaactgttagtgtgtaggcaaaattctcaagcttttactttgaagaaatatctgggaatcacagtgagtgatgtcttacttcaattttagggatacggggccatatatgatccggttgtacagttattcctcgaaaagatcaatagaaatgggcagaaatgtaatgaaatggtacaactgtgattgctattattatgttttaatttttcgttcatggctttccaaactgttatatataatttaatttttcaggaaaaattatctcccactccaaaaggtaccatctgttttttgaacaaagtagctaagataagaactattaagaacaccagcttatcaggtcaacccattctacattcaccacattaaacatatatgttctgtaggatagaacacactacctcattatcccatctagtagaagggaaatagtgaatgtgtatgcaagttaaactgaatttcagtgcacctgctccaagggctcatgtcttggattttaaaaatatgttcagtatctttgcaaatgaatctgtttaatcaaatattaagttttattcaaattccaaaagaaacagtcagccaattgcttttcttcatgatgttccttgtcattcatcctctttgcatctcaagaaaaatagcctagtttaggccccaaacatttgcatgcacccagttaaagcacaagaggagtagtataagccgttaagacgtgcaggtgaagaaattgagcctgttctctgaaacagccggctttttctactcaacttttagggagaatgttagaaagacttgaagtttagaaaggaaaatggtttagtaatttgaaattaaaatccaaccaggaaccat

SEQ ID NO: 2373 - DNA, 1047 bp, Homo sapiens
tgagacttgcctagcgcagctgcctcttctctgcacccacatctggaggtgctggtgcagggcactgctcccgagtcaggcctgttctcaccatcatcccaaggagacaggttgaggttatgcagcggatactggggcaagatccctcccaggtccatccagggccatatccatagtagttaactcaggctagttttgagaagccactagtttgcttcttttcccacccactgcttccaagtttaattactaagtggtggtctcagaaaccctggttttcatcattactcacaccatccccttcttttgctttttcaaattacagccccagtttgcaaatggggaagctctgggaccagtgggttgaccgtggttatctaatctccccaccccaggtttggaaaaaagaaacaaaaattgctttttaatttgtagtaataatgaatattagccctggagagatttcctgcctgagagggttactaaacctaaaagtgggtgacagacggaagttgtggctttgtcctctgactcggactagacacttcagggctgaggtggcctagatgggatcactggagctctttttaaaggcactgatattatgcatttacagggtacgtccaacaccaagtgggccaagtgaatcagggtcgctgggcattagacccagaaatctgtgttctggaagcatcccaggtgtttctcaggagtttgagaagccctcagtctccttccacttccgagattagggtctgtgaaggttgtgtctggtctgaatgtccactgcccactccaccctctacttaccccactgtgccctgattagccagcagggggagcccaaaggaagccagctcttaaaatctgctcttggaaacagaatttgttaaattggggataaactcaaaccttccttttctcctagagtgtgtgaggaagtgcactggcctcatgcgcagttctctgtgtgagatctgtagggagagaggagcagacagacagcatcccagccctgtggttctcccagcagggccttgctctgct

SEQ ID NO: 2374 - DNA, 1005 bp, Homo sapiens
acaacgggaaagcagtggtggaggtggggcaggaggaggtcacacaagagcttccttggggactaagggactgggtagttcgggcatgaagagtgccctccacgtatttaagagataaagatacagcattttctggaaaggacaatagtcctgcaagtcctccatgcaggaaccttcatccagggcttttcttcactccccacctcgattccctgttcctcaaaagtaaacttctgggtttatttttttgttcttttgccccaatggcccaatacaggtggctgatagctgatcccttaatgggccaaaatctgctctaatcacagttagcttggtctacatctatattgttctctatcttagactttggaatggaaaagcattcagcttgccagtcttctttatgtttattcccctcattttctaatcatctttctaaattgctcctttttatattctgttggctatagcatcttgatgtaatgatttcagttgctggctgaattgtttagggcaattacagttgtgtgtctctgggtacagttctttgactcctgacaaactagattggaatggaggatattgagacagggtcagttgtcctttgttggttgagaggcatgtgactcctttcagtagttttgggataaatgggagtggaatacaagatgctgtgttccaagaactgagagctagaaaaaaaaacaaaactggtagcaaaacacagctttccagggctttgatatccaacttatatgttgtctaagacctttgcttctccctcttaattttttttattgttcttagtactttcatgaactgcttattgttttgataaaaagtttcattgataaaatcgattgaaaaaaaccattaaaatggccgttaactttatttagtaaaaaaacaaattctcaaactcttgcctaagtaactggaaaatgaatgatttttctttttgtttatgttctgaaggctaaaataaaggaaagttgctatattttc

SEQ ID NO: 2375 - DNA, 1052 bp, Homo sapiens
aatatacaagtgaaaaagtgtttttaaaaagtatgtaatagctaacatatatggaaagcttaccaggaaagcttactgtttctaaggccttaggaagtcaccatcattattatcctcattttacaaacaagggaaacaaggcatagagcagctaaataacttgcccaaggtcatacatccgtaagtgcctgagctagaagaatccgctttgtttttttttttttttaaattttaaatctttaatttctgttttcacgtattttcttcttgcttccaaaaggaaaggagtgcgtagctctgttgcctgtacatcgtccacagcccctgggttggagcggggtcccctgggccgcccgggggtccacatgcagcccctggggggccggcgcggggtgaggtccgggggctgccttattgctgaggtctggccggttggtgccgccgctaggcgagctggctggcagctcctgggagatgaagcgacgcaggccctccaggtactggctgtagagctcgatgtcgttgtgcctggtgccctccacccacagcggctccaccgccttggggcagcgctcgtagagcgccagcccgtgcgagaagtcgatcacctcgtcctccgtgccgtggatgatgagcacgggcgacgtgatcttggacaccttctcgatgttagggaaggcgtcgaagcagtaggtcttcttggtgtcggggaaggcgacgcgcatgcccgaggtgagcggcgaatgcagcaccaccgcggcacactcgtagcgcgaggccaggtccacggtgggcaccgtgccgatgctctgcccgtacaggatgatgctgtccgggctgatgccgtacctggaggcgccggagcagggtcagccgcggcctccgacgcgcgcgcacccttcccgccagcgggcgtccccgggcccagctccggatgcgaccctccagtctccccactcagccaagtcagtgggtcaggcccaggctccacaccagtcccgagggccacccccagccctcaacaccgcggcggtgggcgaagccagcggccc

SEQ ID NO: 2376 - DNA, 1734 bp, Homo sapiens
tttcaggtctagaaaatgaaaactaaacagtactttttaaaaattacctctctattagccaactaaatagtgatacagtcattgcttctaaaaggattttgcttgtgggagaattttctggtttctaacaataactggttttagcagccaaacttgaaaatgaattgttaagggagatttataggatttatttcctattttttaatttttgaaaggatagtaaagactccctttctaggatgggtgtgtctggccaaagatgatatactacatggcttcaaagaagtttcctatctattggcttcaaagtgtgatcatctaaaatttctgtgttcatatggcttattgcagctgtatctcaggaatttagtagtcaatgttagactcaggtttaccaataatacttggtaaattcacaaaataagggagttattgtcttctgaacaattctcattaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtaatattttgggatggtatttatagggatgatatttgtatgtattaatcagatgcgtttgtcttttcctttaacaatataattattatactttgcaattttttttcctggtagaataagtaatgattcggtctctgtaccgtaacttgaaagagtggaagattaaaaacaaacaaacagtgatttggttttatcattgcatagctcagtacgatataaatttatcaaatgtttgctgcattactcatgtattcattcagtatatgtttattaagctgtaccatgattcagacactattggtcactgagtaatacaataataaatagtactatcatactatcaaattgatagtatgataatactagttacatagcattatttgatagtatgatagtacttgttaaaataaaactatcgacagctgttaccgaaaagatggaaattagttgaagcatactgatggctcgtgttttctctgggtggaaaagctgctgtagagaatgagagggagaactagggaattataaaaggacggaatagcatggagggcccagttgagattggagacagaatataagcaggcccaatctgcaaggttgtgtgataatttaaaaaatgtttccttttggctgggctaggtggctcatgcctgtaatcccagcactttaggaggccgaggcaagtggattacctgaggtcaggagtttgagaccagcatggccaacatggtgaaaccccctctctactaaaaatacaaaaattagcgaggtgtagtggcgggcacctctaatctcagctactcaggaggctgaggcaggagaatcgcttgaacctgggaggtggaagttgcagtgagccgagttcgtgccatatccttatagcacatttggttttaaaatattcttcttatctagtagactacaaaaactactgaatatggttttaaaatttacactgctaacttccaaatgcattgcagaaacttattttttccatcagttgtcactgattaggtttctggaaggtctccaacaagtgaggttgaaccgtttggaatgtttgttaaaactgtggagatt

SEQ ID NO: 2377 - DNA, 1045 bp, Homo sapiens
ctcctgcctcagtctccccagtaactgggatttacaggcaagcgccaccacacccggctaatttttgtattttagtagagacggcgtttcaccatgttgcctcagcatttggaacattgtggaaagaagcattttaatatttaaaatttcccacaaaatccattatgcttgaaacagactatcatatgagggtaatgggcaccctctgatgattttacagcttttaaattacataggctaacaccattgcattttaacctctcatttccatgcaacaaaatgttagatgaatcgttagacatgccgatcttttttttcatggcacaaattaggaagtatttatttaagtgggctaatgctttacatccttgctaatagttcctaaacataaattgtgtgctaaaacaattatagcagtttttctaaaacacaaaatatttgttcatttatgtgagtaatatttattttgtcttgaacatttttattcattattagtatactgcattggaacaaaaactgaaaaaattgacggaagatttgagttgtcagcgacaaaatgcagaaagtgccagatgttctctggaacagaaaattaaggaaaaagaaaaggagtttcaagaggtaaggtaaatggattcatgaggtgtttgtctgaaaggctttttatgggcttttcatagtttgatcacttggaaaggggagttgttatcacaatttgggaaattctcttagaggagaaatgctttgtgagctaaaggtcatcttattttctttcacatcttcacttttgcgctttttttaaatctttcagtttttgattagagaagggaattagtattcagaattcatccatgttttctgatttgtttgagatttgatattcagtaggaaaggatcacttttcttcttttggacattttctctgctgtggaggaaattgtattacattttccagtaggcttttaaaatttttttttctttcactctatttcctttataactccagtatttttttttttgagacagagtctcgcagtgttaccca

SEQ ID NO: 2378 - DNA, 1071 bp, Homo sapiens
agattcagaacatataggcctccctagtagtagaatggaactacacatgtacctgtgttactttattgcatgctgttgcgtggatgtctcttcaatcagatgcccaaagaacctgttttcactgtgaaagctcagaagctagaattaattcttcctctgtgttccagccctctgatttcccatagcacactcaatgtctctttagtatttagcatatcctattgtgtattaaatgattagtatcacatcttcccccactggaggatgtctgccccaagggcagagactctgtcttatttatatttgcattttttgtaatgcacattccagcatcttgaatattgttggttttcttgataagcatttattgaaggtaatttttcccacagaatcattcctgtaacagcaaaccttaagatggttttgcaatgaaaagtaaacatatgtgctgagatttttttttttttttggtttattaacaaatcaaatgtttgcaaaggtatatttggccattcaggtgtgataggaacttggaggttttgtcttgaggatcttgtagataggattttccttttgagcttactctttaataggcgtatgaacaatgagaaagttcaatgaaacttcttgaaagaaaaaattatcttcagatttgggtttgatgctgttgtcttctgttcataacattatttaagtaagaatgtctgacttcattaggtactcaaacggggaaattgtgattctttccctagtgagatacacaaacagttctgctagggacctttattaaggcagaagtcataacttacttgagcattcgttttggctataaccaattaaaatgtgtgttttaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaaggtaagtaaacttagtattttagagttacctttctaagctgctattcccgtgagaggggatggatggcattaacatattaga

SEQ ID NO: 2379 - DNA, 1625 bp, Homo sapiens
taagtctaatcctgtggatgttttagctaaaatggtggagtacttatttacttttctgagacatcagaattactctacaataaagtgggatgttcccatttcagtgctgttcttgtcccagttttctctcttggaataaatatttgaaaagatggtaaaaatatacacatatgtaaacacatacaaagaaaagaaacagtgcttaggaaaatcatcccttggtattttattcaataacatgttcttaagctgctagaaagaagatgaacaaatgtgttactctccttaagataaccatttttctcatttttatataagataattaccaagtgatccactttctaggaggtacccaggcaataatgccagtttttccagggcttgagtagttgttagtttgtttggattttgccagggggcggggggaggggttagcgtttctgtagaataaacatttattacaaacattgacgacttttatttatttttaaatagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagt

SEQ ID NO: 2380 - DNA, 1960 bp, Homo sapiens
gaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgtaagtacctgggatttaaatgccatttctcggtttacatgactagtggacactcagtaaatgtttgtctaattgaaatgtacattaaacctaagttaaaatatttttagggttcaaggaaataaaatacaccaaaatattttcaaaacaaaccagaacttgaggaaaatgagtaaacgttatttgaggaataaatttctatagggattagatttacatagcattatatagaatattactaaagatgtttttaaagtctggagaaaattatattatggagtcagaaagtctttagaatgtgtgtttccaccctttgtgcattaataaagtatactgaaataattaagaacttacaaatggtaatatgtaaatttttaatctctcccacttttcagactatttttgatgttatggcattatcgtcatgaa

SEQ ID NO: 2381 - DNA, 1052 bp, Homo sapiens
taagagatgtgtttagcagaggccacgcatcagtttctaaaaagtaataactaaatctattctattttgattctttttgaaaaataaaatgcatgcttgttatgtattataattacaggctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaa

SEQ ID NO: 2382 - DNA, 1033 bp, Homo sapiens
gcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaaaatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcatt

SEQ ID NO: 2383 - DNA, 1977 bp, Homo sapiens
tttatgattgaaggctaaaataaatggcatgaatatgttgtatcagagtggtcgatctgatcaaaacagaccaccaaaaagcagattctaatgaaagatgaaatttcaggtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagtaagtttctttgtgacaagtgttattatgatctgttaattcattgtgcacactctccttattggttcctgtaagaccttctgttgtttacctaacttatttttagctcttgaaaaaaataaccctgtgcttatgtcataatctgatttatagtaatctctaccatccagcactatcaggagcccacaaggagtcgtgagaagcctctgaacacatgaaagtatctgtctcagagcccaaatacattttcatggaagaggacccttggaccacattaacgcacaacagaagtagatctcatgccgctttcaacaagtttatctgcctccctagcttgccacagattacagggtggaatgttgctagaaacacattcattgatctgctaagaactaacaaagtaacagaactaaagtcatagttttaggcagggttaatgtggcacacctatagcacttgggctgccactgcccactgccatttccatagtagatattactaattcataccctccctttttcctgagtctcctaacactgtgtactgggtagctgctaccatgcagagagagctggcagatgaaatgaaacctgtttgtcatacctgattaaattataaacatccctatagctgtttagtcctcatgcaacttcatccctgagtagtatttaaagaacagcaaaataagatagtcatgattgcgaccctgaataatcacagaaatttgaaatgatacatgtaatattctgtataaagagttggagagatttgttcttttctttaaatatagtatttaatctatgaaaatggaaaggttttggcatcaaatctcaggaatggacttagaccatattctggccatactgcatggaaggagttcctctgaatgatatttgtgtattgcgtctgctgaaatctcttttggtgttgagtagcttgggagtgtcccaagtgcgtcattattgtattttatgtatgggcactactgagaggagtagtttggcctcagccccatacatatgagtgtgttagtttgcattggctttattcattcatttattcattctctaaataataagtgctagtaaggtcaggggatagactattgaaccatacctatcctgtgtttcctgcactcatgcagcttacagtctagacacataataaatcatgaaataggcaacatgtaacaaataagcggataaatactataaaggaaacaaataagattctttgctgtggaataattgggatgtggggatatcagggtaggaaacaacctaatttagatagggtggtcagcagatttagatagggtggtcagcagatgtcacttgcaagatgacgagtcagctatgcaacgaccaggcagtggtggggagccttctaggtctagagagcagtgtggtcaaagctctgggactagaaagatctttgtattttttttagaaattgaaaggaagccattgtggctggagccagatggaaaatgacatgcacaaagattggaggggtaggaagggtatggagggggtgggaaaggtttggggtgggaatattcacttggctagttcaacatatagggagtatttagaaattatgggaatggtagaaaatgatggagaagagaaggcggctcagggcctagcctggaggaactctagcacacaaggtgagatggaggaagaagagccagcaaagaagacagagagaag

SEQ ID NO: 2384 - DNA, 1026 bp, Homo sapiens
cagttcttcacagtgaagggatggggcaaaagattggagggcatttggaaggaaattcttatagtgacagaactggagtctaagctggtcaaggaagaaaatgcaagtccggaggggatttggtgtgaagatggtagtggttctgttgatgaggtcaggaattattgcaatggaagtactttaataaacaaggttggaagcataggaaggtgtggtcccagagtggtttaattgaattcaaggtttcagagtttctgtggtctctggatatgaccttgcgaggtggttgggctggagcagaggaaagtgttattggaggtgaagtcacaattaaaagtgaatacattgctaaggattatagcactattctgtacagattttatcttgcccataaatattttttttctacacagtacacattatttcctaaaaatatttccaggttcttaattatgaggaggtgctattatgattttattatttttctgtttaggatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacaggtgaaatgtggggtttggttactgggggagctggagagtgtattttgatcatggtaaggcttttttttttttccaaaaaaaatcaatattctgggttattactatgctatataatcttttaaaaggtctcacattaacttcacgatcttttccccaggtccctctcttattttatcagttgattttttttttttttttttgagatggggtctctctctgtcgcactgcaagctccgtctcccaggtttgcaccattctcctacctcagcctcccgagtagctgggactacaggtgcccgccaccacgcccggctaattttttgtatttttagtagtgatggggtttcactgtgtta

SEQ ID NO: 2385 - DNA, 1047 bp, Homo sapiens
tgccttcagatgctttcagagtgtttttttggatttgcctggtcatctgttagaatcttgtctcccaaagccatacaacagaagcttcataatctttgctgacttctgttcatccacttatggtagacagaatggactggggaaaataaggatgtaaaaaaatgaatttatttgattggatataactgacgctgcaagaacgtttaatgagttggctgaaatatgagtttgagactttggtggattttatttaagctgtcccaatgagtgtcacaggactagaatatctgccttgatatgatatacctcccgaacaagagttgtttgaactataagaacatatacagatatatctccccaacctcttaaaaaaaaaaatcaaagaaagaacacgtctaagattatctgcttcacgatgcccattgttaactagagaagcatcaagttgcacatgatgtgttgctttactttggacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtagaggaccaacacctgctaccccagagagcttttctaaaaaaagcaagaaagcagtcatgagtggtattcaccctgcagaagacacggaaggtactgagtttgagccagagggacttccagaagttgtaaagaaaggtatgcctaatttaaagacaaaattatttgtgttcttttgaaattccatataatggttcacatataaaaagacaaaagtatttgcttttttac

SEQ ID NO: 2386 - DNA, 1044 bp, Homo sapiens
ctggaatagcttcaaagagtttgaacagtctgtgattttaccttgattgctcacttgtcagagtttgatcaagtatgcgagctgataaccttgaaccagaaaacaaagctttgaaagtgtaataacccctatttgtgtaatgtgataattcataagtgagcaagcacgttcttaggatttgggataccaaatatgaacacattggtggttacacgtgggcgatctaaagagtacaatatatttagatttcttgatctaaacatcacaacaacagatttgcaaatttctttttgttgatgtataagagctataagcattaaggaattatacttagtaataaatttgttcatcatatacattatattaaaatttttcttcaagtatgaagaagaatgctctgagattttctttcactaaagtggacccatttgttactcttattagaaatagtctaccattttgtgcaaatttttctcccctcccctaccaaattctctctgttactcacattcggatttaactttggcatgctgccaacaacaaaatactgaagtatatactggagaatatatatttaatatactgaatatactgactttccaatgaacatgagaacagcttctcttttaagcaactagtgcccctaaaccgtggagctaccaagcttgtccaaagctgtcaactacaagatatccactggatactgaatacaggagaagtcaggtttagggtcccgatatgggccataccattttctcagaagggtgactgggagccaccctttcccaaacctcagtaaaaagtaacatccattcctgtttgtctcacacttctggagatcaaacgaagtatttgactctcttagaaaaccatgacatatagctggtactctatgcctccactgtctttaggcagctcactttattgtaatctcttgtttaaatatctgtcttctgatttgcaatctgagttctgtgaggttactgattacatctatagtttatgtctatgcagtgtctgacattcaacaaatattcactgaat

SEQ ID NO: 2387 - DNA, 1029 bp, Homo sapiens
agcgaggccgacttgtccccagccccaaagctggactggagtccaacggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaagaatgattcctaagtgtaaaggcattcgaatattggtactatttcttgctaattacaacagcctcttatacacgtgaaaatgtttgaacaaatgatacagatctttaaacaaatgatcttagcatctttagttgtattaaaagacacaatttggaatacgggtcataaggagtatatg

SEQ ID NO: 2388 - DNA, 1050 bp, Homo sapiens
tttccctgcttggtttaaaagttttctgcatgtttcaccaacataaacatattcttggattgtgggagttaggagacagatgaagtggagagaagacccaccagcctcatgcttattatgagaattctgaagcatcttccctttcatagggtgctgtgctctgaagcattgttgagattagtatcttagttgtgaatgaagacaaacaatacagtataagtgagtgactaatgtagaaaacatgaggaaaggtgccaagttcattttcagcgctgatggttgtggtgtgacactctcatgccagccaaagaggtgcctgagggaaaggtttaattgcacttttgtgtaataactactggacaggtgtcaaagggtagctccattattccagttggctcaaaaaagggcaagaaattctatcaggttcttgtttctcaaacaaaatagagttcaaccaattcagtatttgctataactggtgagtgtatgggtgtgtaattgagaaaggcgggggaaacttggaaaaagctaagaagctaagacagaatcagtatgaatcactatgttttgggaagttatatattatttttgctgtcttgattttgtgacattgagccaagaaatataaacatattaaacagttttgcaagacttccttttctctgcataatgttagcaagtcattaataaacttcccatgcagtatattaagaagttttacctggagcctaaaagcacagaaatttcttgtaggttattaatggcaatgagtcaactcactcaaagtgagaaatacacattttatggggcctgaaacaggatctgtctatcaggatattattggaatgtcttagtatagtgcctttactcatgactaatttgggttgtaggaagtttgatttattcaaatataaattgtgttaactggttactttgtcaggtgtgtgtgtgtgtgtgtgtgtgtgtgtgtgtgtacaaagcttgagattttcaatcatcactatgatattttagttactatgattttttaatttcagttctcactatgat

SEQ ID NO: 2389 - DNA, 1060 bp, Homo sapiens
ggtgttcttttccgcgcctaattaggggatttgtaatttgaaagatttctgtgatgggagtgcagtaggtttgcagtacctagttatttattttcagaatttcttggtgcatgggcttgaaggatctgttcaacttctaggacagtgtgtccagaaactgcagtttgaacatttgcttttaggaagctctggatattggcacggtgtgacgcccttggagtaaacagactgaatgctcttctctgtctgttctctttctggccttccgcccccccccccccccgccccttctgtgcctgttattaagtttgttgggggaaaaaatcgtagtttttgtggatttcctataacttatgagtcactcctctcagaaaagggagtttgccagctgtttgaaagaaggattagttgagttttaggcttggtaaggagataaacaaggaaatgctctggaatacagttaatttttctgtgcttgagaatatgattttcaaccagcattttaaaagtattttaatgtcttagaaccatagtgataaaaaatgtctactgtagtgctttaatcctaaacatttgatagctttctagaatttaacacagaaaaccatggtacttcgttcttagggtttttcctcttcccccaaatcaaaacttagataatttacaacgttattgcagttgtatagaaaccagtcttatggagatttatgtctcctaatgtaagaaatggagtttttcctaaaatcacgttaaaatattggaagtttggtaacttgtggaatacccctaaagaggaggcctgcaatgtgtgttgattatactgaagagtagcagtataatcatttacaatccctacactggtttctacttgctattgatagttaatgtatttcttttctttaattttctttttttttttttttgagacggagtcttgctctgtcgcctggctggagtgcagtggcgcgatctcggctcactgcagcctctgcctcccagtttcaagcgattctcctgcctcagcatcccgagtagctgggtcacaggcgcgcgccaccac

SEQ ID NO: 2390 - DNA, 2103 bp, Homo sapiens
gagataaacttttaattgtgattggaaagcatgttttgataatgatagaaaatttattttggagactaaggcactttttatggaacagtgcatacacggcttctgctgttactgacactgagactgatactgctaaatgatttaagtgggcagtttagtgacatctgtgtgtcaacaccagtgtattctgaaagtgctctgttgtaaccataaaatgcctgcagatcgtacagaagaatcaagtctccgttttgtacagaacatttaactgagttttagagtgtgattctgtttatcacacataagtttcaataaacatttactgggtgtgtgctaggtgctaagaacaatgcttttaggtggtcctctctggctttaagaaaaaacaacatctacttttttaatacaaaatccatttctgaaactgagtttgaaaagtgaatttacagataatccatttatcaagatatgtaaaatattatgagccattgttgcctcaggtgcctggatggacttgcaaagttgagagatctgtgagacttctgacactactctgtataagccttggtagtcacagtcaccctggcctgcaatccagtgctatttaatagcccacttagaagatgggaatgggaagtaggatgtattttgaggtttgttatgctgcagtgagcataataaaaaaaagtaagcaacttccacgtttttgataattccaggctgctaatttaggtaatggcagacaatagatggatgatacagtgtatacatgcacagcctgggaaacatcccttagccattttggctggggtttggcctgtgtttcctggtgatagtgcatggtaactagtgccactattcagtcaccttgtttagtttaagtatgaaaggtaaaaataaatttagggatttcatataatgccagaaaataaatgtggagtgaaagtagaggtttgctaggctgggtgagataacattgtagttcaaggtgatatcttaaaatgaaaatactcagagaagggctggactgaacaagtactatattgctttgtttgccatatcagtttacataaattattggtttgttgtcccagtctattatactgtactttggtaaagatcctcccttggtaatatacaagcttgatcaaatgacaacctcagaacagtgatgtatttggctgaatgatttttgaatgaatgaagtcagcagttgcagatagcccaagactgcctataaagaaggtgttaaatgagtaatttacagtgaaattactatgagcttaaaaagagataatacaggattggatatttagaaaaactattacagggaaggtaaaacctgagtggtatcaagaaagatggacggatcttgaattattggacatgaagagagtgatctagctgaataaagataccaaaatggtagtaagcatgaattttttggggatatgaagaagttttgtcctattagaggggaaaaccagcatttgtactggagagatgagatggaacctgaaggtaattttgaatgttatactgagaagttgagacttggtgtgatgggctaattgttgattcttcagcagagattagcttattggaaagtagtgttttaagatgcattatatggcggataacaagttgtttattgttattgagagctgcttgtataatcttaactctgaattgaaagtagcaacgtttaaaaatattaactgtaataaatatattggtacagctataactataaaacatcttgtaaatcattagccagtgtattaaaacaagttaactaatactgaaatttcaaatcatgttctcacttataataccagatgatttttaattgcagatttagtacctcaagacaaactcttatgtggattccagattcttttttttccaggtatgtcttataattctttagtgtatattttaatacatttatttaccaaaatataataatgtttgtcagttaaattttttttaataaaaaaggttaactcttaaaattatatatttttgaacttggaagatagataacttacttttagtggtctttaacatttggtaaagaattagcacatttgtttatactca

SEQ ID NO: 2391 - DNA, 1048 bp, Homo sapiens
ctgtgttataatggacttctgagcaagatttcattttaaaaaatgttcccctgtcaaataaaaaatgtttgaaagtatggggaatttcagttctaaagcagttaaattattacatagtacctaacacataatacctgtaccataattgtaaagagtggctggcagactgaattaattacccattaattcagtaacctaaagcttatttattgtaaacagtatgacaataccagaaatctgttgacagaattttgtctttgtctttgtttttttcattttcattttattttttaattgtaattaaattatttgtaataatttgctatattggaagatgtatttcggctttaatgaaattcacatttttgtttctttgtcacaatgtgatatttttaatttttgaaaggtgaacttaggaatgtatttgttttcttcttctctttataggtattcctagtcgtaaaataaacaacacagtcagatctgctgattctaggaatggtctaaattctacagaaggtgaagcccggggaaatggtacacagcctgttctctctggaacgggagaagaaactgttaggctaggtaagcaaagattacagaaatagaaaaagaaaaatacgtatgtttttagtgctgggtgatattgagtaattacttttaaagatttttgcctcatctccttttttatccagatttatcatttatatcttggaaaggtctcatttaacacttaatttttatttaaaatgttgtgtaatcttctatcttctctgaatctttagaacagggttgccaaaatttatctggtaagagccagagattaaatattttaggctttgtgggccacgtgttctctgtcagacctactcaactttgccattgtagcatgaacacataatggacaatatgtaacaagtaagcatggctgggttctaacaaaactatttttttttttttttttgagacggagtctcgctctgtcgctcaggctggagtgcagtggtgccatcttggctcactgcaagctctgcctcctgggtttacg

SEQ ID NO: 2392 - DNA, 1008 bp, Homo sapiens
ttgtatcagtaagttacaaaacctttaaaaaaagagtagtacagtgaagacctgtatgatgttctcctagcttcactaattttctacatggttaggttttatgtttatgtccctttttcttgctgagtttatgacagtgttacttctattaacgaagagtagttgtgtgaattgctgcccccttggggcttatattccactttagatctttaatccttgtggagtttacttttttgtatgtggtatgagatttaaggatttattttcttctcagtgggtaggtaattatgttctgacaatttattacgtaaatcattctttgtcagtgaatctgatagcccattttatcttgctttatgtgtgtgtatatacttggatctgtttttcagttctctcatttccttaagacatatgtctattctcatacaacttgaggtgaagtatgttcataataagtttcaaaatctcacagggcatgtcctctctactgtattttattgaggtcttcatgtaggaaataactagacgtaactctattcttcgcatagctgtcttaaccagagggttggttcactaggcagcagtaagatgatggagaggtgaaataacagagcatattcttgttttatattttgttttatttattattatatattttttgttttgttttgtttttgagattttgagacagagtcttgcactgtcacccaggctagagtgcagtggcgtgatctcgggtcactgcaacacctgcctcctgggttcaagcaattctcccacctcagcctcctgagtagctgggactacaggtgtgcaccaccacacctggccaatttttgtatttttagtagagacggggtttcaccatgttggccagactgttttcaaactcctgatctcaagtgattcacccgcctcagccttccaaagtgctgggattccaggcgtgagccactgtgcctggccttgttctacatattttaaatgtattacttgtatggaaagtta

SEQ ID NO: 2393 - DNA, 1035 bp, Homo sapiens
gtttatcttaacaaatgaatcccatctggtggctgaagagggtggttacaaattacacaatgcttaggaaaaattgatacatttttctctattgctttgaagtttagggaaatcattagttcttcaaattaatatgctcaattgtatattcttatgaattacagttgtattacttggcatacatatttaagggaaaatgaagttgatgtatttttatttaggcccttaggtgaccatcatttatgaatacctaagtttgctttttgcagcgaatgtcaggtagtgtgcaaaagaacgcttcttttccttcatcttctatattctctttaggtaagccaaaagagaaattttatagttatgtttgcattatttgttgagtttaaaaatagatacttcatagttcaactcattcattattatgattacgtaactgctaaagctctaaatgtatgaaggctgctatacatataatcgcatagaaaacatttctttaaaacctaaattcagatagggcagaaagaattattaaaaactgacaggatatttattagagaaattaggtattaaagaatacattagcttttacatatgggtagtcatatggaactgtagttccatagagttttgcatttagacctttaaaaactagtcttcagaggatatcctgcaccctatccttttttatataatagtgctaatgtattggaatgcatgtgatacactcagtgtttctggatagactgtccatctgaagtacaaaaagcaagagattcagtatgtgtcatttcagttaataaaccctgaaaagctgattaataactgaaaggaataataattctgaaattcagatttttgctgattgttcatactcacagaagatgacagtatcatttgtgtgtgtgtgcgtgtgtgtagagaaacatgaaagataaaactatctttttttaaagtttctgaaattttttaaaatttggaggactttactaaattattctttggggaaatatagaactgtagtctctttcaagtcgttat

SEQ ID NO: 2394 - DNA, 1558 bp, Homo sapiens
ataaaacattactcccctgccccactgaggagtttctaactcttgctggttcctcatcttttgcccagttgctgagtgttggattgcccttgagctctttcctggactctgtattctttatctgcactttcctagttatttgaatagtaattatatgtcagtggttcccaaactttcctccacctgtgaccatccaaagagttccaaaccctgtatatccagtgtctggatctctggttgtatgtttaataggcatctcaaatttaagttggacaaaataaaacttaatgatttctccctcaaaagccatcttagtatacagtatcaccatctacttatctactcaagctgaaaatctaggaatcacccttgatttctccctttctttcacctcccacatagtacaattcatcagtaagtcctgttggttttgctgccacattatgtcacaaatccagtcacttttcattgctgtcagtctagtgtctcacgtcatcatcctttctcccctagatgactgtagtaacttctcaacttttccctctctatggtacatgttccacacagcagccagaagcatcttttagaaacacaaacgaagtttgattcctgatggcttctaattgtatttagaataaatttaaatttctaccatagcctgtatggcttttcttgttctagattctacctacctttaaaatttcttcccaatcccatgtcacttttctcattgctgataacactctaacctgttggcttttctatttcttaaaaatgccttcgaacttttgtgtttgttctttttatttgaaatggtttgcccataggtatttgtttgactgcattcttgtcattctggtgccgtttcaaagcccttctcaatgagtgccccttggccacctgctttaaattaaattagccaaacctctgtccaacaataactttctctaacggtaccttgctttgtgttcttcatagctttatcacttattcatttatttgcttgtttattatctctatctcttctagaaaattctccaatagcagaaactttgttgtgttctcagcacttagcataattctgacacgtaaaagatgctgaataaatgttatgaaataaggcaattcagttctctgagaaaatgggccgttttgaagggttattgtgatgtttagatgataatgtatagagatactctgtaataattgctattattttggtggttataatgttattgtgggatgtgataccaaggaactactttgtaaaacttgcattttaacatcagatatttcatgtaggtttgaaacttttgtaagtttgtcaagagaaatatcctttttaacaaaaaatctggagtattttgtgtatactcagttatgttattctgccacctggtggatattaacacatatgtaatgacattgttttccctatagtgcattttaatcccttaaagaaaaactttggataatgactaatattagcaaaattgacgtaattgtccaattgaatcaactaaaaatatttaaattatttttctgaatcctagtaagc

SEQ ID NO: 2395 - DNA, 1723 bp, Homo sapiens
tgagtttttaaaagtaattttgtattcttttgtgttctctttctctgctagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggtgggttaggttattttagggcatttttaggtactatattaactgttcagaagaagcatatcaactaataaaaccacaaaaatgagttttaaatacaaattttccattttaattttgaaattctaaacagaattttagtgtgtttttctgattaaattctataaattcacaaaattattttattgcagcgtttttccttaaaatgttagagcaaatttttcctcttattaatgtttcatcatttaaagaatgtcatcttcacatgttaactacttttatttattattaaaactatgataactgtgtacatttgacatttgaaattttttttgttaatctactgaaaataaaatttgaagctagaaaaacgttggtccctataaatgagagtcattttgatgacatcgtaatattcattaggaaacaatgtagtatgtctcctttgatattctctgatttcagcaaaaggtgtataagtttagtttaggttttctctctatacaccatacatacgtgtgcacatgggcactcacacatccacacatgtgtgcatacacatatacagtcttcatagagatagatcattccacccccggccccatttgaaagaatctcactgtccttataagctacttaagagaattctactaccacagccttactatttttagaaagagaaatatgcagtgttaccagttttaacagttgttatataatcccagttctctgcatgattctaggcactggaagtttatattgttatttattcaacaaatatttatcgagtacttgtgttctagatattagaaattttaaaaagtgcggtgaacatcaacttacaatgtagtgagcagtgggaattaaaataaaacagttgcattttgcaactttgcttaaaggcataggtcaaaaagaacccggaggagatagtgccaggatctatgttagaggttgtaatatatgctctcgtttaatcttgacaatttaggaggtagataccccacttaatgttgacagaagctgacattcagacagagaacacacagaggttttaatgtttgaactgatacatgaaggatagacatttgttgggtgtggaaggttctaaggttggaacattcctggcagagaaaacagcaagttaaaagggtagaggccaagggaacttgacaagtttagaaaatgtcaagaaggtcattaattgttggattataggatatgtgggtaagaatagtaagacatactgagtgaataggccagtgccggatcgtggaaggcatctatacatcaaactaagaaatttagattttatcttgtaagtaatggagaccttttgaagaattttgagaatgatactagatttgtgatatatataattcatctttcaagagcatgcaagaagacttgacagtgaagacatgagagagtgaagcaaggaaaccagaaaggaggaatttattaaccaaagtgcatggtggtcattgactagatgtggcaggcatgagagaggaaggag

SEQ ID NO: 2396 - DNA, 1051 bp, Homo sapiens
caaagatagtaaatatcttaacaggtctcctgctagtactgttaatgtggcaccttaggaaattttttcttttagcttttacagccttagttatatataaaatataatttagaaataattgtgtatttctttaaaaatgttctaatgcaaattgaagtacttgtatacatttattgcatgtctgatgttgagctgaaatgtgataccatattggtacgtataagaaattcttttcttatattaatattaatgttccttttgtaaaatgagaaaaaataaaattttaattaattttttgacatttttgttttctgatcaaggaccttttggagagcgagacgatcaacaggtgtttatccagaaagttgttcccatcaccaacaaactatttgtaagactctcatcgactggaaaaaggtaacactttattgtaaaaatatttgtattcagaagccaccttttgtcttacaaaacatatggcataatttgacatattgaccaaagagtgctactagaaacaaattgttgggacagaagtctgttatctcataatcataactcaaaattaagacagtagactttatgcttactttctgggatttaagagtttcactgatgctgtggacagttaggagggactagtgatagaataagaacacagtgaactttttttcatggccaaacataaatacttattaattttgttattataaacagtttctatctttaaaaaacctggaacttaaatattttccatcccatataaatctgtatacattattgatgtttctcaaataaaacattacagatttcctgattcagtatccccttttaaaataaaaatgatattaataacactaatttgcataatcttggcacagcttacaacatagcacacattttttttttctattttagacctatttccatctactttaacatggagagaaattgtctgtctccgtgagagtaggattcctgtctttatgcagtctcctcagtatttgtttgtgaatgctgcacttatgcttccattatatggcactggcag

SEQ ID NO: 2397 - DNA, 1030 bp, Homo sapiens
agagaaaacattacaaattgattttattatacttttatatgacacgagagccttcagaatgaagacccaaagacacaaggaaaagtgtccatttttatgcttaggttagaagaagcagggacagccatgtagaactgtgactggacaaaaagttgtaagttaacagaaatagactgagtagggaactccagtggagactgtctctgtgtggcattcctttctcccagggatggggcagaacccctctgtagtgagggccttaatttctttatggctagctgttcacagaaagatagggacatgttagggtaatatttttatgcttcatggctagctttggggaaagagcgttctggtttctgtgagccaccttggggaaaaagaagattgtctctatggcttgccttgcaggtcagagagaaactttgcttctgagggtattttctgagacccaagttttcatatgcatacaaatgttgatttgttttatttgaaacataaacaggactctgaggagggagttgttgaacattttaaatcaatttacagatattatttaaaaataaatgtaattcactaaattatgatcatcttgataaatacaggaataaaatctgataatttgtcacctatttatgatttaaaaaaaccctagcaactaaaaaaagggaaattttaaaatctgataatgcccatgaaaataattctttcaaactttatattggcgaaatattaaaaacttccaggccgggtgcggtggctcacacctgtaatcccagcactttgggaggctgaggtgggcggatcacctgaggtcgggagttcaagatcagcctgaccaacatggagaaaccccatctctactaaaaatacaaaattagccaggcctggtggcacacgcctgtaatcccagctactcaggaggctgaggcaggagaatcgcttgaacccaggaggcagaggttgcagtgagccgagatcacgccattgcactccagcctgggcaacaagagcaaaactccgtctaatg

SEQ ID NO: 2398 - DNA, 1059 bp, Homo sapiens
aaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattgccagtggtttcacaacagttctcttgtatttatttatcaattaaatcaaataaaaatgattatgtcaatgcgttttcagttatttaagtaacagttctgtttaaagtgtgctatatatgtttgttcatttctttgcttcttcccataatttaaaaaaaatggggggagggagaacttaatatatgtggaaaataagttattatcaatgaaagaaaatattaggcaaagcataatttcaaaattactaagattgtaattatcttacacccttc

SEQ ID NO: 2399 - DNA, 1055 bp, Homo sapiens
aataatggctagttctccaaaaagaagggatatagtgcagagtaatatatacatgatatacatatatatacacataggtatagtcttgtctctacatgtatatatgttaatgctagaaggaacagatacatttttccttttaaaatttcacgcagcctaatattgcaaatagaacagtagtttccatttgaaatgtgctaggttgaagatgtcagtattctctgatattcagtgaattgacagaattttatgagaaactagtttcaaaactataaaatatatgaaataaaaacattggttcaagtagaggtgttcctagtgaaacactttgttttctcctcaaaatgtataaataagctgtttactccttagatttttggaaaattcataaatgcaagaacagagacatttatgtgtaagttatgtgttgccttgtcaaaaagtttggtgagtaaccctatgtattgtaaataaatagaaccttcagccttgtcaaaaagtttggtaagtaaccctatgtatggtaaataaatagaaccttcagaaaagtttgtcgacctggtgcaaagtttgggattcatttagcagctgtgatcattagaataactattcttgcaggattgtgtcaaccctgacagaaatggcagatagaaatgaacagcagtgacatcctttcaacagaatcatttttgagccagtaactaacttactacttctaacaactgtgagccatcttgaaattgccactgattattcagttaaccaggagcatcactgccaaacagaaccaagtgacaattacatacttctttgtcttctacaaaataagagcaaatcaagtattttcatatgaatattctctctcatttaagatgagaaaaatatcatttcttagacctctattaggaaggaacactttcaaaaacagtcatcatttctttaaagaattataggataataaacaatggcttttcagcatttatgatgtgtgagtgataacccaggaggaaatgggtgcagaccttgcattccagggttacgtcttctgggtttcc

SEQ ID NO: 2400 - DNA, 1024 bp, Homo sapiens
agccagattagagatgatccaataggctattgatcatactttcttctaaaggtcatactgggggggagcataaatgctcaagaaaccacacacttctccaagtaagaggcacattttatttgccttcctatttaacctcatatgggcttttattaataccaaaactcagaaacgtcttggaaatgtccacgtgaggtttggtatagggatcattttctgagattttctcaatttgagggtcgactcaaaagaaaggacaaaatatgtgtgacaatcttcctagatgttagtctaagcaaagactacttaacagcatatttcagtatcttctaatggaagaaaaacagtctcccttcgaggaggttgcaacaccagttcctgggactagatcttgccacaactgtgtctatttaggttgtaatgacctgaaaaaacctaaatgtatggctactgtggttattatacaggtgcctggcaataaaatactacgccttagcaaatgaagagacataggaggtgaagaaaggtcaaaaaaaaaacacagatgagaaatcaatgtcaaaagaggtcactttatgagcttcaaaggaagctacggtcattgattataatatcactgaaacaacacaggccctgtgagatctgaaattacatttccagtctgaatttatagaactcactgcagactctggttgtgattgtagcacattaatgggggcctaccaagtaagcatgatttagatgggcacaggcagaggtgaattcagtttttcctgggtttagatgactaggtgtgcgatcaagaaaagttcagaataggtttcttctgcaatttaagggacattgctggtaacagttaggggctagaacaaactttcaaaaacacaaatctaattatgtcagtgtcttgcttacaaaccaccaatagccctttttttcatgcatgatgaggtttagaatccttagacaataggcaaggcctttctggtgaggtgttgtgctgaacccctattaacctcaaagg

SEQ ID NO: 2401 - DNA, 1036 bp, Homo sapiens
agccccatagatttagcaaaatgaaggtcactggttacttagcaggagttgattcaatgacaatatgggagactagagttggttcgattaggtaaattttaaaggagataccaagtgtagataaaaattcgaataagtttggctgtgagtgggagaagagagaggaatagctgtagggagatatggggtaatgtatcttttattttttaagatagaagatgtttagcattaattatgctgttatgtggatatcactatttaactggtatcctccgattttatattaatttgtcttttaaattaatttcccaaaatttcagattcagaagtaatgctaaggggagcactcatgcaaggggcgcaaactctgccacaaaatgtatgtccttagaaatgagttcctagaaatgggaataacaggttaaatgagtggctctctacaaggggtgattttgtgattttggcaatgtatttttgattgtcacaacttaatgaaggaggctacagcaatctaaaggatagagagagactagggattgctaaactttctacaatgcatagggtagccccctgcagtgaagaattatctacctaaaatgtcaattatgccacctgtgagaaaccctgggttaatgagtatgcacgtttttaagacttttgatccatcttcccaaatgtcttgcagaaagattaaactaatttgcattttcaaccatttgtgtgaatttttatttctctacattctcatcaacactgaatattttttattatcattaattttataataggtaaaattcttttaaaaacttacattgttttgataacaatttattctaaaaatctttttagacatttattgaccacttgctcttttctaaaagacatgtttttttatatcttttgctcatatttctgttcacgagtttgtctttttcttactatttttctaattactatatgaactcttcctttaggtatagattttgtttttatttatcctgcctaggattccttgggttgcttaatctgtggtgtc

SEQ ID NO: 2402 - DNA, 1043 bp, Homo sapiens
attgagaacttttaagcaagatggtgacagttgtttataaatattactgccagatgtacggtgactgccaaagagtgccaggacagtttgtaggcaattgcaaaattctatgttaggatctgcactaggacacagcagtgaagacagagaagggccccacttgaaatatttttcaaaaagaaagtattcaattttgcaaacaggcaactttcatgtgagcttatagcaccataggttttgggcatactacactgttagaggaattggataataacaatagttatacttttggaactttcctatgtgcctggttctgttctgagttccttctatatatcagctcagagaattctgacaactctatgagatagatgctgctattatcctcctgttacatttaaaaaactgaggcacagaggcttataacttgcccacttctgtacataagcagataagcaagttgataaatgatacaacaattattgaagtttgattgtagagcttatgctcttgaccactaccttaatatgtttgaggaatcaggaggacatagataattttaaaaagtatctggaaagtgaaagcgttgggcctttgaatctaaggaaagaaaggattggggacaaggagactttggtatggagacaaacttttctccctcccactcaagaagatttcatcaccaagggacatttttgtgttcagatttctatagcacttccaatgtttataaccagagtattctttccttccttcctttctcctaaaatccatatgttatttctggaagcaaattcccctgttcactcaattgtataagaggcacctgtgatggtactacctttcagagtgactttgtgctagttattattatctaccccaatttcctcatctacaaaatgaggataataataatgtctactttaggattgttgtaacaattaaatgagtttatatatggtaagcatttaatatttggcacatggtacccactcataaatattagtgatgacgatgatgtctcttctgacctaaaaaaactg

SEQ ID NO: 2403 - DNA, 1019 bp, Homo sapiens
gacatttagaattgtgattaatgttttaataaaatgctaagttagaatgaataatcataattatatagatggaagatatattctaacagttcttaaataattttagattctctaaatttagagtgttttctagcttagagagcaatattaatattttttacctagtctactgaacataatttcagggagttagtatttaggactttttacctagagatgcggtaaaccttttaaatttaaatttgctttcttaaaatacctgttccaacattgctcacctttcttctccctcctttttgccctctccttcagtgggaggagcacatattcagctttctgttaaacactctttggttttcaactgagtaaggcaagcaaggatatatgttagaagagtgggcataatactttatattaaaattatagggactaaaagtctaaatcattgctgtcaataggactttttttgatgatggaaataatttatgtctgtgctgttcaatatggtagccactcgcagaggtgactactgagcatttcacgtgtggcttgtgatacagaggaactaaatttttaattttacttaattactttaaattttaaaagttacacgtggctagtgggtctatcccaactatgaagagaataaagctacagagcatctatctagtctaatgaaacaacagtgaatttgggaattgtaaatctgtcttaagctttttccataaacttttattgatataatttaggcatatacaaatactggtgaaattttattgattgaattattgttgacttttttttcagtatttatatttttaaaaagatatgtttctttataattaacttgtattgtagggtaaccattgtccttaaatgttaagccacttagttaataacaaatagcatttggttttttagcattatttatcatctgaggctttcagaattaatgcaccaaaccttaaatatttttgttgttctctaaaagaatgggtttatgatgcaccaaaaggaca

SEQ ID NO: 2404 - DNA, 1033 bp, Homo sapiens
gctgatagccctttgtgggacattttataaagttcagactacatatttttagcaatgtggagatttaaaagtaaaaatataagagatattgtatatgccctgaggcatattttgtcttaaatattatccttggccaagtatactatataaatacagtaaatatgaatagaactggccaggtgccaatctcctaggatgaattttagtcaagaatgtatttatgggatataaataatactgtgtcaacatttaaagaaggggtctgattagttttgaatttattcatattgatcttttcacgtgctgttagtttaagactcgaagtggagttatgctaaggtttaccgatagtttgcccactgggaattagtggacctctagtagtttaacaatccatttgaagttcgaggcacatctattcgaaagatgctgcacaaggttttagaaacttagaaagggtgattcagttatacacaggaagaattcaaataattgacatgtaagaatctgtagagagtccgacaatcaaaaagaggaagagacacaacgtttcattttctttcttttctctccctttttcattgtaaccaatcagcacatgttgtggttctaaccctggtgattttgtactccccccaacacccgcacccctactcccactggaacgtttggcaatgtccagagacactttgggttgtcatgactggaggtggaggggtgctaccggtatttagtgggtcagccagggatgtttctaaccatcctataatgcatagggcaaccccccattcccaacatcaaagaattatcctgaccacaatgtcagtaatgcctctgttgaggagccctggtatttgttgggggttactgaattctgttaacagtaccatttagaaaataataacaaaaataaaatatctttatgatcaaagcatattcaaatgagaatactgaataggaggatagtcagacagttatcttaattaaatggagtgtggattagaccattgtatacagtatgtactttattttt

SEQ ID NO: 2405 - DNA, 1069 bp, Homo sapiens
tgaaaactgattttttttcctttttctgagacagagtctcactgtgtcacccaggctggagtgcagtggtgtgatctcagtttactgcaacctccgcctcctgggttcaagcgattcttctaccttagtctcctgagtaactgggactacaggcacgtggcaccacacccagttcatttttgtatttttagtagagacggagtttcaccatattggccaggctggtctcaaactcctgacctcgtggtctgcctgcctcggcctcccaaagtgttgggattataggcgtgagccaccgcgcccggcctgaaaactgattattttaaaactaaggtttgctttctgtagactgaacaatcattagcatccttacatctctatctcattcatggtcttaacttctaaggcattggatcagcaccagagctccctgtcctcctgccttacttaaaaacaaaaaagaaagaaaggaaagaaaagaagggattttaatgctgttttatagcagagtgaaagtaaaccaaaggtgcatacttgagaactgcaggctggaaattgcaagtgacaataattacctcatcttattcccacacagacttcctatgacctgggtgaccttgggatctgaattctgtttaatagaattgtccctcttctgcaccacggcgtacactggcctgaagaaggtgctgtttcccaggaaaagcacttaaatccccccaagaaatgcatagggccatagtttgaagaaaaagtattgctaaccaagtgacttactctgcatattctacctttctctggttgtattctttgagatttttatttaagataactttcagcatctctttttaaaggtcagatacgaatgagaaaactttgtctgacttgttaatcttgtgacaaaccgtttatatccagtgtagcttcctgtctttgctgactggttatttgagggaattttcttcctgtaagactgtggagaagcctctaaaaataaacagcatggtttcttattggtgggaacatatgtgagcagatgtcagctggaagcagcatatggtggcaacat

SEQ ID NO: 2406 - DNA, 1033 bp, Homo sapiens
ttagtagagacggggtttcaccatgtggccaggatggtcttgatctcttgacctcgcgatctgcctgcctcagcctcccacagtggtgggattacaggcgtgagccactgtgcctggattattttaattttttttagagacaggtctcactctgttgcccaggcttcagtgcagtgactcagtcatggctcactgtagtctcaccctctcaggctcaagtgatcctcccacctcagcctcccaagtaggtgggagttacaggcacatgccacatcacccagctaattttttattttttaatagaaatggggtcttgtcttgctttgttgcccaggctggtctcaaactcctagccttaaccaatcctcccactttggcctcccagagtgctgggattttaggcatgagccactgtgccaggcctgaaacaattttagactcacaagaaattgcaaaaatagtacagagagttcctatatacccttcaacagcttctcctaatgatgatcacaactgtagtacgttttcaaaggggatggataacccatttaccatgatgtgattattaggcattgcatgcctgtatcgaagtatttcatgtatcacatgaatatatacacccttactaggtagccacaaaaattaaaaattaaaaaaaattagtacatataaaaaccgaagaaatccaagcctagttaatagtattgtaccaatgtcaattaaactttttaataaaaatagtcctaatatgaacattgtagtgaaaggtgaaattgcttgatgcagagctgtttagtggaaagttaggatttctcttgtcaccttttctgatggtcaggtttatagtaaaacaggtgaaatgttaaaggatagtggtggggagtctgtgagaactttggggactggaattgctccctactcagtggaaaggaattagagtatatagcgtcatgtataaactgccccaggacacttagctcctcctgttctttctctcctcttctaatttggtctgtcaggctatcagagcact

SEQ ID NO: 2407 - DNA, 1034 bp, Homo sapiens
ccggccaaaagcctgttagtcatccatgagaccttttactgttgaccctttataacaaatccgttgccaatctctattaattttaccacctaaatttctctagtatctgtttctatctacatcatcgctgtagtctaagcatgaacagtagtttcctaactgatctctgtacatctacttttgctctctttcaattctgtcttgacacagcttccagattgatcctttagaatcatgccaacctttctgtcagaaatattcatgacttcttcatgaacagatttgtcacgttcctacagtttctctggtctcattttatagacactgctcttttcattctctgcttttcagttcttacatgtcatactgctccctcttatccagaatcctggcacctgccctttcctcgccctgggatacttttttcttctgccctgcacttctcaccatcctgtagactttagttcaaaccattcagcaactatatttggatacccagtttttgtcagtcctgttctaggcactatgtgaacaaataactcagataaaatacatcataaacttcctcttgcagagtttataggctagtgcatttattgttgaactccataaacccagtcagttgtgaataaaataaatatttgcaacaccaagtgtctcatttttgaagcaggtacatttgcctttcacatttatttgtgtgattttttgactaatttctgtttttcacaatatgctacacactccatgagaatagggactctattcctccctcaccccaccatcattgcctctctagcagtgaacacagtgcttgacacattaacagggattcaataggcagtttttgaactgataccttaatgagttaattgattaaaaaattaaagttgtgaccttaatttcctcctcaggactccataagatggacttatatttccttccatttttttctgtaaatacatatacattaatatttatatggctttttattacttaccagctttggagtagataattcttcttttaggtca

SEQ ID NO: 2408 - DNA, 1026 bp, Homo sapiens
taaaacttaagcttaaacaagatcttcagagtaatcaatggtgaagccaggagtaaaataatcaaaattattgctagttattgagacctagttagttaattcatattagtaagtcagtttctatatggttattatgatgtatggagcttttttaaatcctttattccatcctctgtgtgacataaaagttttagactgctttgaaatgcattgtattactaaaatatttattttaatctagattttttgattcatcaggtgattctggacaaggattaagaatgtggatcaagcaggttttaaatcaagatttaacattccaacacataaaaattatttatccaacagctcctcccaggtatgcagtaatttatctcacttgtcaatataactctgtggcataaaatatatatagagagatgtgccagctaggtgttctttaagcttaattttgtatttaacatactttaaattagagtactttgtccccagaatgtattctttattgcagttacactgttggaccaagttttgccaggtgagtaatttattccctttctgtaaagcattccctaaagctctgaatttaaactgtgtcccaagcatggcttatgtaactctgcttcctcttgccctgcagattgctcaactttcatacttcttccctacattcaccccaaaaggaaacttaataactccaacaagtataatctttctaataatttagttaagccagaattcataatctctgggaaagggttttatggcattctttccacatttaaaaggattatcaagaaacaatgttatgcttttttaatcagtaaaccagaataggaagatagaattgactacttaataaatatttaggttatataacctgtaggtgtgtgcaaaaaattcacagtaataaaactgctatagttttgaggtcaaactactctttgtaaatattaaattaacatctgcatagtcttttattcggaacacatgccgtaaatcagggattgggatttttttttggtt

SEQ ID NO: 2409 - DNA, 1434 bp, Homo sapiens
ttggagaatattctcatcaccccagaaagtttccttgtgcttctttcaagtcaactcccatctcatgtattattgtttgcatatctattactgtagcatagtttggcttgttcttgaatttcagttaaattgagtcacttaatgagtgacttaatggaatcttgtgtctggcttcttttattcaaattggtatttttgggattcatctatatgtgtgtatcaatagttcaatttttaaaattctaagtaggtattatataaatataacacagtttgtttatttatctactgttgttgcacgtttggatcatttccagttttgagatctaatgaataatgctaccataaatattcttgttacacgtctttttgtgagcataatttgaattcttatctagactctattccattggtctaatcttatagtagtacaaaattgttgtaattatcacagctgtatagaaaattttgaaaccaagtggtgtaagttttgctcattctatgttacttgcatttacgtgtaaattttagaacctgctcttcaattttacaaaacacctgtttggattttgattgaaattgcatggaatctagtttgatttagagaaaatagatgccttctaatacatacacatggtatgtctcaccatttacttaggtctttattaatttctctcagaagtgattcggagtttttagtgtagaagtcttttgctaaatttatctacaagtattctgtttcttcatgttattgtaaatggaatgttaaaaaacttaattttcaaattgttgctagtacagagaaataaattttagttttttattatgtccttgtatccttctatctttctaaattcacttatttctagtacttacttagtatattccttatgaatttcgtgtgtgcattttatttcattgtcttgcttttttggacttgtttgaacttccagtacaatgttaaatagaagtgagtacttccttcctgtgtaatcttagaggggaagtgttcagtatttcactgttaagtgtgatgttagttctagggttttttgtatatatgccttttttttatattgaggacatttctttgcctaattagctgagaggtttctttgtgaatttatcaaatgcttttctgtgtcctttgaaatagtcatggtttttatctttcattttgttaacacagtgaattacattaatggatttccaagtcttaaaccaaccttacattcctgggataaacccttttgtaatgtattatcctttttatatgtatctaaatttgttttgctaatactttggtaaagaattttatgtctgtgttcatgaggaatattgttctgtgattttctttaatgcctttgaaaaacgttatcatcggggttatgctagtcacttaaaagcattgggaaggattcccttctctgtgtc

SEQ ID NO: 2410 - DNA, 1377 bp, Homo sapiens
tataaccccatgggacctaaataacccataagttctgggtcctaaataacccatgagttatttagaaacatgttgtttccagatatttggagctattctagatattcttattactgttgatatctagtttcatttcattattattagagaaaatatcctgtatgattttcttcttttgatattcattgggacctttttatggctttgcatatggtctatcttggtgactgttactgtgcatttctgcgtgtcacgttctataaatgttaatggttcaaggtatttgaaagcattacacaaattctgtatatgcttagtgattatttttctaagttgttctattagttgccaagggatgggtattaaaatctctagctatgattgtagattggtctgtttctccctttagttctgtcagttttctctttatgtatttttaggctatattattaggtgcatattcatgtagtaatattgtcttttttatggctacttttatctataaaatgttcctttttaatttgtggtaatactctgaagtgtactgtgtttaataaaaatatagtatatctcagcttccctatgcttattgtttacatggcacttcatttttcatccttttactttcttttgattagagctgtatggtatgtctttttccattcttttgcttttaacctacctatatcattgtatttaaagtggatttcttatagacaacacgtagttgggctttgttttcatctttaaccaaactgataatttgtcttctaagtgatttgtttaagcaatttacatttaatgtaacaattaatatgcttgaatttaggtctactgcttttcattcctctgtttccctttcacactttctattgaattattcgttttttaatacaccattttactttattttttttctgattgccatagggattatgatatacatagcaaagcttttttacctacttagagttctttgttgttttttttttccttgtaactatataggtccctttatccccatcttgtgtatgttatagttttcatatgtattttgtctgcatacattgaaaactgtatcaaacaaggttataatttttgttttcaacagtcaaccatattttaaacagcttaagaggagaacaatagtttattgtatatactcagttgtggtctattacagcatataagtgtgttttgattaaattgtgaattaccattttgattataaggtatcccttttcctcaactgtatttaatagatgttttaaatcagctaaggtaggggcatagtcagtaaaagtcagcaattagtttgctgtgttgatttagatggaaaatactgcttttttttttcactgtggtaatttggactct

SEQ ID NO: 2411 - DNA, 1046 bp, Homo sapiens
taaaataaactaggcactttttatttaggcatagtaaaccatgaattcctctttactccatcacttagaattcctatctgaagcatgatagtaggagagccctctcctgataacagtatatctgtactacaagtatgctagtaaggaaccctactaaaaacagctattttgaagaaataatgtacttctttggtaagtattaggtatgtttaaataggtactagtatggaaaagttttcttagatatgattttttaaaaaagaaacaaaaatggactgttttctacaaatcacagtgtagattttataagagttaaagtcaaaatatatttggagcaaaaataaaataattttagacattgttatttctggctggcacaaattattcccaagtggcacaaatgattactgaaatttattcagcaaatatttagcatctattctatgtcaggctttgttcttagcactgggtatgtatctgtggaaagaatgaagtccctgctctcaatgagctcatgtagagacagaaaataaaagggaaattaaatgtaataatttcaaatagtgataaatggtattaagactggggatagagagtatatgtgtgtgttgcagggtaaaagggaggtatactttcagttggagagtcaaagaagctcccctgagaaggtgacacttgagctgagacctaaatgaacagtcggagcccaccatgcagaaatgttgcaaagagccctctaagtagtggggatatcagatgcaaagccactcaactaataataagctcgtactatttgaagaaaaggaagtgacaaatgtgactggaacctagtgaagggtgggagagagaagtggtatgaaatgaggataaagaggaagactggtgccaatttgttaacttaaaggttatgaatgaactttcgattttatgactttaaggcaacacagatcaaaaacaacttggtatcaagctgaatgtcaacttttttttttttttaaccttggacattttattctagcttaatattttaccaatgtgtaatgggt

SEQ ID NO: 2412 - DNA, 1034 bp, Homo sapiens
ttttttttgttcccctttcatttacatctaccaacataatacttgaatacaggaccccctttactccattacagtttggaatatcttgatggtgtgtgtgcctgtgcacgtatgtgtgtgtattttttttaaccaacatagtatcccagagcatgaatatacaatgaatggattaagattcactggtactgtaactgttctccctcttaaaagatggagggagtaggtaaagaggatatgaactggcattagtagattttaatggattagatacaagtatgggatagttaatacaatatacatgagagtagttttaatatgcatttaacttataaaacttagaagaaattgaaatcatttattcaaaacactattattttggtaattaaagcatccattttcatattcccttttcctttctttttttttgggggggggcggttgttaaacagatcatatactcctatgaaaggaggaatctccaatgtatggtttgacagatttaaaataaccaatgactgcccagaacaccttgaatcaattgatgtcatgtgtcaagtgcttactgatttgattgatgaagaagtaaaaagtggcatcaagaagaacaggatattaataggtaagacctttaaatgttggtaatttatcactgttcacttttgtctaattctatacatcaaatcttacttggaacattatttagaagcacttgtatatcattcgatgcattcatagtttcagataaactttacatattgaggatttcaaagatattagaattataaacagcagcgcatgaaactttaattgattttctttttgaataataacggattttgagactcttgtggcagttaaaatttttcttctagtttaattttcagttaagaaattattcatttcaatttttaaaacattttacttcagttaccttaactcttatgaatataagtttaaacatctattgccattaagatatacagtcaaaatataccactacatttatgaaaattataatcttcagagttaat

SEQ ID NO: 2413 - DNA, 1034 bp, Homo sapiens
aaactttctttgtgtttattgaagtgctgaactgtctgttgagtcatgagagacaacatgatataatggataaaatccattctattctgtcttggcgttagtttccactttgttgaaagcagcgtggcctctagcataacaacatcacctttctggtccttagtttcctcattatgtttaactctatatttctgtgtttccatgtttaacgttgatgtttaactctaatagagataaacatggagcattatgggaggactaggaagagtgtagggaagggattcccaacttagtctaggggattatgaagtagttagaagatagaattccaaacatgtgaatcatgtatcattcagtcatcattcaatctttagcaagtattttttaagtccccactatgtgctacgcattattatagatgttcacggggatgtgcagataagtaaagcaagatctatctgccttacatatttcttacaacctgaaagggccaatgagattcttaaagtggtaactataatgccagccaggctgtgatgagtgctctaatgtggtataactaatagcttttcaaagccaatgatagtatatatttctttttatttcccagaacctatcacaatgcctggcacagagcaaatactcaggaaatctataacaaataacattacccaatcaataaattgtcagtactgtaggaattgagaggaagaagtagtcacatgcatttggggctgtaagagaaagatttaatagaaagatggcagtggcatttaagatgcacaaattattaaaattttaactattacagtgtagaagtctaggtagagggaatgatttgtacagtaaagtagaagtggacagagtaatgctttttgtttttgtctgtctggacagtagttggctgtaacaaagtttgtgtctaactaaaaagtacctgttgactcagatagccacagtaagagactagaacgtgatggcataatggtgacaaaaatgagttcaaatctacagtccaccacttcctagttggc

SEQ ID NO: 2414 - DNA, 1129 bp, Homo sapiens
ctgggtcagatggtatttccggttctaggtctttgaggaattgccacactgtcttccacaatccttgaactaattaacattttcatcaacagtgtaaaagtgttcctgtttctccacagccttgccagcatattaaaaattcaaaattcaaaaattcttgaatttttaataattgccactcagactggtatgaaatggcatctcattgtgattttgatttgcagctctctaatgataagtgatgttgagctttttttcatgttttttggctgcataagtgtattcttttgagaaatgtctgaagagtcatttatgacaaacccacagccagtatcatactgaatggacaaaagctgtaaccattccccttgaaatccagctcaagacaaagatgctctctctcaccacttctattcaacatagtattgggagttctggctggggcaatcaggcaagaaaaagaaataaaaagtgtgttcaaataggaagagaagaagtcaaactgtgtctatttgcaaatgacatgatccaatatctagaaaactctatcgtttcagccccaaagcttcttaagtggataagcaacttaaggaaagtctcaggatacaaaatcaatatgtagaaatcacaagcattcctatacaccaacagtaggcaagcagagagctaaatcatgaatgaactcccatgcacaattgctacaaagagaataaaatacttaggaatacaaaggacttcctcaaggagaactacaaaccactgctcaaggaaataagagaggacataaacaaatggagaaacattctatgctcatggataggaagaatcaatatcatgaaaatggccatactacccgaagtaatttatagattcaatgctatgcccattaaactaccattgacattcttcacagaattagaaaaaactactttaaaattggaaccaaaaaagagcccatatagccaagatagtcctaagcaaaaaggacaaaggtggaggcatcatgctacccaacttcaaactatactacaaggctacagtaaccaaacagcatggcactggtacaaaaacagacacatagaccaatggaacagaatagagatctcagaaataagacctcacatctaca

SEQ ID NO: 2415 - DNA, 1036 bp, Homo sapiens
acacgttttctctatagcccagctgggagctaaaacttcagaatgatagcattcttctactttctttgaacatatatgtattttaattaaacattttatgtttcttcaacaactagtaggactttaaaggctctggactgttgttctaacagttttccatagaggaaaataaatattttgtttatcccacaagttttgtatgagaggagatatccaaataaatgtaatagtcataatttctgtattcccaaatctgaagaataattataatagtataccagttaaatggaagaggtgttgaaatttagaatggtaatggactttattgcatgtttaaagttcttttcagttgatagcacactttaagtggatttttttaaggattttactttcagattgattatcttaatgttcctaatatagtctttttatagattgtttctgttttattttatataaagagttcataaagccaggtttattattttttaacatgttttattcagcttgttaatcttaagtgtatgttgaaatgttaactcttgacattttaaatactttgccagcaaccgtaaatacccgttataaccattacctacaatggatttactattttcgtatttacttattgaacagtagattttatatcattttttagactcttaggtggaaaattgaattcaaataactagttctttgtgttaaattttcttctgttaggaaaaaatacacaaagtcccttttcacagtagtgtcctatgctaaaggtcattgtattgtcaaagacggctagtgaggagttgcagattacctcacaaaatcataaatgggaaagggacttagattaaatcttaaaataataatatttcaatgagtatatttttcttcattgtaacttaagagaattaaacatgaagttaaatgtctgcaggatgcatttatgtgtattcataatgacattttatgtgcgggtaaatgttttctttctctctttttttttttttaagttgttaccatcaaaagtctctgaaactac

SEQ ID NO: 2416 - DNA, 1033 bp, Homo sapiens
ttatggattcttacaaagctgccaggagaaatggaaaaacaaaaatgaatgaatcaagagtgatttgttaatgtaagtgtaatgtctttgtgaaaagtgatttttactgccaaattataatgataattaaaatattaagaaataacactttcctgacttttttattattaaaatgcttatcactgtagacagtagctaatcttattaatgaaaaacaatagacaaacatctgtgcataatttttcagacacaattctgtaaatatttggaaaccttttaagtatttaaacttttaaatttttgaaataaagtattctaaactaatataaataaggacaatgaaaaaacatgaaaggacttagcataatgttattttatcttttctacaactttgtttaaattacctttccaaagatatttgtgtttatgtaattttccacggaataacattaatactctaggtttataaaccggtttcacattatttcatttgatcatcacaagagctttgtgaagtaagccgagaagttgttactggtatttaataatagcaatagaggagttaaagactttcccacagcttgcaggtcaagacaagaaattcaggtctcctaattctcagtggagctctatttctgttaacccaaattgctgctctgttttaggtctcaatttcatctgtaaaatgatactaatagtacttatcccattggatttttgttgagatttaaataaatagccaaaagccaatacataataaacactcaataaagattaaccataaggagagtcatgatctggttccaggaatacattgttagatgactgaaaaattgtattacttcaatgaaaatactataaataataacattttcatatattagttggttctcatgcatacataatctaattttatttgatcctcacaactgtttaagttttattaaatatacattatccctatttgtataaatagaatcatacaatacctgcctgctttcattcaacaaaattatcatgagatttttccatg

SEQ ID NO: 2417 - DNA, 1051 bp, Homo sapiens
gaaccctggagtttaaggttttactctcctaagaaaccactcaaccattctcttcatgccccctaccccaaaactttctgttgctttgcacatataaacatttcctaaggccaggaagttgaagtagccatgatactttcttacatgagtgaggagaaattgcagcaagaagaaagcataaatcagtatcacaataaattacatttatgtgttgggggaactggaattttgcaaaggaggagagagacacattaggatgtgagtaaagggggactttcattttttattatatagttcttctgcttgaagttttataacaggctttattactttataatccttaaagagaagtaaaatgtttattgataggatttttttctcagctgaaaactgaataggcagtgaccatcagtagtaaggaaattaaatatattgtttataggaaattggatagttcaattgaagtataacaaaatgaactgagaacaaaataggaggcagactggttataattgagcatgtgtagtactttgatatgtaaaataaaatgtccagattattattaccaagaacatatttaaacaatgtcttcattagatgaaaaaaatttcttgacatatgacaagagcacagaattagcaaagccatgtaattacaagttaccaactatttcaggaaaatgccaaaagcatgtaaaccaagattgtccaccctgcagcccacaggccacatgtgggccatgacagctttgaataaacacagattcataaactttcttaaaacatcgagactttttttgcctttttttttttaggtcattagctattgttagtgttagtgtattttttgtgtggcccaagacaatcttcttccagtgtggcccagggaagccaaaaaattggacacacttgatgtaaacatttcaagaaaattcagactatatgatcactcaagacagccgattcaccagccttctgaagggaagactaagcatattcctatattgaaggtaagatacagacccatgcatgtgttatctttttcatatttg

SEQ ID NO: 2418 - DNA, 1102 bp, Homo sapiens
gctacttccactcaataaaaccttgcactaattctccaagcccatgtatcatccgattcttccggtaaaccagggcaaaatcccgggatacagaaatctctctgtcctagcgacaaggtacagggtccaattgagctggttaacacaggccgcctatagatggcaaaactaaaagagcacactgtaatacacgcccactagggcttcagctgtaagtattcaccgctagacactgctgtggggtcggagccccatagcctgcccgtctgaatgctctcctagaggtttgagcagtgggacactaaagaaacgagccacaccctcatcgcatgccctgcgagggggacaagggaacttttcccctttcacttggatcctttcccctaaactaatattatcaaggtcctctaatcatacaaactgaaatgatttgaagagggcaaaataccctttcaaaagttggaaatattttctgtcatttaaatgggtgagacttacatttatctgtagggcaatgtattattaaggttaccacacaaatggccttttagtcacgtaaataaaaataagagatttttctctgaaatagaaacttttgaaataagaagtaacctgagttactttcactattcaacaacttaaaaactgtatggtaggcttatcttttttttgaaacagagtctcactctgtcacccaggctggagtgcagtggcacaatctcagctcactgcaacctccgcctcccgggttcaagcaattttcctgcctcagcctcccgagcagctgggactacaggcgcctgctaccacgcccggctaatttgtgtatttttagtagagacggggtttcaccatattggccaggctgatctcgaactcctgaccttgtgatccgcctacctcggtctcccaaagttctgggattacaggcgtgagccaccgcacccggccgtaggtttatcttgcaatttgattgacttagcaaagtcaattcattggtcaagacaaaattagtttctgtatcaagagaaaattagtttctgtggtattgtattttcctgattcataatgttttcaatcttgtctaaaagaaagatacaag

SEQ ID NO: 2419 - DNA, 1043 bp, Homo sapiens
ttggaaagggtattttttactacctgtgttcacctgaagtctgtgagtttttaagggagatatttatcacatagatttgagacccccaaacaacttagctcttctataactcaacagtaatgcccgagctcagatagactcagtgcagttcatttaaaaatataaatacatacatacacacaaacatatatgcatactttttaaaaaaaatagtgtaatatgaagttgggcccttaccctatactgtatacaaaaattagctcggaatggatcaatgagggctaaactataaaattcttagaaaaaaacataagaagaaagtttcatgataatggatttggcaatgatttcttgggtatgacagcaaaagcataagcagcaaaagtaaaaatagatggattagactacatcaaaattacaaacttctgtatgtcaaaggatactatcaacaagtgaaatgcacctatgaaatgggagaaaatatttgccaatcatttatctgataagagattacaatctggaatacataaagatctcctacaactcaactgcaagaaaacaaataacccagttaaacaattggcaaaggatttgaatagacatttatccaaagaagatatataaatgaccagcaagcatatgaaaagatattcaacatgcctactcattagggaaatgtaaatcaaaacctcaatatatcactgcccgtctgataggatggctactatttaaaaaaaaaaaaaaggaaaataacaagtgtttgtgatgatgtggagaaattgaaacccttgtgaactgttgtgatgatgtaaaataatgctgccaccatggaaaacaatattccagttcctcaaacaattaaaaatagaattaccttatgatccagtgattcttcttcttggtattcaaaaacgttaaaagcagggtacacctatattcacagcagcattattcacaatagccagaaggtgaagcaacccaaatgtccatcaatagatgaatggataaacacaatgtggcacatatacagtgtaatattattc

SEQ ID NO: 2420 - DNA, 1067 bp, Homo sapiens
ttttaataacattagcattttgttctctagtttaataatcatacatttctattgtagtatagtcaagcatcacttaatgacagagataccttctgagaaatgcatccttaagatattgtaattgtgcaaacatcatagagtgtactttcacaaacctaggtggtacagcctgctacacacctaggctataaggtatagcctattgctcctaggctacaaacctgtacaacatggtatcgtactgaatactgtaggcacttttagtaaaatggtaaatatttgtatatctaaacatagctaaacacagaaaaagtacagtaaaagtacagtataataacataaaaaatgtaagccagtataggtcacttaacaggaataaagtttgtgggatgggaagttgctctggggtggcaggtgagtgaatggtaagtgaacataaaagcctagaacattactgtacactactgtagacttcatcaacactctacatttaggctatattaagttaatttaaattttttctttcttcaataataaattaaactttgctaactgtagcttttttattttataaactttaacatttttttaaatttttgactcttttgtaatgacatttagttaaaaacaaacacattttagagctgtacaaaactattttctttctttatatccttgttctataagcttttttctatttttaaaatgtatttttcttgtacttttcaaactcttttgttaaaaacaaagacacaaacacacacattggcctaggcctacagaggatcagggtcatcaatatcactgtcttctgctactacgtcttgtcccactagaagttcttcagaggtaatagcaagcatggagctgtcctttcctatgataacaatgccttcttctgtaatacatcctaaaggatatacctgaggtttttttcacagttaactttttttttaataagtaggagtatactctaaaataatgataaaaagtatagtgatagtaaatacaaaaatcagtaacagtcatgtattatcatcaaatattacacactatatataattgta

SEQ ID NO: 2421 - DNA, 1038 bp, Homo sapiens
tggacttgtgaaattaccccaatgacttccatatttttccctatctagttcacaaggaaaaatgaacaatgataaccaaagaggcaaactgcagaattttagcagtagatatcagaggtctggcaaaaacaaatctaatatctagaagggcgctggtccttagagatgagggctctttttatcctggcagtacagtgaccaccacaatcacagcgtagaatttacttccacctaatcttctgtaatccccaattggagcaattaattttacaaggggtcatgctccctttctgtggtatttctattgagagcttaatgatgtgtcctttatgatgcattttggcagcacctttcacccagacctgaaaatattcattgattatgatcagcaattttggtgttgtaaatggggtgtagctgaagtgtttccttgatgacagagcatagaacagcctgtgcctagaaagggagagagaaagggagagagacactgtgggtttagaactcatttcacttatctaaacatgggccttgttccatacagatgacacaaagaggaactgaagtggaaagtagagtgtatactaggatcagcagttccaagcagaactaggagataagggaaagcaccacattttaggatcagaagctggaaaacaacaagaatctgatggcctcacacactatcttctttgtcttattcactttagccctcaaccactaaatgacccatgttcagatatctgctcatctgaaggcattttaacaaattggcttaaataattgacatatttttcctaagctcctctcatctcctaaaaccaggaaattgtcattgtgattttttttttaaatatcagagcaaagctttgaaaattaattcaattcactggcttttgtccaaaaacaaatctggggacttcaaataagttaagcttttccagatccactgtttccaaggagaagaagttttattgttgttgttgtttaagtattggaggagatgtgagggaatacagaaagatggcaaacgtacaa

SEQ ID NO: 2422 - DNA, 1071 bp, Homo sapiens
agaaaatgaaggggggatattattgaataagtaatttaagacattttcagactgaaagacatgtgtcttcccattgaaaggacaatggagcacctagcacaatgaatgacaaaaaaaaaaaaaaattccaggtaggttatggtaaaatatagaatacttgaaatcaagaaaagatcctagaagcttccaaaggggagggggataacacagtcaaatacaaaacaatggtcttgaatttcttaacagcaactgaatcttagaagacagtggaacaaagcgtgaaaaattctgagtgacagtgattttcaactgagaattctattttttttccaaaaaaaatcaaatataagggtaatgcattttttatttaaaataattttgtcatgtcagaaatataagtgctttagaaaacaacatagtaaaccaacaaagaaaatgcaaaaattgttgtctatcttatgagagatgaagggaaggttcatgattacagcagagtgtgtagtaggtctagagaattatccaccataaaggaatgaaagttatcattctaggatgaaattatccatccttttcttggtggggctctaagaaagagagaagtgggggctgaagagatgaaatgaatgtgtttgagtgaatggattattgatagacctatggcagacatgatgaaatgtttggaaaataattactacaaggcagcacagagtgttggagtgatttctccagggccacacatctagtaaacaatggatctgggcttataatctagctccatatttggtgctcttatccggcacccagtaggacttttcaagcacgtgacaacagggcatgttctttgccatgtcatttatgatgtaactttgattataatatagtaaaaagaaaatccgggtgtaactttattgagaggtactgtttgggatgggggcaaagaaacaaatcttcatcatccatgcctagaattatcgatgaagaaatagcagtgcatgcatatgattcacaaacgtggagctaagtacaaaggagaagcagagcagtttagcgtatttgcctctggggagcagg

SEQ ID NO: 2423 - DNA, 1043 bp, Homo sapiens
ctagctctacttactaagctatgtctcactgtccagctgaatcagcctttctcatatgtcaccagctagcaccttgtccaggagacagctgccaacttgccctctttctgtttatggtaatattattaattcttttgcaatctaattttgaaaccatgagattgacttgagaaagattgacatagggcaatgtctctcaactttatgatggaaaacatttttcaaacatttctaatgtaaaatgtctattatttaaagacttcaaatgaagccttccttgtttattcagtttccccttcaccttcccttgtagctcctgaaactctatcatagaatcccaaggcttctttgatcatggttttgaaaacattactataatagaaagaaccttgaaaaaggagagagaatacatttcttaattatatcaaccttgtgactttgagcaaccctcttaactctgagtttcttttctgatataactgagaataatatctgatcaatttgttggactgctttgatcatcagtctcatctcccactgcaattctgctccccatttatactttaatcttctaatgttgtaggattatttgccctcccctaatactctgccaatttttatgaccctgggccattgaccactttttcttctatatctagaatacattttccttttttctttcagtgaaatccctacttttccagcataaatgacagctttctgacccaatcataatgaagaggggtgtgtgtgtgtgtgtgtgtgtgtgtgtgtgtgtttaatctgcatttgcatggcattttgtataacaactttttacaccatggctgagttttgataaagaaataattgtaaaatttgtatctattttatccggcatctaatataatccttagtatgaaatagattcccagtaattgtttttagaatgaataaatcaaaaacttaaagttttgtattgtgtacttattattattatgctagccatttctgtgtgaagactattttttattcctctgcataccttaccttagacttttaaa

SEQ ID NO: 2424 - DNA, 1025 bp, Homo sapiens
tgttgcagctgaaagaatattttcaatactattctaaatagggatctgggatagacctccatggctcaaaattctggtatcagaatgaaataaactacgaacatttctcactataggatgcaaatttaggtggcttatttcattgtgctttacttcactctgtggcactcatgtcatcattctgcaccttcttttgctattctcatctagtgatctcaccttctctttatagagctccttcatcttccttctctctggactttgccttcgcatatctacccactatccaaccattcctttttttttcttccacttatggtagagaaaagtaagtcactcttctttcctaaaggtggtatctccacagctaattgtatttccattcacacttgtctttctctgatttttctttaaaggcaattccctttaaattctgtagcaacttgaattctcatttcttaaggaaagattcccctccacctagggcttgtggatcctgagaaaatcttttctgagatctgctgccccctcaaaatgaacactcagtccttctttgagttatggaacttccaacagaacatgctgctacacttctgtattcattggtaaactcactgtagtttgtcttcccctacaccatttgcctgcagttgttcactcaaagaaaccagtgaacccccattgttttctcagaccatatccagtttttattctttatagcatttgacactgcaaactatctacctttctgaaagtggctcctcctttgacttctgggcattgcacgattctcgtctcccttctctttccaaactcttttgtctctcctgtacttactgtttgtcctcctcccattctctaactgggagtcttcccccaggatttatccttttatactttgcaactattttacgtgtattttatcagaattcttcatcttatggttttaaataagtccacagcataagtgacttcctgttttatatcaacagccttaacattttcttgacatctctcccaaatta

SEQ ID NO: 2425 - DNA, 1058 bp, Homo sapiens
acggaggagactccgtctcaaataaataaataaataaataaataaaatatccacaggattatattgaggaataaataaaatgaaatatgaaaacattaagaatatagtaggcgttcagtaaaggttaccatttattagtacttttcctttcttcaagtgtccttccaggaacgatttaataggcataccttccccaacccaatttctgctgaacaataagcctagagacaaagtttcccctcaaggtagctgcatgttcattgcatcaccactagcccagcttaggctctgttcatccagtgtttggcttactactccctggatggtttttctggtcctagttagtctaccatataatctgtctttctcagtactgattcttctcaaataaaatatttaccatgctatccttttgctcaaaaacattcaattatttcttattttctatagtgtcaaaactaaacgttgacttctgattccaactgtcatgcgtaactggtacctactagccctcctgctgcaagcagctacaaaaccggactaaattatgagacaattttaagacattgaaaagctgtcagcacaagaatgtaatgtttaggagaagtgaaaccgaggatgtaagcctttctatcacctcagatttttgcctggaggcatttactagatcctggcacaggaaggagcaatcaaagcagatcatgttggtctcattgagctaagaaggcagattggtgctcagagaggctgaaaccatgggaatttgtgaagcacaataccagataggaggtaactatgcaaagacagagcactagattctacataatggttccttcagtgtttacttgaatgccaggtttacatgccatagacacagtgagaaaccatgagtcctggggaaggacaactattggagacagataaactgttggggagctcagccatttctaaaagtggcacagtgctggaaaaggtttgtgctttcaccaactggaatgtagacactttctagaacatcaaaggcatttgataggaggacaggacctcaggagtaaact

SEQ ID NO: 2426 - DNA, 1061 bp, Homo sapiens
cagtccagcctgggtggcagagtgagaccctgtctcaaaaaaataaaaaaataaataaataagaaagaaattcccaggcctattttcccattgccctggggagccattttgtatcccaagctgaagccaatttaatctgaattcattagaccattcaataaatatgtattgtgtgatattatgagttaaaactgtaacaaatttaatgggaaattcagttgtacatgaagtatgatccctgccctcaagaagcttacagttatcttgcacttggaagcacagatccttagaaatagaaagaaccccaaaagtccaggtgtctcattatttaaatgagataactgagatctagagagtaaatgtgattatctttagtcagtgctcttgtctaggtcagacacagtggctcacacctgtaatcagagcacttcgggaggcccaggcaggcagatcgcttgaacacaggagtatgagactagcctgggcaacatggtaaaacctcatctttaccaaaactagaaaaattagctggatgtgatggtgtgtgcctgtagtcttagctactccagaggctgaggtgggaggattgccttaagcccaggatgtcaaggctacagagagttgtgatcttgcactccaacctgggtgatagacaagatcctagctcaaaaaaaaaaaaaaaaaaaaaagctcttttctataacccaggttccagattcaattctgtgttttttccattatgtgatgctttgagaggttacttcgttttgtagttatttttctttttccctccctagctaaattataggtctctttaaaggcaggaagtaatgtctgatatttctttcccattcaggccacccaagtatgttatgcataattagacagacttaagtattcagtaaatgtttgtgggatgagcaagtaagtaaagtaatgaatgaataggtagtgcgaacacaaatcactaaatgggagagaaagcctggaaaacactcattctttcttattccatgtctctgtagtgattgcccttggtttgtggcttagcagctgtcagt

SEQ ID NO: 2427 - DNA, 1029 bp, Homo sapiens
aatccaggtaattgtggaaatggataggggtgcagatgaagcaagattgtccatgtgttgataattgtttaagaaggaaattggtatatggaggcttattatgctattctctatatttttgaatgtgctaaataatctacaatgaagtgtttttgaaaaagatattgaatagctaatagagtattagaagggccagaaaacaaaagcataagacccagcttctagcaataatgcaaaattaagtctcagaaacactttcgtaaggaaaacgctgtagccaccactaaccatcattggagtcatctgctcttatagcagagcgagagacagagaaagagccactgccagagagcacaagcatactctccactcattccctctcaggaacttttgaggaaaaatctgcggcagatgcctgtggttatcagagcctttgccatagcttcaagggagtctgggaaagaggggaaagtaatcatctagtattatctgttccaattacaaggtttcctgtcccatccccactgcaaagaatcaaaatgagagcaattccaaaaatacagaaaataattcagaaatcaaaaagcaaaattgaatgaacaatatttacctccctgggcaagtaggaacctccctgagtttcagtttcctcatctggcaaatgattaaacaataccattctcccaagattgctttgaggactgaaagcaataatgtgtctattaaacagcacaatacaaaaggtccctcagcaatctttccttcctccctgtttttctcccctcttcccttcctttccatttaatttcctatctcacttcagtttctatgttctttgtgttttcaggataatattctatttacttaagggacacaaagtaaataaatgtttttgaaactgaattggattgaagtggatccagattttcacaggaaaaaaaagtttccttttcccttagttctccttacacacctggctttgcaggaaaagaaattatcatttggaaacacacatctgcctcagccaca

SEQ ID NO: 2428 - DNA, 1053 bp, Homo sapiens
aaactttcaaataaataaattttatcaaaaacaaaaatatattttttcaaaactcaacacttcctaattattatcattttactatcatctatgctcttgaagttatatttttatctattctatgggcataatggaaacaatatgtccagctcactttccaacttttcccttagttgcatcacactggtagcttgagatcagctaaggtagaggtattcatatcacaaaaattggcaaacactacaaatcaggatttcatttgtcttgttgactgtctacaccactagttctcaaccaaggtgacgtttgcccctccaatgcctaacatttggcaatgtctcgataaatttttggttcttccaacgggggattactactagtatctagtgggtagagaccatggatgctgctaaataccctataattcacaggacaactgtattaatctgtcctcacattgctaataaagacataccagagactgggttacttacaaaggaaagaggcttaattgattcaccgtttcacatggctgggagaactcacaatcatggaagaaggtgagtgaggagcaaagtcacaccttacatggctgcaggcaaggcagcgtgtgcaggggaactcccatttataaaaccatcagatctcaagagacttattccctaccatgagcacagtatgggggaaactgcccttatgattcaattatctccatctggccctgcccttgacacatgggaattattacaattcaagttgtgatttgggtgggaacacagacaaaccatatcaacaacctcccataacaaagaattattcagccccaaatggcagtagtgctaaggttgagaaaccctggtctagacctaataaagtgatatggaaaatattaatagtgcagattaaagtatcatatctgtactggttacattggcctatgtctgccctcctttcctatcatcacagacaactttagctagccttctgtcttcagaattttccaggcaaaggcaggtataacttcctcaattctcaaatatccccaagcctaac

SEQ ID NO: 2429 - DNA, 1051 bp, Homo sapiens
tgctgccctctggtatctaaaatgaatttaaaaaggtaaattggttctagaactatacctaatgaagaggtctactgttttagtaagggtttgtcaatgacagagttaaccacaatattccattctctgagtacactgtaagttctgcaatggtttgatgatatttcttagctcaatataaataatattagactatttgtgtcaatagtttttttatgagttaatttatacgtttcctttcaaattgcagttttaaaaatggtattaagtttaaaaaaaagaacataaattgtaggccaaatattttatgtatgaatgctaattatcattttatctttgcagattttgaaatacatggccaaatattttatgtatgaatgataattatcattttatctttgcagattttgaaagacatagccaatcgattccatatgatgaatggctccaaaatacattttgtgcccggctgggattgtcatgggttgcccattgaaataaaagtattatcagaacttggtagagaagctcagaatctttcagctatggaaattagaaagaaaggtaaataatctgtatttctgttttaaaatgatatttgtaaacactcaggtccttgaaatagtcagaactttaccaaaggaaccttttgtttgggtttcgtttgcttataataagatctattggaaacgcctttctgtcacagaaaattcagattttatttcattgatttttgtaagaacttatgtttggatattgaaggaaagactttgtgagcatttctgattgcattctcagtttcttaatgttcatattttaaaaaactattttttggtaaattcttttttctgctttcctcaagggggcttgttgactgattttaggtgttaagccaaaattcaattctaaaatacatatattttacattaatcttttatttgatcctttttcttcagtcgactgggccaagggaggattctctttttcttatatgttatactattgtacatttggatgtaactgtgaagatttttttacttccttgtgaaac

SEQ ID NO: 2430 - DNA, 2128 bp, Homo sapiens
tcaggaggctgaggcaggagaatggcgtgaacccgggaggcagaggcttgcagtgagccgagatcatgccactcgcgccactgcactctagcctgggtgacagcgagactgtgtctcaaaaaaaatttgcattctaaactgtctgtagcatttgcatttagagagatacatgctaaaccatgtttaagaattcgaattcattggttttttaaaatctttttttcgtcttttttttagctagatcatttgctaaagcagccattgagaaacagaaatcagcatttattcgttggggaataatggcagattggaataattgctactatacatttgatgggaagtatgaagccaaacagttgagaactttttaccaaatgtatgataaggtaaagaagtattttttctctttgagtaggttttagtatgcgttacaagattctacttttaacatcatatttttgtcttttatagggcttggtttatcgatcttacaaacctgtgttttggtctccgtcatctaggtatatatgcatttttcggtaattaaaagggagaaatttgtgaggcttccaagtatttatgtttaatatttttaacccttaggactgcattggctgaagcagaacttgaatataatcctgagcatgtcagtcgttcaatatatgtaaaatttcctctcttaaagccttctccaaaattggcatctcttataggtaagatttattcatagcttgagtgtaccaaagttatagaattatcccatttgctaacatatttacaattgtattttcacagatggttcatctcctgttagtattttggtctggaccacacaaccttggacgattccagccaatgaagctgtttgctatatgcctgaatcaaagtgggtatattattgcattttttgttttatacacaaatagaatgtattccattattaacattattttgaatttattttatcctgtttattattgtaaaatttaatgaattataacttagttattatgttcatatagattttattaacctttaggtgatcctttttatgaccttatccagcttttcgggaaaatgaaatagaagtataagttacaaagtgttttgaaaatagtacagtttgatcttgaagtcagttttttcttttttctttttttttttggagaccgagttttgccttttgttgcccaggctggagtacagtggcatgatcttggctcaccacaacctccacctcccgggttcaagcaattttcctgcctcagcctcccgagtagctgggattatgggattacaggcatgcgccaccacgccaggctaattttgtatttttagtagagatggggtttctctatgttggtgaggctggttgcaaactcccaacctcaggtgatccacctgccttggcctcccaaagtgctgggattatagacatgagccaccgcgctggcctgaagtcagttttttctaaaatgattatttaaaaattaaaatgatatctgtggcttttcttgtttcattattagtaatttctcctaaaattttatgttaggtatgctgttgtgaaatgttctaagtctggagacctctacgtactggcggcagataaagtagcatctgttgcttctactttggaaacaacatttgagactatttcaacactttcaggtgaagatttttagatatctgacaacatagtcatcaaagtattgggctgacttgaatttactactttgctgaactgcatattttgaattgaaacagatatggcctctacctttctagaatacattttacattgattacactaaaggagaatatacattaagcatgataggagtatagaaaaatatgaatattgataaatgtacaacaggtaaaactaatttctggcaatatccagtagttacttggtaaaattttatgcaaaattaatttttaaaattgtttttatctgttttaataaaagtagcaagaaaggaaatgcatatacttatttttcgatacataattttaataaaggattgaataagttctgaaaattattcagaaagcagttcttctatcaaaggaattttattttattttattttttaaagagacagggtctcatgctgttgcccac

SEQ ID NO: 2431 - DNA, 1651 bp, Homo sapiens
gttcactacagcctccgctttagcttaggttcaaatgattctcccacctcagcctcccaagtagctgggattacaggctcacaccactgtgccctgctaatttttttgtatttttaatagagatggggtttcaccatgcaggccaggctggtcttgaattcctgacctcaagtgatcctctcgtctctgcctcccaaactgttgggattacaggcgtgagcaaccacgcccagccaagttgactactcttttattttttgagacggagtctcgctctgtcacccaggctggagtgcagtggcacgatctcggctcactgcaacctctgcctcccaggttcaagcgattctcctgcctcagcctcctgagtagctgggattatgggcacacaccaccatgcccggctgatttttgcatttttagtagagacgaggtttcaccatgttggtcaggctggtctcgaactcctgacctcgtgatttgcctgcctcagcctcgcaaagtgctgggattacaggtgtgagccactgtggctggcaaggtgactactcttattgccacctgttgctgcagatttagtattttctggaagtttagagcatttttaggattttcacagtactttttaattatgtctaatttggtgtttttttttttaaagttataaagatgcttcagactgcaaagaatttgttgaaagaggagaaattggtgcatagctatccgtatgactggaggaccaagaaacctgtggttattcgtgccagcaagcagtggtttataaacatcacggatattaagactgcagccaaggtataaaaagcatcctgttttaacaggtcgggcatatcattccctcagtataaaggggctgcatgtgaggttgaggtggggtttcaggagtaatagggattgctgctattatgatttagtttcataacattgtagaattttagatctggaaggaccttggacttccattttttcattatacatgtgtgagaaatgaggcataaagaggttgagtgatttgtccacatcacactgttagtagatagactttcttgcccagtgtagtcaaagttgcatagaatttggacagaactgtgttacctagtttaacctcccactgcctctgtttcctcatctatataaagtggtaataatgcgtatctcatggagtaaggaaattcgagtttccagaatatggtctgatacataataagcagtcagtaaaacttttttaaaccctttgcttccttaagattgaaattacaatcaattaaaaaagttactgttctgcttacaaaggaagcatattaaaaagaaaaactaacaatatgaaaaatatacaaagttgttgctttggagctaacaaatacttataattggtatttaaatacttaatatatatttgagccctttcatttaatatgtatctttctatatgggtatatatatatatatatatatatgtgtgtgtgtgtgtgtgtgtgtgtgtaaacatctctcacaacttgattctatttaatgaaagagcttaaatatatatgtgttaaccaggttgaatatatagatattttgctttacagtttgaaagatactactgtatttagctggttcatttattggcctggcaatttggggtcct

SEQ ID NO: 2432 - DNA, 1002 bp, Homo sapiens
gcatctatttcaaggtctgttttgtaaagtaaagggatgagggtaggaggaagtactctcagaccattgattgcatcagtttagttttgagggaatgaggttggactgatacagtgtcagtgggaaccactgtaatctttcaaaggtagaactgagagaatgtgttggtttaatttaggcagaaatcagaagagggaagataattagaaggctttgagtataagtacctggatagaaaatagatgagtaagaaataggtaaatcagtaacggaaacagatgttttttctttttaaggatatgtataatcaattttttatttatattgaatttaaaatgatagcagctttttcttcaaactaaggtttgaggaaaaaggaaaataaatcactatttcttaattttaaaatgtttgttattcatcacaatagttaattgaataattctgccatgtcccccctgaaatagccaaaccactgagcatattgttaaactagtggaacaacacggcagtgatatctggtggactcttccccctgaacaacttcttccaaaagaagtcttatctgaggtaaatttctgtttgtatttaacagcctttgtatgtattacaggacttaatgacaacatgagaaattcttgagagttaaaaaattatcttatgtaaagttaacaaatttatttactgtaaattagaagctaatgcagtgtgaaagtagacattttgtttaactatagaagtgtagtatttaaggctgggcgtgatggctcacacctgtaatcctagcactttgaaaggctgaggcagacagatagcttgagtccatgagtttgagaccagcctgggcaatatggcaaaaccctgtctctacaaaaaaatataaaaattagctgagcattgtggcatgcgcctgtagtcccagctacttgggaggttgaggggggaggatggcttgagcctggaagacaggttgcagcgagccaagattgcaccactacactg

SEQ ID NO: 2433 - DNA, 1031 bp, Homo sapiens
gaccctgtcttaaaaaaaaaaaattgtgttttctcataattggaaatgtgtttgcattagtgtacccttaagtcagaggtgtacataccaattttgcccaaatcaaaaataaatgaggcataaatgaaggaacactaatgaattgttggtgacgtccactgtttgctgttgttaaaatggtgtgattttgttatttacaatctcattctttccttaattaatgtcctttcgtagttctcagagtaaaatagtattttctgagtgtagtcaaatgtgttatccagaaatgacatttggaagattcccaggagttcttgcatattgcctgttttgtatttgtctcattgaaacatatttttgaaaggagcatattttgcttgtgatgacttacattttcatttgcctgtctcagcttccaaatttattttggctttgttccctagattaccgaattatacaaacaatatgattttggaaaagttgttcggctgttacggacgttttataccagagagctctctaacttttatttcagtataatcaaagataggtatgtatgactaaatattaaaatgcttaacaatggccaggtgtggtgactcacgcctgtaatcccagcactttgggaggccgaggcgggtggatgacatgaggccaggagttcgagaccagtatggcaaaatacaaaaattagccgggcatggtggcacatgcctgtaatccgagtcactcaggagactgaggcacgagaatcgcttgaacttgggaggcggaggttgcaatgagcagagattgtgctgctgcactccagcctgggtgacagagcaagatctcgtctcaaaaaataacaacaacaaaacctcaacaagtattttttgagtgtctacttgtgtttggcaaccgtcagggatacagtgatgagcaagatgggcagtgttgtgcagttattaagattgggttccgggccaggcgtggtgcctcacgcctgtaatcccagcactttgggaggccgaggcgggcggatcacgagg

SEQ ID NO: 2434 - DNA, 1048 bp, Homo sapiens
tgcctgagtagatgtagaactcggtgacttgggagatgtcagttaatctcagagtcacggggtctctaattcctcagctcccttcaggtgttgagttgtatgatcccattatcttggctatatatgtaatgggacaaatggggaagtgtctgacaagctttaccaaggcaggacaaaagactgaaaaagaagcctctgctaaaccaattaagaaacagtgttacaagttgaatgcctatcagaaatactcttcatgtatttttttataggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactgactgattttggtgcagaagttttgagtatcaagtaaaagaagtatagttttgaaagggaatggcggaggcctgtttcccttaagaggtgaagggtcatttcattcttcccattagtgaacatcagccttttcagaatagctagtttttggggttggatcagaaagaatataatcaccaaatttgttactcaagaaaggaagaaatctcttaatagttagttatactt

(The sequence listing continues in the following parts.)

What is claimed is:

1. A method of activating an inactive X-linked allele in a cell, preferably a cell of a female heterozygous subject, the method comprising administering to the cell an inhibitory oligonucleotide targeting a sequence of at least 12 consecutive nucleotides within SEQ ID NOs:49590-49613, wherein CTCF binding to Jpx RNA is disrupted.

2. The method of claim 1, wherein the inactive X-linked allele is associated with an X-linked disorder, and the oligonucleotide is administered in a therapeutically effective amount.

3. The method of claim 1, wherein the cell is in a living subject.

4. The method of claim 1, wherein the inhibitory oligonucleotide is identical or complementary to at least 15 consecutive nucleotides of SEQ ID NOs:49590-49613.

5. The method of claim 1, wherein the oligonucleotide does not comprise three or more consecutive guanosine nucleotides.

6. The method of claim 1, wherein the oligonucleotide does not comprise four or more consecutive guanosine nucleotides.

7. The method of claim 1, wherein the oligonucleotide is 12 to 30 nucleotides in length.

8. The method of claim 1, wherein at least one nucleotide of the oligonucleotide is a nucleotide analogue or a 2' O-methyl.

9. The method of claim 1, wherein the oligonucleotide comprises at least one ribonucleotide, at least one deoxyribonucleotide, or at least one bridged nucleotide.

10. The method of claim 9, wherein the bridged nucleotide is a LNA nucleotide, a cEt nucleotide or a ENA modified nucleotide.

11. The method of claim 1, wherein one or more of the nucleotides of the oligonucleotide comprise 2'-fluoro-deoxyribonucleotides, one or more of the nucleotides of the oligonucleotide comprise 2'-O-methyl nucleotides, one or more of the nucleotides of the oligonucleotide comprise ENA nucleotide analogues, and/or one or more of the nucleotides of the oligonucleotide comprise LNA nucleotides.

12. The method of claim 1, wherein the nucleotides of the oligonucleotide comprise comprising phosphorothioate internucleotide linkages between at least two nucleotides or between all nucleotides.

13. The method of claim 1, wherein the nucleotides of the oligonucleotide comprise phosphorothioate internucleotide linkages between at least two nucleotides.

14. The method of claim 1, wherein the nucleotides of the oligonucleotide comprise phosphorothioate internucleotide linkages between all nucleotides.

15. The method of claim 1, wherein the oligonucleotide is a gapmer or a mixmer.

16. The method of claim 1, wherein the inactive X-linked allele is CDKL5, MECP2, or FMR1.

* * * * *